United States Patent 7,868,149 (PLANT GENOME SEQUENCE AND USES THEREOF) - sequence listing, part 64

SEQ ID NO: 34725 - DNA, 30710 bp, Oryza sativa
ttaatcatcgtagcccttgggttaagacaggttcgtgtaggttcacgcccttgattaataatattgtatagctctagggtcgtatttacaaaatagctttgagcaactaagtgtcttttaatgctgttactgcaaacccctaccccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcctccgctgtttttcgtttgtcttcttgtgtgctgggccttcgccgcccaggtaataaattaactatttacgcttccgcttgataagctctaaaatgtatcaacttttggtataccttgcctcctgggacatggaataatacacgcacgtaaggaacgcccgttgggttatttccggtcgtgacaggttattgctaccgaagtctaatttggttccgagaggggggcatattaccactaattgcatagtgtgcgattgtaatttttttgttgcaataagtaggaagtatcgcaacaaataaatttgcgttaaaattagggtgacgatattgccgcgctttttgttatcgttgcaatagttatccatgtcgcaacgaatttagagcgttgttattagagtcatgtatatagcaacgcgaaactactttgttgcaaatgagtctgtagatattgcaacgcaaacctaaatcattgaaaattagtctataggtattgcaacgcaaacctaaatcgttgcaaccattcttagatattgcaacaaccaccggaaatcgttgcaactaacaagattctctcgcaacaatatttcgtcattgctatagtttaacgaatcgttgcaataggtgaaattggtggtgccacctacagattgttcatgggcctttgtattgttaaactttaacttgtttgcatcattgtggcccgggtcggggtcatgacttacgtaattaagtcggcccggccaattagctgggctgtatcgtgtaataaaaacaggtacgattaaccctacccttagcagtcgatagatagatccctgatcatagactagctggcgccagcgacccttttatatcttgcacaattgccggcgacaccgaagcactcgacgctagcgagaccacaccctgtccctatctcccaactcgatatctcgacgccgttcgaatcgatccctatatttatatatattcaggtacctcttcgatcacgagtgcaatgaaaactattgattctttattttctatatatctatgtaattaaaaattggcttatttcattgcataccaccccttaggcaaatttggtaacaaattttctcaattggaatatggcacgtgatgatgatcatagttggatgctattgtctcagtcagattgtgtgtggcaagttggatttgaaaaattcatttaacatacatttgaaggtacccatccaggagggactgcggcctgtccatgtactaggtgtcgttgcatggcatacagaacgaaaattgaggttcaacaacactttgcttggtagagggtttgataaggatttcataaaatagaaacattctgttagtaaacctatggttgtggatgatcaggagattagtgaagccgaagttgatgatggcggctctatcgataatcggctttcttcgctaatcagagatagtaatattgaggtgccaaatgagtcagcaaagaattttttcaaattaatggaagaagatcggaaagaattatacccagggtgcaaggaggctaccatggtatctttcattgtcaggctatttcagattaagtgcatgtatggtatcagtaacaatgccatggagcaaatacttcacttattctgtcttttgctccctgagggacattgtgtcccaaatactttggataaagttcgtaaggtagtccaagatctcgggttggactaccaaaagattcatgcttgtgtcaatgattgtgtgttatttcgtggagagtatgataatatgaacagatgtccaacatgtggggagagtaggtggaaaaatatatattctggagaactcggggaaggcagtggcattggaggagtaaagaaaaaagtccttcgtcctcgtaaaatacttaggtattttccacttattccttgacttcaacgattatatatgaatgacaccacattgacctatatgcgttggcacaaggaagaaatagttgatgatgggaaagtgcggcacccagcaaactcattggcatggaagcacatagatgaaaagtacggggatcggtttgaatctgatccacgcaatgttaggattggacttgcatcagacggcttcaatccatttgggatgttgaatgcgacttacactacatgggcggtgatcctaattccatataacttgcctccttggttgtgcttgaaacaatcttattggatgatatcgatgctggtacctgggcctagatctccaggaatgaacattgaagtatatttgcagccactgatcgatgagcttaaacagggatgccaaggtgaaaaagaattttacgcttcgtgcaattctgctttggacaaaaaacggttttcctgcgtatgccatgttatcaagttggagcagaaaaggcaagtttgcgtgtccttattgtcacaaggatactgaatacttgtggttaaaatacggcaagaagcattgctacatgggccatcgccgctttttggcttcaaaccacaggtgtagaaagaacaaggttagcttcaataacaaggttgaaatgagggggactccagtggcactcagtggtgacgaagtattgaagcagtacgagagttttgagcaagtcaaatttggcatgatgtcaaggaagaggaagcaacgagatgaagatactagatggcacaactggaggaagaagagtattttttttatcttccttactggaaatcattgcttatacaccataatctagatgtgatgcgtattgagaataacatatgtgagagcttgctaggtactttgcttgatttaacaggtaaatctaaggacagtgagaaggctcgacttgatttgcaagaattgggtattaggaagaatcaacatctattggtccataaaggaaaatacactttgtcggcagccttgtacacgttaagtccaagtcagaaggaaattctatgcagatttctacaacatgtcaagatgccagatggttatgcctcaaatatcaagagatgtgttgatgaaaatggttggaaggttagtggacttaaaagtcatgactaccttgttttattacaaaaacttttaccattggtggtatgccatattttgcctgaagatgttgtgatcccattgatcgagctcagcaggttttttaacaaactatgttcaaaggagcttgaggtgactgaaattgaaaaactttgcaattcgattggagagaccctttgtcggcttgagatgatattccctccatcattttttgatattatgatgcacttactagttcatattgcttcggaggctagaattagaggccctgtttgttatagatggatgtatcccgttgagaggtacctacgtacccttaaaggctatgtgaggaacaaagcgtgcccagaaggttcaatagcagaggtatatatctcggaggagtgccttactttctgtgctcggttctttgaagatgttagtacaaaggtgaataggccagaacgtcaagaaatgtaacaccctgaaaattcaaggcaataaaaatcactaaatgtaacatacccgaattctaggattaaggaatttccatcaaaactagttgaaaggaaagttcttcaattttgtgaacgaaaaatttccattttaaaccctaggtgaagttaatctaacttgtactgaagtaaaatctgagaacaaattaaaaccttttcatctttaacctataccatagatgcaaaaacaagtgaaagcatgcatactcgtttacatcatgttttgacttaagtccttcttatgcatttggattttcgttttgcatttcataataggtctcatgaataataactaagatctagataaacaactaaaccattagggcctagtgctagctagaggaagttaaaataggaaccatacaccttaaaatatatcaaaaaggcctatgtcaagccccacaaaactaaatttggtcatccatttgaagacaagtcataaacatggaagtgaacaaataaattaactcatatagggtatattctatcttaatcatctctataagcattctcttaatttaatactaaagtaaacttatacataaataggtaaggagcttacgacatgtgtaaggtaaactataattttaacatatcaacatcaccttatgttaagaagagtccaaatataacttttataaacatttacatgcatttaggcaaaggaaaacacatataagagataagtcttactaattatctataataattcgtgaaagataaaatcatgggaaaaattcatgtaggctctaattaacatatacaactcactgtaattttggttcaatttaataacaaaatttgatacctcaaataaatcagtcaaaccagttaaataatagactaattaaaattcctaatcggctaaaaccatactttgtttaaaaagcatttaacttcatgggagtgtataggggaaacaatttattcaaatactaggtcatttattatgaataaatatattttttccagaatttatcttctctgtttaggtctcctaaaaattcaaacagtttccattgagcccttcttcttttaatttctgtgagcaatctatccataattcgtgagtgaaaccaaataaaatggaaactaggtacattcatctacttccagtaaaatccacatgaattgatctgtaccccaaaaataatatatgaattaacaaagatgggtaagagaaataatcctgaaaatttgtctaaaatcacttacacccaattatctacccatccctcacaccaccacctagcttacaccgacctggacccacctggcagcctccttggcttgcccttcctctgtgcaacttctctagccgaccaaaactgagaaagagaccgagccaacagccctcaggcgcgtttgacacgtggccacgacgtgtcgacgatctaaaaacgccgagctccatctccgcctctcccagacgcgtcgtcactcctcacccaccattccagtgccgatccaaccgagggagagcatccttgctgcccttctccaccgtttctctatcgccggtcgcgaagaagatgatggccacattcgttgatgagccacggtcatttcctcttcttttgcattccaaaacctactctcgatgccatctctatttcatctaatttcgtcccattctatgcagcggttgagcgggaacgccaccgtgcccacaaacgccctggagcgcacaacgacgaccgctgtcgggttctcgtcgtcgttctaaccaaaccgaaccaccccaagccgaacccttgcgccaccagaatcgcctagacgtcctcttcaagattctccaagaacctcatggatcggtgaatcgaggagggatatcggcgtcatcttctccatctccggccgccgacatcgatcttcgattccttgatcccgggtgagcttcagcgcaattcctgactcgtgtagcatctttagatggtctttgagccgttccactctttttcttggcagcccggagtccggatggtggttgtcaccgttggcatgccgatttccgccgccgtcgggacatcctctgcatcgtcgtcgctgtccaggcctacccgtaccgcgtccgagctttggtgagcaccctgcagcctatagaacatacatgcatgcatccctttgggtacatccagactatagcatgacatgcaccaccacccgaaaacatcctctgctcggactcgccgctggcgctactccaatgtccgctatctgataaatgtataggaatggaatcgaaataacatgatcttcattttgtattttggtcgcacccccaaacgagccatcgtttgtcgccggcgagctcgagatcgagctcagccatggcgctctgttctgtccaggtcgcagggacttcgctttgagaatttaaacaaatataagggttaatatgaaaacatactaaacactgacatatgggcctaggactgcgggttggtttctagaaatctcaagggccttcctgcatattggccgtatgactgacagcggacccctagtaacaaaatctgagattatgtaagaaaagtacctaaaacttgtaaaaaatccatagaaaatcaaatataactcattttgagatgattatgtaaactcatataaggatgaactttaatgttatgaaataaaaacttacacttgcagtacaaattacacctctaaaatttatttaagaaaaaaatatacataaagcatgcacaaacttataaaatgcatacaaaattcatctcaactcattttagggtaaattcacatttcaaggaatcataaatttgttgtccactgtaaagtgaaataaaataatatacttactttgtacctgatgcctctaaaactattatctttaaaatgaatagttttagataagctgaactttagaagttcatataaaattcatcttagatcctttttgagtaaacccaagttctgtagattcaccaaaacatatacttccaatttgtaaaataaaatcatatacttactgtgtaataaaagcctctaaatatttatgtaattaataaccaacatagagcaacatttaatttgtaaaatttgtagaaaattcatctttagtctaaatgaagtgaaccaaatttctataggaccagcaagtaatgtaattcaacctagtagagtgaaatatggcaccctctgttcataccatagctctaaaccttaatttggtagtataggtactaaacacataatagtggttaaacaatacatataaataagtatatatatgcatggtagctccaaataattccaaataaaacttgttaggaccagtggatccatagttccatccccatccacaaaaacttagaagaacttagctcatataataatttctagattgatataatatattgctagcatagactagagctcccctagtttataagaatatgaactatgataataaagaccataagcttatgaactaaggttagactagttaactaaaatactcattttgtacatcactagctagatgaggcaagttctggacctaaacctctaaagccatgaccctatgtaacactatacacctataacacgttataacttgtaaaatacataaagaattcatattaactctaaaaattgtgaaaccaaatgtgttagtcttagaaaacacatatcttcaccttaataaacttaataagaatcaccttacaacagcatttcataatagtacctaagtaaatcctacactataccgacgaaacttctaaaattcataactctcaaataaaatgagataaaatagaaattctttcacctaaattcattttagaccagtacctattcactgtgcacaaatcatgcattttagagcattttgtatttttcacatatttcggtgtttaattgcattaggtgtactttgtatagatgattgcttaaacggtgaagaagtgaattaggtgctgacattttccagttgcaaggcaagtcccaccttcctctctttgatcattttgaacctttattttggaggttattgcaaatgtttgcaaatcttgcatgtcgattgtacactaataaattaaaattttcttaaacttggtagaaaaactcctattatttgcattatcaccctaaccccacatatatccatatccatcattcctaaccataggaacaatatgactatgccactttgtatatgagtttagatgccactagattgctataatgcttagccatgcttacaatggtcttccttgtcattatgggctcattacaaacatgtcaattgattttgaaataatctggacagaactttaatacttgtgattttgataaataaaatgatggaaaacgtggattttaggtttgggctcaagtggtgcacatatggtgattagttgtgtaccgatagggggagagtgcacccaaaccgacttaaagacttcactcaatgtcagtccatttcgtatacagtacaaccacatgtgctagtatgggatagcccaagcttagtaaatcatttatggtttagccttacattctggtaggccagtgtgggtgggttcccgttgtgtccgccaccacggcgttaagtttaaggtgtgggcccgccacttaacggttctaggtcatataacgtgtaggcttaggatggagtaacacgtatcgtgctggtgtaaggctaaatcatgaattttgaaaaagctttgttgtgggtaataaatcgggtacttatgtttcgcgtgacacgctcttgcatgattattatttcgcatcatgtgggtaaagtgtacaaactctgcagagtaagaactaatcgattagccgtgctcacggtcataagcagcatgtggatatgtattgagtatagacttgtgtttattcttctaaatgttgaatttaccttcaaattatgttgagatttgagaatgatctccttgctgccatggatggcaatgaggtgcacatttatacattattaatgcctactttgatgcccatatgctaagtactagcttgctgaaatttatttgaaagaaaatttgatttgaatgtggtttatgcaaataaaacttgctttgtgctaaaaagaaccatatcatgccttccttgattatatgccttgcaagtagggtgttaggcttgtcttggtgcttgccagtacattatttctaataatgtactgattcttgccgttgaattaaccttttgcttgcaggttttagatttagtctgtgagtgatgcgcgtaatcgactgcttcgcctaggatttgaacataatggggtaaactcctagtcggtgtgcttgtggattgggtagacaagcttccgctgttctatatatttatttggccggtcggcctatgtatctctaagttagttgtaattttaatcgctttcatctttatttgtgtttgctatgtatgtccatgcttaagatgaaagtgtgaatctagtgcacatactgggaattagattcacatgagtataagttaagaatatttgagatgttgtagatctttagctatttttgtcaagtctcctgaatgtgtaacacatctggtcgccgccttcgagtggtttgacgggcacatctcaggttgaagttgactggcaggatattcctctcttgaggcgtcggatatttcattatgcttgttagatgatttgaattattcatttcatctctcaattataatggaaggtccgaagagcctacaacactaaaattttgaactttttaaaacttttgcatcatgctggatgttatggttgctattgcttgccaaatcgtaaatgatcataaagaaattaaagaaaagatctacatttaagcaatagataaaatttacgagaatatattatttatgtttaaccctataaatacacacgaaagcaagccaaataaagtacaagtcaaatattaatttctattttgaatcacaaatcaaatattaaatattcgaaccatcttgatagcttgatgtcatatttaacaaaaggaaatactaagattaaatataattcatttggatccacctcacatgaaataatgtcaccaccataagagcatctccagcagggtccctaaaccaaagtccataaataagttgtgagagttgattgcaaaaaatataggtccagcaaagttcctactagagccccaatctagggaggcccctagatcactcctccaagcccccagtccggggggctcaaccccacagcccccatcctctttttttttggcgggggaaatttctgagcgcgcgccattgtcatcctccctccctcccgcgtcatcgccatcctcccacaacctcccaacgagcaagccgccaggtcgttttgctccggccggcgaccacccgacatccctcgggaagaaacttcggcgagattccacagtgtgccgcctcaagccatcacaatcatcggttttactccgtcactcactgtcgccgacctccttgcatctttggccaacgcgcgtcgtcaccgatcgatcacgcctaggtgagtctcgacgtcctccccgaactagctgctcacccgctgtccacaaggcctagcgccgaccatcgacagctatctatcaccggccgcacacatgctgcagtaaaaaaattcagagatgatggtgattaaaacaaatcacaatagtaaagttcagtttcgtatgtctgagtctccttgtttgattttgatctttatgggcttcctaggcgtctaggcccatctaaatcattcgcacagcaaaacgtacattgtcatcattcatgttttatatgcaatgtcttgttctatgtcagagagctaatcttgctgagcatatataatatttaagaaataaatttgtgtttgcactgagtccttagtactgcggaaccaatatatatgctaaataaatacatattgcaaacagtataacctgatgtacattgcaatcatttgttgatgtttctgagatagattggaaaggttgtcaatttatatatttattgcagtgactagattgcaatgacaagtggaggtgattcctttgtgcgcatgatgtccgaggacactgatgtcgaagtgctaatgccaaatgaagaccttcgtacttcaacaaatggtgcaaaaggaagtgccaaaagatcaagcaactatactcgtaaggaggacattcaattgtgcatttcatggcagagcattagctcagatcctattattggcaatgagcaaccagggaaggcatattggcagaggatcgcagagcactaccatgctaaccgtgattttgagtctgataggaatgcaaactctcttgagcaccattggggtaacattcagaaggaagtaagcaagtttcaaggttgctacaatcaaattgagcgtcatcatccaagtggcataccacatcaagagcttgtaagttaaattgtttatttattattattaataacaatcttgtatgtatgtgaactaaaacttaaattatgttgcaggttcttgaagctgaggcattatactcgtccactgcaccaaagaatagggcatttcagtttaatcattgttggctcaagttgaggaattctccaaagtttcaaacactagaatcccacaagaggccacggtctaggaagtctttgaccccaattgagagagctggtgaagaagatgaaggagatgatgctagcaagagtacagctcctgatttatctcagccgagtgctaaaaagagaccaataggtaggaagcaagcaaaggagaagttgaagaatggaggagaagatggaccatacaaagaggcgatgaaagatttgcttgacgctaaagagaaagaagcgaaattgaaagaagagagatggaaggaaactaaggagattcaagagcgcaagctcttatttgctgagcgtaagttagtgtgggatcaagaacagaagattatgttttgtgatgtttccaccttggaaccggatgtgagaacgtatgtgttggctatgagggcacagattgcagcttcaaaggtggctgccctcaatggtggatttgatggtagtagtggctttggaggtgagtttggtggcggtaatggagaagtttgagcacttcgatggaataagttggattctattggatgatccacgtgtcctttactagtaggatatgccattatcacgattggtctttgaagtccttttttgttaattatttccacaataattttagtgtcacttgctagtaggacatatattactttcagatttgttatttataatcgaaccattcatggttgtaggatgtattatttttaaattatataatgcatcattgggttcacatagtttattttttatgagcaattttcattttcattggtgaattacgaatattggttgcatcttgttgtcgtatatggcactgtacccataccatatttacatgtttaaaaattttaattttgtattcgaattgtagtatttgaaattgtgaatttaagtatggttaaattatgtgagttagaaataattgtgttcgaatttttgtggtgttaaacatactgtatatggattgtattttaaaatacaagataaacatgagtagggactaagaaatagggggtactgctggagttggaggcattttttagtcattgagaaataggggcagcccttatttaacttttaggtgcttcaaaataaggtctattgctggagatgctctaatgaccctatctatatatttcactcgaatatttaacatatctttcttcacataaaattcacttatgtaaaatggttggtcacataaataactagagcaaatatatcactacctttatgatggatttaatggaatattttaaacctacatttagatattgagtctccaaaatatataagttctgatgaggacatcaacaccatcgatacatccatgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgccacgacttcatgcgaactccgatttgggcgtgcaagtacttcatggaaagattatcaagtctactttcaaatggatccagccacatgtccatatctattctggagcggccgcaattgtcattttactcccgactattttttgtccatggtgctgcgtcacctcttttggcccaatgggctgtgtatccatgttgggcccattaggggcgcgtcctagggttggagcacgaccctattgtcgttcttcccctctttttatacctctagtcgccgccaagaataggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttcgatgatcctatagaccattgtgccttttccctagtacttgttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccatcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaaaaaaaaaagaggatccagcgagcacaccacaccattccccctttgtcaccaccttctaccaccggttcttgttttcgttgttgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccagaggataaagatgaggagggtgcatctcattccccacgcaccaaaggcatcatccaatactttacaaggcaagtgaagcagcacacagaaggacttgatacagatttgcaggtgacaaatgagaagattggacaataggagtccacgcagatctccaccaacactaagcttacagggttggagacagcggtcgcccgcattgacactagccttgctgctcttgtgaggcattttgatgctctcaatgctggaggcaatggtgggggtaatgacgatgacattgacggagagtacatcgaggataatttagaggatgaatatattgctgacactgaacaagatgatcgagatgctcaagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgttcctctcttgggagattgctgttgaccaaaaatttgcataccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacactgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtccgtgacaaaggccgctcagccagcaccgagtgcttcttcaatggtatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcctcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggtgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtcttctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattactgagttgattgcatcaccttcagttgcctatgctttggtatgcaaagatgctttgatttcacttcacgatatgcagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaccaacatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtatgctagtgggattggattgggtggtgttttgctacaagaaggaaaacctgttgcatattttagtgaaaagttgagtgagaactttagataaggaattattctacttatgataaggaattgtatgctcttgtgcgaactttagaaacatggcagcattatttgtggcccaagaattttgtcatacattctgatcatgagtctttgaagcatattcgtatcaaagggaagctgacccgtagacatgctaattgggccggatttattgcatcttttccttatgtcatcaaacttaagaaagggaaggagaacatcattgctgatgctttgtctaggagatacactttgttgacacaacttgactacaagattttggcctagaaacaatcaaagaccaatatgcgcatgatgctgattttaatgatgtgttgctgcattgtaaggatggaagaacatggaacaaaatcgtcatcaatgatgggtttgttttcagagctaacaagctatgcattctagctagctccgttcgcttgttgttgttgcaggaagcgcatggaggcagtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattctgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggagttgaattttgaacctggagatatggtttggttgcatttgcgaaaagaacgatttcctgatttgagaaagtctaaattgatgcctagagctgatggaccatttaaagtgttagcaaagattaatgagaatgcatataagattgatttgcctgcagatttcagggttagtcccacatttaacgttgcagatttgaagccgtatttgggagaagaagatgagcttgagtcgaggacgactcaaatgcaagaaggggaggatgatgaggacatcaacaccatcgatacattcacgtccccccatatacagcatgatggtcctattacccgcgctcgtacacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctattgtcgttcttcccctctttttatacctctagtcgccgccaagaataggcgggttttgatgatagagatagcttcttgctaccggctcgcagcgcgcgtgttggctaaaccgcccgtctgcctgtaatcggaaccccaccatattgtgtttgatagtgaaactttcatctttttctagcaatctcagtgcttgtcctacttgttcttgcttgttcttcgattgcttgcaggacgagtgcccttgtggccgggttgacgcgcaccacaagttcgcggcgaccattggagacggtgtatcggttgctaaggtgcagcgtctttggacagttgtagtcgggccgtgaacgtcgacttcatctaatcgagttatcccttacctctcatcgaaagatcgggccacaaaccctagcgggttcgcatcaagttcaccttgggaaaaatccaaattaatctaaaaacaattcaattgtgggtgaataaataaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgaccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattaatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaagaagctctaccaccatgatactaagatctttgagtgaaagcttgtttttttgttaattgtcctttatgcggtgaacctggagaggacgcggcggccgtggcgccaccatgtggaacacacccactcggcggtgtcgtgtttcatcatctcccacgttgggctgttccccaccaggtggtttggatctgaatccccttgaatagttgatttacgattgtgccctcattatatgtgtgttgtagtgttgtaccgatatgaacgaggggtaagtcagtccaaaccacaagaaaattcacaagaatagcagcaggtttttacttttaatgcatgaataaaattttaaagtagtttatctcactcatatgagttcgaaattagacgattcctttttcattattcatataaaaatattgtctacaatttcgagcacgtttagaatgttgtcaagtaaacagtgaagactcataaattgaaattcaaaattttgaattgtagaacaactgtgtggtttttcttttaaatctctaggtaaaacttgtagaaagtctttctccctcatactgacttcaaatttgattattcttttttctacaaatttctaaattcatgatctatcaatttattgtgttattacaactatatttttgtttactgctagataaattaatccgagctggatgtgcatgtgcttgaaagatggacaaatttttgggtggtaacttttgcactgacttcctattagcaaatggtaagaatggtcacttgaaccatagtgtccaactgatctacttagtgatgttgctgccacattgttaaattttggaagtgggaaaatgctcttttgatgtgttttgggttcctgcctggcatttgcactccatattgtcgtggaactgttgttgtatgcctgtactttgtagaaatgaagcatgtttaaattgtgtccataactttacaccacactttacggtcctgcatacaaatctgtatatctaaatgctatatgcctatagtctgtagaaatgaagcatgcataggaagttacttgtatcataactttagtgtcgagaaatgtccaggggtcttccggctagctccacaaggtggtaggctagacgacctgggttcaaagcctcacccctcctaattatttgatattaggtccttccctaatattctagtttttttttatcataactttagtgtctaatttttagtgctacactcctatgcattctagttcagttgcttgtttgtttggccagtgaaatgaggtgggttggggatggtgacattgagttctgttagtgcaatatattatggggacatcggattagtgttgcaaattagccctttcattcaaaaactaatatcgtatctgtcgattgtttcttgttgtttctctagcgcataaaaaaataatctaacatatggtactatcctatcaggttgctgtgctcctccccatcaccctcgggcaggtcagaaaaataattgatcctgaattattattcagttgtatctgatttggagaataagaaatttgatgttgatataatctgaaacttggttttgtttgattgtcaggtgttgatataagctgtcttagtctcctttattatcttatgcactgtgatgaactccatctacttattttagttgtgttgatgcttctatgagcttactgtcgtgtggtggacttggttatgtaaaatgatgtttggtgctatggtggacttaaattatcatcctgtggtaaacttttgtggacttaaatgtgaagatatgtgtactaggttgtgtgaacttatttgtaatatggtgctatgtgaagttggtatctgtgttcaatgttgatgttgggcctattcataatgtcctgtgaagttctaattgttgctccaaattggccaatgctaaaaattttctagacctaatagtgggttggggccacaactagatgtaaaatgtgtggctaaatgggttgggccaagacaaatgatcagtgggccttcatcctaatgtgtttgacacgtgtcattgaaacagattaacacgtggctatatcaggtaaagacatgtgtcattaatcagatataaacacgtggcgcctcaaaatgagaacacgtggcgctgccaccttcagtcacgtggacatatgaaatgccaacacgtgggattaaatacgactgccacgtggctctagtatactggagatgctaatccaacatggagtacatgtcatctgccacgtcacatctgtcacaccccgaagttccttcccaagcctaaattggagttttaaatggtctcaagaaaatacctgtgtcaagcaagagcaaaccttaataaattaatgcaaataataatcggaattggcatgtggaatttttcttaagttttacatgccgaaatacgctaaaaagatttttagtggaattttcagagctctcgaaataattttaaccaattaaaattgagcacatgcaattttaatcccaggaaaaatcctttttccttctttttcctttttctttcttttcttttctttttttttcctttgaatgggccgccggcccattcctcctttttctccccctcctcccgctgggccagcccttcggccaggcccagctaagccgcgcgggccggccgcccagctcccctctctccccgggacaccgacaggtgggccccacctatcggggtcgtccccttcctccggccgcccgctccacgtcgccaccaccgccgaaaccgccgccacgcccacctccgcctcctccgggccacgacgtccatgtcgccctcgcgcccgcgcctcccgcgcccactcccctctctctctcccgcccgcgcccacgcccgagatgaccgggatccgattttcgaatcccgcctctctctcctcccctactccccgcgttggccggcggaattccgcccctaccggccacgtccgggattcccctcccctatttaagctccgtcgccaccccctctctctttttccccattttgccgaactctcccgagctcttgatcgctcccgcaccgtgcatccgcccgccgccgcctttcccaccactccggccgcctctagccgccgctagactcgccgccgcaccgcgccgtcgccgccgtcgggttcgcgtggccgagatccaccccgtccgcccttcctccgtcgagattcgtcaccggaacccgcatcccctcgcgctctggtgagctctacccctaccgccgccttcggccatggtttctgattgccgtagttcgtctccctccctctaacctctctcttttcctcccttagggcattccggacctcgtccgcccgccgccgttgtcctcccgtagctcgccgtcgccgttcgccgtcatcctcctccgcgccggccactctcggtgaggcactccccctcctctattcccctccctctccctcctagccgcgccgggtcaagccgctgccccggtcgtcgccgccgccccggtcgtcgccaccgccttcgcgccgccgcctccgccgccggttgccgtcgcctccgccgctggttgccatcgccggcaacgcgtgcgcgcgcgcgcgccgtcgccatcgccgtggccggtcggccggccttgagccgagctaagccaaggcctcgaacaatgggaagctagtgaggatcatagctctgaaggatgagatagcacgcttgaagaaggagaatgctcagttgaagggtctcccagcgccaggaggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttccattagtttatcgactgtttagcatttgcctgttagtttgagtgtttaggtctgttcgcttgggggtcagtcgacggtcgatatcatatgcctatgatatggctgtcctaataaggatttttgcttgctttttaagtgttttaattcagatcagaacaattgcagtttaaattcctatataataaagcttagttcctgagcatctgtttttcttcttttcccccgtctgctcttcctcaagatggtctacaccaggaatggtaaccgtgcaataggcgagggcagcaacggcgaagaacgcactaacggtgtgcatcccaaccgtgattccggcaatggtccgccaccactccccgagaatccgacccttgcccaagtaatggctcatcagacgcagatgatgacagctatgatgcagcagatgcagcagcagcaccagcagatgtaccagaggatgcagcagcaagccgagtagcagtagtttggtccccctccccctcagtccaaactgccggagtttctacgcgttagaccacccaccttctccagcaccaccaaccctatggaggtaaatgactggctccatgccatagagaagaagctcaatctcctgcagtgcaatgatctggagaaggtcgccttcgccacacaccagctccaaggtcccgcgtcagcttggtgggacaatcatatggctacccgcccaccaggcacggaagtcacttgggcggagttctgccgcagcttcaggaaggcgcaagtgccagatggggtcgtggcacaaaagaagagggaattccgggcactccaccagggcaacaggacagtgacggagtatctccatgagttcaatcgcctcgcgcgatatgcaccggaggatgtccgtactgacgccgagaagcaggagaaattcctagcaggtctggatgatgagctaaccaaccagttgatatctggagattacgccgactttgagaggttggttgacaaggcaatccgtcagaggatcagcgcaactaaatggaaaggaagaggaaggcagcgcagttccggtccaaccaagggagccaccagcgaccgcgcttcactcccggacagcaaggtggacctaccaccctaatcgtccgccagcaccgccctttcagtgccagcaacttccatcagggcgccagtggcagccagaaccaccatggcggtcagcccaaccgcagtgcagctccactcccaccaatggctccagcacagtcagctccgtccgcgcaagccaagaaggagactgggacaaagccagggtcttgcttcaactgtggcgagcttggccacttcgctgacaaatgcccaaagcctaggcgtgtcgggccaaggtttgtccaggcccgtgtcaaccacgcgtccgcagaggaggcgcaagcagcaccagaggtcgtactgggtacattccctgtcaactcagttcctgctacagtactttttgattctggtgcaacgcattctttcatttcaaagaaatttgtggggatgtatgggttaagaaaaaaagagcttagtacaccaatgaaggttcataccccaggaaatagttcaacctcggtcagttatagcccttcagtgctaatagaaattcaaagatcaccatttctagccaacctcatccttctcgaatccaaggatctagacgtcattcttgggatggattggctgaccaagtttaagggcgtcattgattgtgcgaatcacacagtcaccttgaccaatgagaagggagaaaccgtggtgtacaagtcaccagtctcaccgaagcaaggaatctccttaaatcagattaaggtggaaaaccctgtgaccaccggggagaagagttcgcggaaattggacgatatccccatagtctgcgagtacccagaagtgttccccaaagacctcactaccatgccacccaagagagaaattgaattccggattgatttggcaccaggaactgcccctatttacaagagaccgtacagaatgacggccaacgagctagcagaggtcaagaagcaagttgatgagtagctgcagaaagggtacattcgaccaagtacttcaccttggggtgctccggtcatttttgtggagaagaaggacaagacgaagagaatgtgtgtcgactatcgcgtactcaatgaggtcacaatcaagaacaaatatcctttaccgcggattgatgatttgtttgatcagctgaaaggagctaaagtgttttctaagatagacctgcgatcaggctaccactagttgagaattcgggaagaggatattccaaagacagccttcaccactcggtatgggttgtatgagtgcacggttatgtctttcggacttaccaacacacccgcattcttcatgaatctgatgaacaaagtgttcatggaatttctggacaagtttgttgtggtcttcatcgacgacatacttatctattcaaagtccgaagaagaacatgagcaacatctccgtctggtactcgagaagttgaaggagcacaggttatacgccaagttcagcaagtgtgacttctggttgtcggaagttaaatttctgggtcacgttattacagctcagggcgtggcagttgatccatcgaacgtggagtcagttaccaaatggaccccaccgaagaccgtgtcgcagattcagagttttcttggacttgcgggttattaccgccgattcatcgaaaacttctcaaggatcgcccgacccatgacttagttgcttaagaaagatgagagtttaaatggacagctgagtgcgacaagagttttgaggagctcaaaaagaaattagtatccgcaccagttttgattctgcccgaccagatgaaagacttccaagtctgttgcgacgcatcccgccacgggcttggatgtgttctaatgcaagagggcagagtggtcgcgtatgccttgcggcagttgcatccacacgaagggaattatccaactcatgacctggaattggcagcagtggttcatgctttaaagatctggagacactatctgattggcaaccactgcgaagtatatacggaccataagagtctgaaatacatcttcacccaaccggacctaaatctctgacaacgaagatggttggaactaatcaaagactatgacatgagcattcactaccacccgggtaaagccaatgtggtggcagatgcgctaagcaggaaaagctactgcaatgccctatgcatcgagggcatgtgcgaagaattgcagcaggagcttgaacatctcaatgtgggagtcgttgaacacggattcgtagccgctctagaagcacggcctacgctcgtcgatcaagttagagcagtgaatgatcttgaaatagcagagctgaaaaagaacatgagagtcggaaaggctcgggatttccttgaagatgaacacggcacaatctggttggcagaaagattgtgtgtacctgacgacaaagaactgaaggatctgatactcaccgaggctcatcagactcactactccattcatccaggcagcatcaaaatgtatcaagacctcaaagaaaagttttggtgggtcagcatgagaagggaaatagctgaattcatcgcactctgcgacgtttgccagtgagtgaaggcagagcaccaaagaccagcaggtttactccaacctcttcaaatcccggaatggaaatgggaggagattggaatggactttataacaggactgccccggacatcatcgggccacgattcaatctgggtagtcgtggatcgactcactaaggttgctcacttcataccagtacataccacgtatacgggcaaaaggttggcagagctctacctctcgagaatcatgtgtctacatggagtacccaaaaagatagtatctgatcgagggagccaattcacttcaaagttctagcagaaattgcaagaggaattgggaacccggttgaatttcagcacagcctaccatccgcagaccgatggtcagaccgagcgagtcaatcaaatattggaggacatgttaagggcctgcgcacttgattttggtggagcttgggacaaaagcttgccgtatgcggagttctcttacaacaacagttaccaggctagtcttcaaatggcaccgttcgaagcattatacggccggaagtgtcgcacccctctcttctgggatcagacaggcgagtgtttggaacagaggtgctaagggaagcagaagagaaagtcagaaccatcagggaaaggttgagaattgcccaatctcgacagaagaactacgcggacaaccgccgaagggagctcacttttgaaacaggggattacgtgtatcttcgtgttactccgctccggggagtgcaccgttttcaaaccaaaggcaagttggcaccacgtttcgtgggaccatacaaaatcttggaacgaaggggagaagttgcttatcagctagagcttccttccaacatgatcggcatccatgacgtgttccatgtatcccaattaaagaagtgcttgagggtacccgaggaacaagccaattcggagcacattgatattcaagaagatctgacgtatgtggagaggccacttcgaattcttaagaccagtgaaagaagaaccagaaacaaggtcactaggttctgcagggttcagtggagtcaccattcagaggaggaagcaacctgggaaagggaagatgagttgaaggccgcccatccgcacctcttcgccagctcctccgaatctcggggtcgagattccgtttaagagggggggtaggtttgtcacaccccgaagttccttcccaagcctaaattggagttttaaatggtctcaagaaaatacctgtgtcaagcaagagtaaaccttaataaattaatgcaaataataatcggaattggcatgtggaatttttcttgagttttacatgctgaaatacgctaacaagatttttagtggaattttcagagctctcgaaataattttaaccaattaaaattgagcacatgcaattttaatcccaggaaaaatcctttttccttctttttcctttttctttcttttcttttctttttttttcctttgaatgggccgccggcccattcctcctttttctccccctcttcccgctgggccagccgaaggtccaggcccagctaagccgcgcgggcccggccgctgccttccctttttccccaggacgctgacaggtgggccccacctgtcggagtcgtcccctttcttcggccggccgcttcacgtggccaccaccgtcgaaaccg

SEQ ID NO: 34726 - DNA, 8706 bp, Oryza sativa
tccctcctagccgcgccgggtcgagccgccgccccggtcgtcgccgccgccttcacgtcgccttcgcgccgccgcctccgctgccggttgccatcgctggcaacgcgtgcgcgcgctcgcgccgtcgccatcgccgtggccggtcggccggccttgagccgagctgagccgggtcgccgccaaccgtccgatcggccccgaggtgatctgggccgtcggtcccatggaccggtggtggaccacccgcgtggtcccggtccacggtggaccggcagccttaggccgctgacccgggggccccacttgccggcgcccctctctccccttgagctgctgacatgcgggccccgcccgtcggcgccgccgcccccttgatgacgtcagccctgggaattaattgcgcaataaattatttaaggactttttgttatagtaataaacacagtgaatcttataaaattcataaataattcatccgtgctccatttaagcccattcaagtctcagtaaatcaagaaaaatgtgtagaatccattaaaaatggttttgttctctgtttcagtagtcttatagcctgtttgcattgtttgctttgtatgtcgcttagattccggttcttccgacgctccggtgtacttcgaaatagtcaccgaggtttctccagcagcagagcaaggcaagtcatgcttgtcacttgaacatgttgatcctatattgcaaatgctctattgtttttcttcaaatactgcattgttttataatgttactatgggatgtttacctattgttacagccatgctattttgataccatgctcctttgttagcttgggttataacatgaatagactttggactaggaattgcttagccatgcttagttcaactagcacacattggggaaaaatcctattaatgtttagactgtaggttctaatggtaatgttggattagtgacaccgcttcggtgttggttaattaaaatgaatcacatggcgggctgtgggtgcatggttttgttggtcgcacccatggcagttaaggaccggttcacgggatgccctgaaagaacttatcgtacttaccacaagccagcgtgggcaacggctgggcttgtagtgtagcttttctctagccgacgcatccaggcaagggtgggcgtgatggagtttggatgggccctgtgacggcctatgcggcttccgaattcacctaggcacaagaggggactgcccgctgccttgcgaggagtggggttgaaacctgaggtgtggtgtgcttggttagagggggttatgcgaatggtcctgtcacggcctctttccggtatgtcgtggtggcatgtcggcgcacggaaacatgtcgtggggctgtgtcttgtgggtacagttgtacacctctgatcagagtaaaactattcgaatagccgtgcccgcggttatgggcggtcaaccagattcaccgtgattagtctcaccctagtttaatctaatgaaattggatagtttaggtggatggttgggcccgttgcaacgtgggatagcgttggacagcggatgattaatattgattaattattacaactgtttaattcttacaacttctgtttataaatgctcgctttatgcaaatgaaccactctagctctcctttgataattccctgcatcatacccctattccggtatggcttgctgagtacagtgggtagtactcagtcttgctctattttccccaacccaagagtacgagtatgtgtcagacagtgatttctccgaggagtaggatgcctgtggagtggtgttcccgctgcagatcaagtcaaggctcagctccagttatctttcgtttttccgctgtatttatgtaagacttttatgatgtttgtaagacgtggatctgaatgtcaacattgtcatttgtgtaccccggccggtcctggacggggattttcatgcacattctgcttggaattctattcgggaatttctgggcgtgacaacatccaacgtggattccacgcataacatggagtacacgtcatctgccacgtcacatccaacgtggattccacatatggcagccacgtggcttggacgacgcatgtcactagccagctggaaagcaattctgtgacgagcaccttcgtcatggatagaagcatttctatgacgaaatctaccattttgtcatagagaaacttatgtgacgcgagttctatgactaatcctatttcgtcataagttcatcatagatgttattttacgacgattattgcatcttccatgacaaaagtagatcatcatagatgtaccgatctctactagtgcacgtcgtcgtgtcgccgccatcgctatcaccacctcgagcaccgcccgcgccgcgtaccgttgccgtcgcgcccgccgtcccatcgccgttgcccgtcgcgtcgccgccctgagacacgcaccgccaagccatgtgccactgctgcgccgtcgtccgtcgcgtcgcaccacaccaagccccgtgccacgtcccgtcgccgcgcgccgtcccatcactgtgccccgcgccgtgcaccgcgccatgccattgttggatagtataggagagatatactatgaaacgttggatgattgtattgagcctcagggggccggtatatataggagtacatgtggaggagataaggaaggattacagataaggaaggaatccacataaatcaatcctatcctaatacatctctaactaccatatactctaacatccccccgcagtccaagcgtgagcagcgcggacacttggactggagaagaaaccggcaagagtgcttaacatggatgatagccctttgtgccatagtcgatgtagtcgagatgaagttgtcgtagtcgtagtagccagtcgtcgccgatatcgatgcagcacaagtcacccaatagtgtgtggttgcggttcgtggcagggatcgcggcgtcaggcgcgagagtgcgcaggtgcaggcgagaagccaacaaacacgacgaccaaaaggataaattaaaaaaacactatggtgaccacggcgcgaagacgtgatgacggacagacgacgatgtcgaacaatgtcgttgtagcttgggacagcaaaacaacaacatccttgatctcggtgaaacgacggcgtgggcgacgcaaaccgatctctgatcggaaaaggaaaataacagcagcaagcagcaatatgccaccaaaaccaatctgaacctcgagctcatggcattgatggctttcctggcagcatggaggagctcacgtgcagcatgttgactcaacccatgcatgcatatgtgccactgcagacgtcgagcatgtatgctcgtagcgtgcatacacaggtgcagaacagccagagccacgagtagacggtaacgatgagactgctgttggtgctgcttgacgcgaacgacgaacgtcgccgcccaaggagattgagacatcctcccacacagcaacaaaacacgaggccgcgtcgagatcaagattgatccttcggtggcaaaccatgatgatgacatgacgccaggagatcgatctctccgaggagaacaatgacgacgactggaagaaaaaaaggtggccgcccccgggagcgagatcgcctcccgggggcgacggcagccgaagcgattagcatcactctgataccatgttggatagaataggagagatatactatataacgtgagatgattgtattgagcctcaagtgactggaatatataggagtacatgtggaggagataaggaaggattacagataagaaaggaatccatacaaatcaatccaatcctaatacatctctaactacaatatactctaacagcaatgtgcgcctatgccctaaccgcctctagcccagcatctagcccggttggccatgagctggtgagcttatcaatcttagcttccagcacaagcccctcactcgcctataaaagacctcccagccttcacgagctcgtcctcccctctctgccttttcttcacccttctacacatttcgtcgaacatcttgtgggcgtgctgcagcttcttcccggctccaccgccgccgcggaacttcgtcgttccgccgtccctcggtaagtcctcactcctgttactcctcctattcctctaggaactacctcccccaactatttcgtcgattagggccataatcgtgacaagcccgagctccgaagctccgcccaaggaggtcaccgtggacatgccatcccgggggctctcccttcgatttttctagaaaaacggaaccctcatgcgccataaatgctcacgccctcaccaatttggtcggaaaccctccgtatcgccctagcacctagctacccgtgcccggccatggcggccatgcggcgcctctcgcccccgcgccgtcttgtgccgtgactgccggcaggaggacaccggagtcttgccgctccctcccctggtcaccgtcgggtcgccctcggccggccttgctgcgcgcgccgcgtctcccctgctgctcccgctcggtctggaggtagaagacgatagagagaacgagaaaagagaagagaataggttgtgggccccacctgtcattagcaccatccaatttcctttagaaaataattcggtagaaaaaggaataaacccggggtcccacttgtcagtcggtacaaaggctaaagatatactgtatttcggattaaaaataaatgaattatgaacagtagcttttcacaatttctccgattaattcgaaattgaatctttaaactagtataacttgctcattttaactcggatttgagtgaaacttgaacctaaattcatctaaattcataagatttctaatggtatataattcactatttaataaaatacatttataattataaaataattaatatcaagtaattagataatggtcaacttaaatatgtgctcataaataggattgatattttacagtagagtagatgtaataatataggcctttaacatgttttgtcactatagcaaccccataaattagttataatcaatattttaaattaatggatgtataggaaaataatagtgctgtttattaatctatgtcactactcgaaaatcgatttttcatggcgtttggaaaatatttttcatggcggccatgtggaaaaaccgccagcacagaaaatcgtgggggtggggggtcaagggccgccagcggaaacacatcttcgctagcggtgtacttaagaaggccgccagcgaagataggatatcttctttggcggctttcttaagctcacgccagtgaaggtattgtatgttcgctggcggtaaggggatgcggcccaccaacgaagatgtaggtgtctttgctggtggccctcttaacttaacgtcagcgaagatatcttaacttaacgccaatcttcgctagcggtgtggtgacgtggaccgccagcgaagatacctacatcttcactagcggcgtcctcaaccctccgccacctcaaatcattttgaatggaggttcaaacaaaccgacatatgacgaccgccagggaaaacacgctgaactatatgaaccagctacattaacctcgagcaccattaggagcacgattttctctctcttaagaacacatacatagtggggaaggttttgatcttgaatcttttgaaagatttattgtaccagaggttagttatactttgtcctactctttttgtcaagttttttttcatttttattggttgtatgttgagatttttcatcacaaaaaatacttgacatggaggaacaaaaacattttttatttgttatttggagctcaaaatggcaaactttgcaagaaatattgtgcatgatccatgttccatatatatatatgtagttttcaataggtttatttttagcagatttatatattagttaactgcaaaagaatgagctagctaggaagagaagagaaagaagggtagtttggtaattcgtccgagggatgtatgttttatatatgtagatttttggctaggtttaattatcttgttcaaaatatttaaaataattaaagttgtattatttttttcgcaattaattaattaatgcatagatggcggacagggcatggatgtataaagagagatatcgtgcgtcatatattgaaggagtcgacatattcatgaaagcagctaagaagaatgctgcatctaagaagacaaaagatattagatgtccatgcgtacactgtaaaaatcagaaaagttggaaggatccatctgtaatcgaacaacacttggtaacgcatgaatttgttgcacgctacacaaactggtcacatcatggagagatcccaagcaagcaagttccgaaccaggctacagtacgcgacgaagtgttgagctgggacgaggatgtcattgtagtagctcaagaagaagaagaagtgcatgcagtagaacccgttgatgatgatgatgttgttggtggcaatggttagcacagtacagttgatgatgccgatgatggtaatgtcagcgtagatgtcacgcctagaaattcacaagtaatttccgaactaatttgtgcattaaaacactcgtgcaggaatcagccgaggtacacaaactgacaatttaatacacagattcatcaaaataactaaaacgataaatacttacataagagacacttagtcctcaccatgaagaaaactgcagcagaaaacaaaatctagcgaagcttcagctccactcccataggcagctcaactgggatctaagccaaaggtcttctccttctggatcctttctcttcaactgaggtttgatgattattgcaaggtgagtacatggaatactccgcaagccacacagcaagtatgcaagtgcacatggataccaaaggatggcataatatagggttcatttgcgaaagcagcatttagcaaagggttgagaatttgtaaaacagtagagtaattaatcatccatattaatcaacactgaacagcaccccaatgctgcacaggcccaaccaaacctgaacaaccaaccccggtcgtacagatcaaacctccaaacaaggagtcaaattaattatcacattgttgtcattaatgagtagtgcgggactaatcacgaaaaacattgttagacccgcccataaccgcaggctcagctattcgaatagttttactctggccagagatgtaccactgtacccataagacatagttccacgacatgtcaccatgcgcctcaataccaccacggtacctcggaaaggaactgtgacaataccccttgtacaacacaactcaccacagtgcaccattcctggatcataatcagcccctcaaaaaccagaggcattaactccccagcgactcccacggacttctcgccgcttcttagtctggcaccccataatgaaccatgctatacaaaaggtaaagccgttgcccatgctgacttgtggttggcacggttaatatttcacaacagtatctcgcgaaccggtccttaattgtcatgagcacgaccttcaaaaccatgtgctcaccacccaccattaatcagattttaattatcaattataattatcataacacgattcaccaccgtgagctaccattaaatataatggtaagtaatagtgaagcatgatttatcccattaatgagttaatgtttctaagcatgactaagtaattttgtatatagcatttagctgaaccaaaccaatatataaggtccaagctaatcaatttattacccataggaaattaaagtcatcttcggccataattaaatgggaaaggctgactacccaatgacaatcgaaaataatgcataagttgaaataaaacattagctttaaatgggttcaacatgctcaaagggttgtttgggatctgtgtgacttgccttgcaaacaagcgtcttcaattcgtctttaggaacttctccaacgaacgaacgatcctccgaaacaacggaaaactaaacctagaacgcaaaaccaggaaaaacactaataaaaaccaaataaacagtacaattaaaattcataaataggtagagcttgaatttagatgaattatgagacttgaacgaactcattttgagttcgtatgaattagctatgaattttacaagatttaatataatttagccttatatagaaaaggaattacgatttatttggaaacgaaaaacgcgctgacgtcagcgatgacatcatcaccggcaacggactggactgcaaggtcgcaggtgctatgaggctcggccgggctatccgagagcactaacgcgaagaggacgacgagacgaactcacccaagggcggcacgaccacggacgacgacgggagatggccggctacgagattgagatggcggcatggctctgtccacggtgatgatggcgtttcggtgaggggagacagcaaatgaggggcggacggtcttcacctcgctcctgcgatcccgtgggtggcgaaggcggcgatggacggtgatgagcggcactgctaaaaacgcggtgacggaagatgagcggcacagccttcacggtgacggagacttccggtgggatttggaggaaagcgacggcgtaggtcggggacgaccgaagaggcggcgcgacgtggctggagcagctgccggcaaaggagagagaagccgagcgtggcagcggctctaggg

SEQ ID NO: 34727 - DNA, 3694 bp, Oryza sativa
tcaggaaaaaaaggaggaaacggaagaggaggcccgaggcatgctatttatagccaaaggaggaggagatcggctcggatacgaggggaatcggcgccggaagggctagggttcgccagcaaaatagaagataaactccacttcgaatccacgcgatataccacgggatatactccgattcttgaggggaaagaaagaggaggataagggcaacaaatcccctcaatcaatttcggaaacgggacacaagatgcgacggatttggcggtggtagcggctgcacacacggctcggcagggagtctggaggttgggggcgacactgtagcagagggacacaatacagacttcttgccgggctttctttctcggcccgattggaagagggagacaaagcagacttcgccgcgagagacagccgctgctcgggctgaagaagagagagagagaaaggagaggagtgggccggattaggccggatttggcccggagctaggaagagaattttaattgattttataatttaaataattgctgaaatgatgtttcatttattaaaaataattccaatgctcaaataaatccaagaaaaatcctgaaaatacttgggcacacaaagtatttaataaaattttatctatatcaatttaactttcaaaattttcatagattttattcacacacttactttaattattaaataatctccaacaattcctttttcacaacgatttataatttagcgattttcagggtgtgacaaatccaccctcttacagaaatctcgtcccgagatttggaacggctagcaagaaatcggatagggcaatcctttactgaccactctgttgaactgactagccaatctgacatacctttatctaactctttttttcttccttcttccaatagaactaacacctaacataatcctcttgtagacattgtcaggtctgccttttgaaaacattatcccttcaacctttcgaatgttgatcacaagatctccaaacattgttgtattcgatcaaaggttccgctttagcttttccttggaatactttgaagtatatcaagtccatagaaattttgcctataactggagtcaaattgattcccatgattccactttagtccaatccaacctatcatggtaaaatgatttcctcttacattatggaaacaagtttcttatcctttaagtatattagtgaaatatctgagccttctcaatccgggcttaaaaatgctttaaattgatagctaatcctgaagtatcttctttgatctgacctttatgtttttgcagtaaaaataattattgtctgtatctcaaatattatagaattgtttcctataacggtgacccattaacctttctaattctagtttccaatgtagcttcttcaatagcttgactatcaactatctggacggactatcaagactttacttccaacattggtgtaaaccactttgcaaccgtattttatggcctctgcagttccaaaataccttgaattagagaactccacacttgatttgactgtcctagtgattattgttccatttcaattgactatttatttatcacctttctatgtatccttctccttattatcatctccatacttcagattgacatagtggtaatgtccattgtcctctttgtacttcagattaacatagtagtgatatccctgcttatctttttaccataggtgtacgtgtaactgatagaacgacccatctaccgtctcacagaagctttgtagtgattcgtcaaaacttcttgtacttagtgatgtgtcggaaagcaaaccattcttgtccttgtaccatattagtagagtataactttcttaagtgcttccaagtagactctggtgtaggttccactacaactttatatatccttgattaatcatcacttcgtctttattctcattttcctgagttgccataaacatctgtttgacatgagtatacctctgaccatcgataaatattaaggttcatgtatcaactatattattccaatacaataccgtagaatccatagtctcactttcattgattacatacttattcaacacggtgatgattctatttaactgaatccataacctttagatagactggcattccttaaaacaactttgaatctcatatatctttgacaatctggaatacatgaataaactgattgcttggatccatatcttatcctctgtctaattattattgcacctgccggagccatattttttttactcatggaaaacgaaccatttaaatctcttgaactataatgttctttgcaatatagacattggttggcctttcattcatttgggtaatagtaacgtagttaattcgtccttttagttataatctgaccaagatgcaatagagaatattgttgtgactgacatcttgcatcaattattattatacttcaaacttgctccagtttccatgtaatttactgtagacatccagggtagaatcatatgtgcaaccatctactgtgaatatccatcttacttgattgactattaatgctagaacttcaactatcgacctttaaaaattgtctcacattgaatagactatcgtgaacacattttccatgtatctccctctagaactgttgattcttagctgcgattagcatagtttctacaaaaatgtgttgactcaaaacaattaactcataccaatccccaacatgaaaggggtgcattcctcttcattaacaatcttcttactcaaactaaaaaatatacaaacttgaacctttcttgatgatacctttgctgatcacatttgacagtattatcttgttactattaatagaaataatgtcatgagcaccggcgggcgaatgccctaatttatccctctctttcacggtaacaataataatcaaataattaaagttctgaatttttccagacagcagcaaatttaatgcacacgatagcaaatcaagcagagcaaccaaattaatccagcttaatagcaaaatataaaaggaccagtcttggcttacagtagcaaaaccaatccctagatagtagtactccacccgtgttcctgagacacgatcagagtaagtggacttccaataaaatccagaaaacgtccccaggagatggatctcctgataagtagtaaaaaccaatccctagatagtagtactccacccgtgttcgtaagacaatcagagtaagtggacttccaataaaatccagaaaatgtccccaggagatggatctcctgatcacgtcactctccaaacatcagccggcagcagcgacacttcaatagatagcagatgggagcgccataagctttttccgagagaacaaacctcgacgaaaacaaaaaaaaaacctcctcccgtactgcttggtagagtttatatatagtatatacggcacgcaggccaactcaaatacggcgcataggcccatgacccaaactaacagaactctgtttggactcaaaacaggagaagtctaatcacttttgctaaatcagccgctaatgaccctgctaatgataattggctaattagcctaccggtacaggaactgaaccaatatatatatatatatattctttgaattgcttcttttcttcctgcacagcaacttgtatttcttccaccaaaaatacctggctcttgg

SEQ ID NO: 34728 - DNA, 778 bp, Oryza sativa
attaatattaattaattattacgactgttttcttctttaaacttctgtttataaatgctcgctttatgcaaatgaaccactctagctcttctttgataattccctgcatcatacccctattccggtatgacttctgagtacagtgggtagtactcagtcttgctctatttttcccaaccccagagcacgagtatgtgtcagatgaaggtttctccgaggagtaggcttcgtccgtgccgtcgaggatgcctgtggagtggtgttcccgctgcagatctagtcaaggcttagctcctgttgtctttcgttttccgctgcatttatgtaagacttttatgatgtttgtaagacgtggatctgaatgtcaacattgacgtggatctgaatgcacattctgcttggaattctattcgggaatttctaggcgtgacagtgaccatggctactatggatacaaccatagctcacatcatggatgaaccagaagatatcaagatcaagtcctccaagtgttgaaatccgattcggccaactgctacactgctgacttcaaacggtcgccgaatctgcatacgacctccgttttcggtccgcgagtacttgatggaaatatctcggagccctctttccaacggatctagcctcatcaccaaattccatgtagtttggccgcaatcacataaacaaggtgttgtgtcacttgtcttgggcctctgggcttgtaactttgtttaggaccccagcccaggtggggcccatgtaagggtgcatcccatcc

SEQ ID NO: 34729 - DNA, 503 bp, Oryza sativa
acgggcggggcgctaaagcggcggctaggagggagagggaggggaatagaagggagagggcgcctcaccgagggtggccggcgcggaggaagacgacggcgaatggcgacggcgagccacgggaggacgacggccaccggcggacgggattcggggtgccctaaagaaggagacgagagagattagagggagggagatgaaccacggcgaccggtatccatggccgaaagcggcggtagcggttgaactcaccggagcgtgaggggatgcgaattccggcgacgaaactcgacggggaaggggcggccggggtggagcttagcctcgcgaacccgacggcggcgacggcgcggtgcggcggcgaccctagcggcggctagcggcggccggagtagcgaaaacggcggcggcgggtggttgcacggcgcacgagcgatggggagctcgggagagttcggcgaaatggggaaaaagcaagagggagtgacggggaagcttaaata

SEQ ID NO: 34730 - DNA, 398 bp, Oryza sativa
ggatctcctgatcacgtcactctccaaacttcagccggcggcagcgacacttcaatagatagcagatgggagcgccataagcttttttcgagagaacaaacctcgacgaaaacaaaaaaaaaacctcctcccgtactgcttggtagagtttatatatagtatatacggcacgcaggccgcaggccaacttaaatacggcgcatagacccatgacacaaactaacagaactctgtttggactcaaaacaggagaagtctaatcactttgctaattcagccgctaatgaccctgctaatgataattggctaattagcctaccgggacaagaactgaaccaatatatatatatatatatatatatatatatatatatatatatatatatatatatatatat

SEQ ID NO: 34731 - DNA, 676 bp, Oryza sativa
ttagccttactgacactattcttttgacttaaaaaatagtgcaaaaagaattgtcctttcagacaccttgatataatcatttcttctataaaccacattgtagtgggaataatcatcttgatgacatagatgtaagcttttattttccttattccttattgactcttgctcacatcaaacttggaaccttatatcgtgagataccaaatgtgaacaattctcttgaattttttttcaatggcgtcccttgagcttctgacttttaaccttccttggctgacagactgtgttatccacaacagcatctggatgaattttatttggagatccagacacattgttccttagctgaaataaccaggttgagtatattaaatgtttacttgtttaaaccactggcaccgttgagcacaaaacttcctttcctttaattcattctcttaggtaggaggtaagagagagatagaaagggaagagaaagtagataggagactcaaaatagaatagactttttactaagctttattttttttattgatgtgaagtaggttgttttttaacactaaactgaacactgaaactagtatggttatatcacaaccctcgatatacttcatacgctaaaacccacacacacacaaaccaaacttaaagcagcaagcttacacaacgatct

SEQ ID NO: 34732 - DNA, 583 bp, Oryza sativa
aagctccggctccactcccacaggcagctcaactggggtataagccaaacgtcttctccttcgcaacttgttttcaactgaggtttgattgattatagcaaggtgagcatatgacatactcagcaagccacacagcaaatatgcaagtgcacaaggataccaaagaatggcataatatagggttcatttgcaaaagaagcatttagcaaatagtaaaaattgtaaaacagtagagtaattaatcatcaatattaatcaactctgaacagcacacccatgctgcacaggcccaaccatcctgaacaaccatacccggctgcacagatttatctccaaaccaggaatgtaccattccaaaccaggagctaaattaattaccatcaattaccacattattattaatgagtagtgtgggactaatcacgaaagacattgttcgacccgcccataaccgcgggcacggctattcgaattgttttactctggccagaggtgtaccattgtacccacaagacacaacccaccagcatgttaccgtgcccggccagacacgtcaccatgttgagtgattgtgacaagaccc

SEQ ID NO: 34733 - DNA, 437 bp, Oryza sativa
cgctacaccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacataatccaccggcatgtcaccgtgcccggccggacacgtcaccatgtcgagtgattgtgacaagaccctccatataaccccctctgaccaagcacaccacacctcaggtttcacccccgcccccaacaggcggtgggcagtcccctctcgtgcctaggcgaatcagaaagccgcataggccgtcgcagggcccatccgaactccatcacgctcacccttgcctggatgcgtcagccagcggaaagctatacttcaaattaggtag

SEQ ID NO: 34734 - DNA, 630 bp, Oryza sativa
cttgcgaagccaagggaggcgacggcgtgggtcggcgtggaccaaagcggcattgtgaccgcggctgatggtggcaatggcgacaaaaagaggtggtgcgcgtggcggcggcgttccggagacggaatgggaaaatgtagtaggggccggggtggagatcggcacgccgatgccgatggtggtgtcatcgcggctcggtggtggctagtgcggcgggaggcggcggctggagcacgccggtgagtggtggggagtgggagcaccgtggggaggtggttccggcgacaaaatggggaagtggaggggatgctgggttacggcacgacgtggcgaagacgttggtggcggtcgtgcggagcggcggcggcaggagcagcggtggcggccggttggagggtcgccggcgagcggcggcgcttgggctcgcgtggggaaagtgggagagagcgcggggagctcggggaggaggaggaaacggaagaggagagcccggggatcccttttataggctcgggaaggcgggatcgatcccgggagaggcggcaaccgacgatggggtgggctccggcgacgtggtgaagtggggcagttcagcggcggttttggaggggagaagagggggaaggggtg

SEQ ID NO: 34735 - DNA, 508 bp, Oryza sativa
attgtgagctatcattaagccatcattaaataatagtgaagcattagttatcccaattgtgtgctaatgtttctaagcatggctaagcaattatgtctaacatctagctgaaccaatatataaagctcaactagtcaaattataataacacaaggtatcaaggaatagagtaatcaatgcaaacaggccataacaaaggaataagttcacaccacccggtgacattaaaaaataaatgcacagttgaaacaaatagagaatttaaatataggatcaacatgctcaaaggaattgtgtttaggatctgtgtgacttgccttgtaataacgggtcttcaattaatcttcttgaacacttccggcgcactcgcgaaccttcgaaacgacggaaacgacaagctaacacgcaaaacgaggaaaaagactaataaaaactaaataaacaatacatataaagtaaacaaacatgagacttgaacagcctcattctgacttcatatgaatttatt

SEQ ID NO: 34736 - DNA, 443 bp, Oryza sativa
actcctattctccttccaacatcaacctccggattctttggcaccatcatctttggcattggctctccaatgaacacttttttccccttagtggattcggcttgctctggccgaatcaataccttcttatcattgaaatcaattgtgttcaccgggaaaggatcatgatcaagcttcatcttggaaccatcagtgaatttcaatcgtccttcatctatggccgattgaatctgtcgtcgaaatacattgcaatcattagtagaatgagaatgagaatcatgctatttacaataagctcgacgtttcaattcctcttgagatggtatgacatggcctttaggcaatctaattatcttttcttgcaaaagataataaaaaaatcttatcacatttggccacgtcaaaactatacttaatctcactttgtcgatctttacaaggag

SEQ ID NO: 34737 - DNA, 636 bp, Oryza sativa
gtcaccggtgagttcgccgcgtcgcccgcatcattttggtgcccttcgttagcgccgtcgtgtcgtcgttcgccggcgagcttgcgccatccggtcgccgccggtggtgacgtcatcaccgacgtcatcgtcgccgtgtcccgtggactggtcgtgcgccgatagatcccggccgttcgttttggatggatcgatctcgatcgttcgttttcgtagccgccgtcgtgcacccggtccaccgtgaaccctagccgatgacgcaataatcccctttcccttttcaaaaataattcattattgcgtcataattcaattaaaatctatataagtgttttaatccgatttaatctttgaaaattcataactaattcatcttagctcggatttagttggttcaagtctctagatttttctaaaattgagatctacatgttaaaaatatccacatgtactgttcatgcttgttaatgtgctgttttggggattttgctcttttctccttagattccgacgttcccagagagtccgatttcgcaggagaagactttgaagagttccaaggccagcaaggcaagccacacagatcccaaacaaccctttgagcatgttgatcccgtttaaagctattgtttctat

SEQ ID NO: 34738 - DNA, 179 bp, Oryza sativa
gtcatgaagtatttctttcctcctttagtcaacacgacgttcatttcacacatatcggaatgaacaagttctaaaggtgctaaatttctcgcctctgatgcttgtgaggcttgcgaggttgtttcgattgaacacaagtatgacacttagaacccttggctaaagtgaatttcgagatt

SEQ ID NO: 34739 - DNA, 429 bp, Oryza sativa
atcctgatgcaaagtttgaaatctaaacatgctttaatgcaaaaaatcaaattgatggaaataaatatgtgatacgtaccaatttacctattggtgagggcaacgtcgttttgggtccgacgagcacgacctgttcctccatcatatttaccttgatgatgtggcacccggctccggaggtggaggagcggatgtcatctgtttctcccgccacaacttctttgtttttggtgcggcttgtggcttcttgactggtttcacaggctttttagcctgtgcatctagctttgtcgatacattccttggacagggcatgctcacgactgcttccttttccaggaagttcttcagtgaaagctatcaacctatccgtctttggtggcttcatttcgacctcttgtatgttctatggattcggccgtacttgat

SEQ ID NO: 34740 - DNA, 639 bp, Oryza sativa
aaagaagctgaaatacgagagtaccgtcatatatgggatgagccatacctgatagggttgctctgatggtctattgagaagatgcgtgccaactgaagagggacttaagatcatagaacgatgccacgcctcgccttatggtggacattacagtgcattccgcacccaggcaaagatttggcaatgtggtttcttcgggccgcaatgtacgaagactcaaaggaatttgtcagaagatgcccaagctgctgtaggatcgagatgtcgactagaggggggtgaataggcgatttaaaactaagtggcacgtaatcaaaactaacctatgttgctagggtcggtgagagacaagtctaactaagcaactaagttatgttttgcaatcctagggtgaaagtggttcaagtgtatcactaggaaagtaaatcacacaactaaattaagttttgcaatcctagggtgatatggccacaaataagtttttatgaaatataaattgcacaaatgtaaatgcaacaaataaatgagacaagagacaaggaatttttcactgaggttcggaaactcgccgatttcctaatccccgttgaggtgagcccaactccaccactcaaccacgaagccgccgcacgccccctt

SEQ ID NO: 34741 - DNA, 394 bp, Oryza sativa
cagcaacgtcatactccacaagctcccagagaagaagaaagatccggggtgtcccacgatcacctgctcgatcggggcacaacaattcgaccaggccttgtgcgaccttggagccagcgtcagcgtcatgccaaaagacgtctttgacaagctcaacttcacggtgttggcaccaacaccgatgcgcctccaactggctgactcgttagtccgttacccggcggggatagtgaaggatgtgctagtcaagatacgggatttcttcatcccggttgattttgtggtgctagacatggacacagggaaggagaccattcctggggcatccatcctggggcatccattccttagcaccgcaagagccaacattgacgtgggaacggggagtatctgt

SEQ ID NO: 34742 - DNA, 566 bp, Oryza sativa
tttgagtttatctctcttatcgaatttatgtgtttttctgcgttgaatcaaatggttatttaagcgtttttaatgtgttttacattctttattagaatactacgttgtttctatcaaagagggcctaatagagacgctaacaaagcatattttgaatttgtcgttgtttgtaactccggaatgtgtgtgtcaacataaatataccagagtacgatgaagcacaaaacgtttctgtttacacctaaaattggcatgaatgttcaaattaaggaaaattgctaagatttgggaaaaatcgctggtttcctccatagggccagtctgaccggcgtgtattggccagtcagaccgttgattgagggtcggtctgaccggtggcatgtggtcgatcagaccggtagagtccgagaccgagtctgtttttgtcaggtctcggaattccttgctcgagagactatgcttttggtttcctttggtttctataccgagttgaacgtggaggagaatctgtaggagacaagaccaacccctatataagggacaaagccggttcaattggaggagaa

SEQ ID NO: 34743 - DNA, 351 bp, Oryza sativa
acggctagaatcgaaggttgacgccagcggccggaattggggaagaatgcttgttctactcgctccggccggctacctagcttcgagtgcttgggctcttgggctcttttgagatatcgaagatgatggtgtagtggctcgtcttggagtccaccggagcgccagaacgtggccgtgcagcagctagggctcgtcggcggcgagagtgtgaattgcgattaagcgacgatttggaccttcgcaactggatccaaaatgcacggatggattaagtgtggtaagtggatcacgttcccgtgctcggtttgcggcgaagctcaccaatgcggaaatggcgacggcaaagatctt

SEQ ID NO: 34744 - DNA, 387 bp, Oryza sativa
gacgttgtaaagaaacagcagagatccacagtgctgtcaaaaaacccaaccccacgttcccaccatctattcattcttaaatctcgaactctctgctgctgccgccaggcgccccagatccactcgctcgtctcgtctctccgctctcttccggacttccactagtcgcacactagcactcgccactcgccagtcgctacgactagtagctccacctcttgtagcctaaagcccaccccccaacaccaccctctgtgaagtagcttgtcctcttcgccgaggccgaggtgacgcacatggcgctgcctcctcctctgctccgcttcttcatcgtcgccgtgctgctcagctcggtcgccgcatgggtggcggcggcgacgacgctgc

SEQ ID NO: 34745 - DNA, 619 bp, Oryza sativa
cggtggcccgtagcgtgttcgccggccgcatgacgaccttctacgcgcagcacaacttcctgactggcttcccggtgccgccgctgccgctgccggactccgcagcgctgtgcctctcttacaattgcatggagctaccgtccgcttctgccgccaacgggtgccccaccatcggcggcccaatggagtccaggcccgccgaccagtgccggagcagcaccgcagccaacgccggcagcagcggaggggacggctgagccgccaacattcctcaaggctgacaggtggggcccacctggttcagctcatcagctgggcacgggtgggggcgtgagaaagggacggccaggatagctaagcctggctcacacattttcgttttgtccgtttgtttcgggtgtggttttcatgtgattgggtttgaattcatcggcatccgggcttgtcgtcgggcgcgcaacggttacacggctacaaggttagcgcgttcttgtgcgtgtgtgcaattactcgctctggtagtttgtacgctgcgtctgtgttactctgttcattgtgagtagctggcagtgtccatttaaacaactctgttcatactctactaagtcagctaatgtaa

SEQ ID NO: 34746 - DNA, 639 bp, Oryza sativa
aacacagatggagcaacaacagatgccatgagacgagatttccgacaacttggttgctgcagcagttcatggagtatctccaatgcttcagtttttaactctgaatcaagaaatgaagcaacgagacgcactgcatcttcactaatggatggaattcgggtcctgtatgaaaaggaaatcagccgttacaaaagtttattggagaccaaacaaacaaattgccataattgaaccctttgtttttaaaaagtagcacaaaacaatcttcgtttttgtaggataaatatagggcactcagttttatttatggatttttattgaaaaaggtagaaacagcaaatatcttatgtttgtcaacagtaaaatctgcacaaggagatttttagataattaatgaattaaaaccagagctctacatccaacatggttgtacacagccaaactcaaggagaatatattatacaagaatgctcacctgctattacgtagaaaagcaagaaaaaactgaatgccagttctttgagcttccattgtgcattttccattatcgttcttaagaaactcaagaaatgaatctaaaaaaccattggaaatcatagaacgccaaatttgatattcacgattcagaacacttttgaa

SEQ ID NO: 34747 - DNA, 1290 bp, Oryza sativa
cgcgcatctaacggcggcgacgggaggcggccgtgacgacgcaagcggcggcgtgaggcggctgttcgccggccggcgacggcggcggtttgggtggcgcggcggcggcactacggggcacgagagagctcgggagatgggtcaaacgaaagagggcgactaggggatgctatttataggcttggattgaagagatcggactccaaccgagaggatttgagccggaaaaaccgagggttagttggagagataaactcgaaaacgaatccaatttcgcgtcgaattcaaagggataaagtcggatttttgggggaagagatagaggaggataagaggaatatttcccctcaactaattttgcaaacggagcacgggatgcggcggatttggtggaggaagcggcgggtgcacaggtacaggacggctggctcgggctctgtccaagcttgaagacgacattgtagcagggagacgaattagacttttcgtcttgggctggctgaaaacaaagcaaagaaagaaagaggaggagctcggctgggccgacttgggctgcacagcacgcgcgcgagggagagacatgttgggctgaaattagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaaaaaaattataatcagaccatttaatgattaatttaatatgtggataattactgaaatgttctttgtagggttaaaattaggaattgagttccgaaaaatccgagaatattccagagagtataattaaccatggagaatttaataaaaattaaatccatccatgctttatatttaggaaattttatttcccacatttaacttcactttataaattaatgaccatttaatataaattctaataataatttattaaatattttttaaatcctaaaacgaaaatcaggatgtgacaacacctttgtttttacgacatttggggcaagaaagcacttcattgtttttcacaacatcttccatgtactcaacacgacctaaagcatcttttagtttcatcttattcaaattacatgttgagcaatccaaaacaacatgaggttgttttaactttttagcagaaatcatgttaaacatcaaactagcatgaaaggcaatttgatatttttgcaacaactttttagttaaaaacaactcatccaaagtgcgtgtgtgc

SEQ ID NO: 34748 - DNA, 446 bp, Oryza sativa
agggggcacaaactttttgaaagccttcctaagattctccatcttcctcccttggtaagaacccttcgacttgttgttgttggtcttctcaccatccttgtcttctcttttgcctctcccaagcttaggacaatgcgaacgaagatgatcaattgaactacattcaaagcaacaatttggaccacctcttttcctgttcctggcattattcatagctcgagcaattctgttagcaaccaaagccaaatcctcctcctcgatttgttcgagttgatcatcggatgtggcattaaaaatagcaagaaaagacgacttagatgaagaggcatcaacatccaaagaggaggaagaagaaaccaaagcactcgatttagaatcaactgcgagaaagaacattcatctcatgtgttttcaattttgtataaagtgaatccaaagtcaaagta

SEQ ID NO: 34749 - DNA, 551 bp, Oryza sativa
tgccagatctgcacacgctcgacctcggcaataaccacctcacggttccattcccagcggcttgctgctgccgtcttcgcagagcctcaaggtgctcatcctagcgaacaatggcggcctctccgggcagattccagaccaattttccagctcacagcttttccatgtcgacctaagccggaattccatcactggctcgctcccaccgctggcgcagacagtccgctacttctccgtcgcggcgaactcaatgcaggggagcctcgacggcgcgttcggcaacggttcggctccgaccgacttggccttcctcgacctctcgatgaacaacttctcgggttcaatcccgcgggagttgttcgcgctcccgagcgcgtcgtcccttcttctgtcccgcaataacttcaccgggtccctcgccgtgccagcgttcgcatcggagcgtgccgcaacgccgccgtggtcggttgtgaacgtcagccacaatggcatcacgggggaggtcccggaggagctagcggccgtggagagcctgtacgtgaacaacaacc

SEQ ID NO: 34750 - DNA, 554 bp, Oryza sativa
aggcggataggcctaaggtactcagcccaccctatgctaataactcgatggttcactatgaggtacccaggtcccgtataccctacagtagccccggggactaagcttggtactagttttctgtatcatcaaaaccgtcaaagaagaacaaaacgtgatgagtactcaaagcctgaatgccgccgagctatatatcatgaccgagtaacctccacttgaactgaggaattgaatcatcaaagaggtatttcagactttatcgaaaaaacttctagggctggcccattgaagcgccttcttactctataaatagcgacctagacggaacgaatctcacccaaatcccaatttgagcaacagtagtcgtgcctcttcatcttcttcacctcacccatttttcttcttgattccaactagggttttttaaacctaaaccaaacaacttatccacccaaaatctgaaactttccaaccttccggattcgaatccccgaacttctcctcctcaaaatgtcgggttcattgggtgaatccgtgttctaccagatcgcaat

SEQ ID NO: 34751 - DNA, 371 bp, Oryza sativa
gctccctctgctcaaaccaccaatggctggcaaatccttaatgccatacattggctcttcctcaaactccacatataaccttgaaggagagccaacaccggccaatcaattgatcccggtggagaattatacaatggaaggggtgaacgcactctgggctcaaccccttgcgacggtgctgggctcccctgcgaatctagagcccatcggcgagctccctagttcttctgaaccaggggttcggtcgaacccatcttggccccattcagcagcacgctccctctccccgatgcacgtcacatagacaaaagtacagggtgattcgcctgcgcgacggccgacaatgggcgagctcagtcttttgaaggcga

SEQ ID NO: 34752 - DNA, 522 bp, Oryza sativa
tttttttttaaaaaaaaatctggagagactcaatttttaagctctctgccgatccaaggtccaatgctcactatacagacttcattcaatcagtagaaatccacttatgcagatgaaaaaaaaagcaactcttgattgcaatcaatgaatgatccttacagaagcctgtttagttactcatcaacggtagtgtatttgatgtctgggtatatatgagtggcctctactccgaccgttggtttgatctcaaagttgatgtgatctcatttatatatacagaatgaagtatggccagatcgatgcttagtggtgaacactctgcaagaccaaatacaatgatttttatatatattccaactatatagacactattaagatttgatatatagcaacaatcagacaagtatagaattcatttccatggtgtttctttaaaaaaataaacaacattgttaacttatttcaattatttaaaacaaatatgtagtaaatgggaaggtttaattctaattggaatatttt

SEQ ID NO: 34753 - DNA, 257 bp, Oryza sativa
ctgcggattgtaggtggtgaacatggacttcatttcctcacccttgaggaaatagaaggtgcggcccgttagcaacgcagcgtaatctataaatagggatcaaatgaaaggtggagataatccaggtggtagataaatacaatagttctcttgttaattaaatgtaggagctggtgaatgggattaccttttcccgcaagattttgcgaattctattgggaactgggtgggtgtccggtacttttgtacttacgttt

SEQ ID NO: 34754 - DNA, 11735 bp, Oryza sativa
gttgagttcaaatgtatttaatatcggtagaaccataaatagacgtcctattaattactccttggtaaatgtcattacgttcaaaacgacaaaaaatatagaactggagggagtatatgttcgaattcatagttaaaaattggttttttctggaacggaatggctttggaagtgctaactagcggctcaccctgttccttgcaagtagtagcatcctgcgggtgtaaatatgtctcacaagtcacaaaagatttcccggcgacggtaaacggtggggcgcttataagttataacgtcctgggaactatagacaatagatatagatcatgctagttatatatactaggtgaaataaaccgagtacatgacatggttagaaaccacagtaacctattagcttctttttagagcacatggaatagccagtatattttcatagggctagcttttctaataaggtggcttgttgtcttgttgagtgattttacctggttcctttttctttatcacaccctgtgcttgatatgcacaatgttcagagccccacaggacacaaagtgtctgaaaccatttgctcctgagatgtcctacaagtgtatggaagccagtagcgacacgtttctaatgttgaatcggtgatagataaagggttccattatattattactttgacccaatagtttatttaataattttagctcaactggggaatacaagtcacgtaaccttggatatttaaggaacccatatatatatatatatatatatatatatatatatatatatatatatatatatatatacacatacatttgccctatgctccctatcatattccggtcgcttctaatcaattggtctgccttgccaggaaccttcggataagtcccaactggcagcattgcaaacgaacaaacttgtcaattagcaactgaacagttgaacagtatttaaattgatggaggatagcacatctccttgagagtaaagaacggcagccagggaatactaggccaccagacagagaatactagggacctaatcaagaggaattttaattctttccctatttgggataattttctagaacatagtttctgcaggaagaaaaaagggttctgagacacatgatacctttgactttgtcttgtcacatatccttctattattgttacctgtgaggcagttgagtccttagctcataaactaagttttgcttgtctaagaccagcctctgaacatagtgatagcctgacagtgatttccatgaaaccgactctgaaccaaccactgcacttgtaaaaagtttgcctttttaccagagactggaggattcatagtagcaaacaaagtagaagcaaggtgaaggtcaccttacctatactttcctcctgattttcagcaggaaaaaaagggcaagaaagactgagagcagcagaagaggaagatgatgatgaccgaggtcgccaatcacagcaaaaggaaccacaatgaaagctacttcaccgggaaagcagcagtcaccagcagctcggaggagtttgggagcatgacatccaagaagccgaggaacacaagcccgagagacgctcccgtctccccgaaggtatgttgctcaagtctaattttcacacgtctttcctgttctttcatttttcttgtgtgttgttctgactgaggtttctttgtttgcaaattgcaattgatcaggagaagaaggataagattggtgagagagtggctgcactgcaacaactagtgtcaccatttgggaaggtatttactatacatttctgcacttgcttcctgtcttctctcatctttgtgaatcaaactcatgttataaaacttagaagcctgagctcatctggttatgcaaactctctcgctttgtgcagacggacactgcttctgttcttcaggaggcctcagggtacatcaagtttcttcaccagcagctcgaggtacttgttctcgatcaccgcacactcatttctgtgatctttaagcctgcttacctttcgttttctgtgactcaactgaaacattttgcaggttcttagctccccttacatgcgtgctcctccggtgcctggcgctgcgcctgaggtcagctacagctacctacatccttctacctaagtcatcatatatactctgaaagtttaacgaaaattcgaaatgttaaattttggctagaaaaaggaaaactttgtagtaatctttgtatgtaacaagcatgtcaattgctgtgatccaggatcccgaccactacagcctgaggaaccgtggcctctgcctggttccagtggaccagacgctgcagctgacgcagagcaacggcgccgacctgtgggcgccggcgaacacgaccaggcgcaggtgaacggaggaaccggcctggaggctcgggggtctaagaggcctagaggaggaggggagcacttttgtctgggggcggtgtagagttccaacttccaagtgtctgacccgattcatcaaatctcctaacaaagcaaaaactaataagcaaaccgtgtttcactctcgtcggatctcttgcctgtaatatagtagtagctgcaaccctgcctgcaggtcggtgtgagaccgtgagagtgtgctactgatgagtctgtgttagcgccggacatatgtgtgtaatcatcatacatagcgaggtgatagtactagactacctgatgtgcccatatgtgatatgtaactatgtgtctcttcagtaacatgatagtagcagcatgttgctgctagcaaccaagttcaatgtgattgagtacatcagccctgctgtagtttttgtaagaagtgctcagtttctgctagaagcaagaaaaactcctgcatcctggagctaagcagtagcacagatgaagcaaaaaacggcatgagctttataggtgggccaaatctaagcccacaataggcgagcccatcttggttgggcttaccatgagaaggtgtgggcagtttgggctttgccttgggctactagcagttctcaacttttttaatgggagcagcagtatatatccagtaggtgagctgttcaattaggctgttcaactggggggaggctaatgggcgggcgatcgtccagcgatcggtttgtccccctccccctatactcctcccttttctcccccttcctcctcccctttttctttttctactacagtacaccatacaattttttttaaaacaaaagttagaaaaatttatgtatagaaatactatttataaaaaatttgaattcaaattcaaatttgaatcgggtatgtaaacttttgacttataaactttggatctataaactttaggtgtatagaaatactatatatagaaaatatttgaattcaaattcaaatttgaatcagataataattcaaattcaaatttgaatcgggtatgtaaactttgacttataaactttggatctattaactttagatgtataaacttttgtataaaaatactatatatagaaaatatttgaattcaaatttaaatttgaatcggatatataaacttttggtctctaaattttaaatgtgtaaacttgaggtgtataaactttaggtgtataaatttactaaaatagaaaaataatgcggtgtcaaaaaagaaaaccagtggaggggggaggggatggatcgctgccccatccccagagtgatcgatcgccgaacagcattttcgtgttcaactggctcttagcacgtttgtgtttggggcaattttggtacgggtgcactgtgttgtgcccaatttaatggaggcgggccatgcgttatgtttatggcctctgtactgttgttgtaggggcgtgaagcaagcaacggaggccacaattttgatcagctgggccccgggtaacagcgactgttcacaattttgagtcatggaagctcctggcagaaacgcactgattatgcatttatgattgttttttcgttatatttttcggctctatcatggttcctgatggccgtccatcatgaatctatatagattttgagctgagaggctcaaaacttgaagttctaaggtggggcaaggtgaattatttgagaacaatctcgacagaatttggtgtgttatcattgtgtttttcaactccacttaatcgaataatggttgcagagctgtcattcttccttccataaaaaatgtttgaaagtagaaacagtactctcatttttccatggctctcgacttgttgggtccaaaatccaaattacgttacagcctgttccgactggggcactggacgtttgcgagtcatgcgagacgtacagcgtctgaaccgtcagcttctgttcatcaatgcggcaagaatggtaggctggtggccatgccaacttgcccaccacagagaaagttccccccgtaatatcggtccggtcccacaaaaccaacccccgtgttggtgtttagattgacgggcataaagttttaacttgtcacatcagatattatataaggtgtcacgtaggtatttgtcactaataaaaaactattatagaatccattagtaaaaccgcgagataaatttattaaacctaattaatttgtcattagtaaatatttattatagcactacattgtcaaatcatggagcaattaggcttaaaaattcgtctcgcaaattagtcataatttgtgcaattaattattttttagcctaatttaatatttcatacaaatgttctagcattcgatgtggcagggtataaaatttttttttgcgcgggaccaagacaggacctaagataattcaaccccagtgtgagtcaacagtacacacgagaacggagggttatgactcacgaggcgatgaacctggcctccctccttcgctgtacacctgccattctggagggggcagcattgccagcatccattcgccttgcctgtccacgttctgttgtgatgctagtatgctactacccctctgcacaagcgtagtacatctacatgtggcagcgacgtctcaggtcggcctcctctctggctggctctccttggcgtcgtaaaatatcgcggtgccgaagtgtggctggcgtgcgatctttgctgcaaaggagacgcgtgtgcatgcgagctcagggcgacagtgcgagttcgtcgtgaaatatcggtgttcgatacttccagtactccatcacccgcgcaccgcgcgcgccaccggagaagtgcgctccacgacaagatacatgcgcgctaatcccgtactgtatgtggactatggtgctttcgtacaggcatatgacgagatgcaaattaggcagcgccattaatgatcagtagtcttttctgacgcaagttctgtggaggtgagaggtgatcaatagtcgtgctatctattagtgctcgtacctgctaaccagataatattccgtgcaattcgacgtggagctagaattttaaactaaaccaaaattaacacatacgacaaaattttttttttgttagaataaataggctagacccaatttttctattaaaatctcaagggccataaaaaatgttaaatataataataccactctgggaattaaaagtggagtatctcaacttaaatagggagttattggaggctcttgttgacaggttgaggtggggatcggaaagccacacgcgcgcgctctgtgtctctctctcgagatccttttgcaacggttaagaattcgtaacgggcaagatctctcacgcattcttcccatcgctggtagagacctccgattagatctctcacacattcttcccactcgagatccttttacaacggttaagaattcgtaacgggcaagatctctcacgcattcttcccactcgagatccttttgcaacggttaagaattcgtaacgggcaagatctctcacgcattcttcccatcgctggtagagacctccgatcagatctctcttccattgtgtgcctgtgttgtttctgttctccccggttctgatcacttgagcgcacgagtgattgggacgagcagggcctccgaaaccacaccttcgcgcacgagtgattgggatgagcagggcctccgaaaccacaccttcgcctgagatctgcaccaggtaggcaagtgatcaggtttttggggagtgctaccgtatgactgctcctctttcttcctcattgtcgttctgttcgatctgcatcgcgatgtctactggtggcggcgtcaacggaggagcaccaggagcaagagacgcaccgatcgacaacaccaacggaggcaattttgccttacaatccagcggagggacttttacagggtataatatccttctgctacctttgattttgttacatctgtcagtcgcaatgttattgcgttgtctcaatgatgttgatgcttattttatcttaagcatgctcctagttatgtttagttttatcactagatcaccacacattgttcatgtcatgtttattgtcttaatattttggattaaaatatgccgatatatgaccatatttccaacaattttgactacttatacaccgccgctgccaccacccctacctccttccctcctccgcctcgccgctgtccgagcaggctgccgggaatcacaaggacagcggtggcagggtcttcctttttttttcctaaggccacgggggtcggagcccatgatctcgactgggtccagggcagcgacggccatagtagagtggcactgggctggagctgactgcgggcgggggagagtagagtggccacgtcgatagcgagatggtgttgaccggggcaacgacggcgcgacgccaccagatctggcatcccttgctagatccagccccttctcgtccgaatccggcctcatcggtgcgagaggccggctcccgagttggtggcggtgatcaagtaacggggtgcgtgtaggtaacagggtgaggtaggaagggcgcggcagcgggcacgcccatgtgatgccggaggcgggaggaaggtggatgcggcggcggggatgggaggaagaagggcgccaactgggagcagagcatcttctctgctgatggagtggctactcccagctgagggctggcgccgcacaaaggcatttggccaacgggggtaggcccgcgcaacgcgagaggagacacgcccgacgacgacgagaatgtgggaggccgacgtgatgagcgagcggcggcggcgggaatgtgggagaacggcagggaggttacccctgttgatggtgtgggaggtcgatgctgtggcggcaggaaggctagggacatcatgcgtgccacgtttcacgtgaaggcacgcgaaggctggtcgctgggggagggctagtacaatggtatccatgtgttgacggaggttgtccggtggtagagcatggagcgttagctgtggatcgacagggggtgagtagcaggtgtaaaacctagctcggccttgttgtgcaaacaacgacgacattttgggcttcgttttccctattgggggcactgtcgagccatccctctctctctagtggggctgtcgggtgaaagccctatcttgatcctccgagacctcgacggacagcaacgtcggtgcctatcatcgctgttttccctgaagatatcgtctacgaggcccctttgccaaagcccaactccacccccgtagtacaattttgggtagcaactttgctaattccactccagaaaatagagaatacgtatcgtttggcacgactcaagctctagaagtttaaagttagagctagctgtgccaaacggacccttaaactggtttaccacgtatcgtaaagatgctaatagtaattttatcccaaagaacatatcaaattcttcatatgggctagacagcaagagggttgagatactggcggtacaagcttaggaaatgggcggactctaaggtagacattgggacaactcccatctcacactatttgaggccgttttcattttcgctacttttcattttcaaagaaaatcttttgaacctgtttcagattccaatctaacattgtctatttcccatcatcgagatcgattgcaaactatccaaaccgttttcactgcagagtgagttttcaacgcaccctctttacaaaagcggctgtgttactgtttatagtcttgcaactgtacgcactacgcacacgactttcctccgcacgggcgattgcacagccagtacgtacaaccccatccaaagtgaagcgaaaaatcgcctcgtatcacatgcagtgcgcgttctcgttctcacgctacttgcaggttgcaagtggccagagtttcctcgtcgtccaataccccggagatttttccatcttccgcgggccccgccgagctcccgtccaccactcgctcgctcgaaagaccaaatcaatttccgctcgcctcgcgctgcatcgccagagaatccgtaggagatacagatactcccccggtgctaccacggcccgatcgctgtagccgccaagaaaaaccggaaggcctccgtctcgtctccatcacacaaaccggcgcgcggccccacacccccccaaccgtgcgcccgtgcagcctagccatccggtgtccggtcgggcgtgacgcacgttgcgccttttatacgcgccagtcacgccgccgctcgttccgtttcactcatccgccgctgagctctatctatctactagttagtttagtcgtctcgagggtaaattgagctttgtgtgcggttttgaggggagtacatcggcatgaggatccagtgcaacgcgtgcgaggccgcggcggccacggtggtgtgctgcgcggacgaggcggcgctgtgcgcgcgctgcgacgtcgagatccacgccgccaacaagctcgccagcaagcaccagcgcctcccgctcgacgccgcgctccccgccgccctcccgcgctgcgacgtctgccaggtaacgtactcctacgcgcgcgtgtagtagcaatagcagagtagagaagctgcagcagcatgtggctgggagagtggagacgtgtcgctgaggcactggtcgtacgtgttgtcgtcgttgttgctgcaggagaaggcggcgttcatcttctgcgtggaggacagggcgctcttctgccgggactgcgacgagcccatccacgtcccggggacgctctccggcaaccaccagcgctacctcaccaccggcatccgcgtcgggttcagctccgtctgtagcgccaacgccgaccacctcccgccgccagcgcccaaggggaactccaagccgccggcaagcggcatcgctgctgctgctgctcccaagccggccgtgtccgcggcggcgcaggaggtgccgtcgtcaccgttcttgccgccgtcgggctgggccgtcgaggatctcctgcagctctccgactacgagtccagcgacaaggcaaggacctaactaacaaaaccattcttgataacaagattagcttagaaatcaagaattgccttacttgaccgtgtgtgtgcttgctgttgcagaagggctctcctattgggttcaaggatctggagtggctcgatgacatcgacctgttccatgtccagtcgccggccaagggaggcagcacggcggcggaggtgcctgagctcttcgcctcgccgcagccagcgagcaacatggggctctacaaggcgagcggtgcacgccaaagcaagaagccacgggtggagatacccgatgacgacgaggacttcttcatcgttcctgatcttggatgagatgttgttatgtaacagtaatgctatgcaagtgatgtaattttgtatgtatgcaaagaacactgccatctcggttgtactaagtgtgctaagtacatcttactgtgggcgtatgtaattgtaagacaatttgggcccaatacttatcagcatggtgttgggcatgaactatgatgtactatgacatgacgaaagtttgcttgcagcgtgtgttctgttcgtagattattgttgcatatgttctgttcatagaatttttctgtcagatgcttaccagtgatgtggagaatatcattcataatacttaataactacctgggcgtcctaagatagatgaaaacactgagcagtaccgacttaaaattggaacatgacccctaattgaatatgaatagtagaacacaatattcgttcaggagacctgaaaatttcatccttacattccttggctccgggaacaggttacagcgaacatatctgtgatctatgactatgaactgaaacctttggtaaatatgaggctcaaaatagagttagaagatcaacacaacagacctgaacattccttggctcggtgcaattattttatccaggaacaggttacagcgagcatatctgcgatccatgactatgaactgaaacctctggtaaacatgaggctagactagatcaacaaaacagacatgcacggttgaacttgatgaagtgaaaaaacaaaggatcatcactggcccacaatgcagattacctcgccgtataccatttactgaaaaccaccacactttcttataaatcataacatggctaccctaaacaactgagaaacggaatggtgtttcagggaacatgagagcaaacgccagaacctcccaaaccggttgcagtacttcaggttaaatagctcactaaatcccagcaagattatgaaataccaaatcctctccgctctcagcagcatctgtgaattaatacatgactttccactttgttaccgatatatctcagatcttctttcaagatgcttgtgctgcatataaatgctttttggcagtgcacattagatgtcgtgaacactgtgtacaaattcccaactgtcaccttttcttcagcaatgaactagctctcaagaagattttatcaatctcatcaagctcggatactttgagttctttagcagatgaatcggtcctatcagaaagggaagcaatctttcgtagatgctcttcgaaatcatctggttcattgtcattattttctgagggaaacttatccagcttatctagatacaacggttgctccttgctttcctgtacctgctcctcctctgagtccgtctcaaaaatgtcagagagatcctcggattcagagtatgtgatagactctgaagccgaatcagcactaacctcataattttcatcctctagccttccagacccttctatactttctgacaggagatcagatacacttctcttgcgaactgagcaagaagaatattctttcgcagatgtactgtttacactatctgaaatacaagtaatatcttccgctgcattctgtcctttataatctctagctaacttcatctgtgcatgaagatctacaagctcctgctcaagcctgggaatgtaccgcctaagagctcggaggcgttctctgtattttgatttatccagtgcctgattggaaattttaaaattataaatgatgagaagacacaacatgacaactgtttctactcgttttgcatagattatctgccctacactccacctgaataaagttgttgcatgtgtctttcaatcctaagtttagatcccaaatgagaacactatatggaaaacttactgaagcaccttccactaattaaaaggatttactggggctagtagttcttggaacatctgttactaatttggttttagccatttttccaccttgcttcatagttcatatcatatgctaaagatttcatatattaattattgc

SEQ ID NO: 34755 - DNA, 4961 bp, Oryza sativa
gctttttccagtgcaaatgcatgttcaggatcactccttgatatattccacgtcttcctacaggcacataatttttacttttttgacccatcttgaggaaatagaagtgctcttcaggtgtaagcacctcaggatcatgggtaggttctgatgggtcatccggttcaatcttcgtcaaagctgcaacaagtcgttcttccttgtttcgagccttttaagggccattgcaaaaggaaacaatgaaagaccaatatgttagaggagtgaagattccacaacagaaccataacaaaaacaagcaaatatactttcattgtaatgtgaacactggcacatagatattgttgcaatgcattgagtatagaaaagacaatcaaaatctaattagactcttcggcattgaaaattttcatcatgagactatactcatgaacataatgaatgatgattagcggtgtgtggctttgcttctctgatatgctagctttctgggtgggttttgcctgtgtatgacaatgttcttgttttgttttctatggtctgtgaccgtaagctggaaaacccagcaagaactacagtacttgttatgctttcttctaaagctgggcgtaatgccttccctctaaaaataactacttctgtccacaatgaagtttgggtatccttgtaattcccaacatggcatgacatggaaagcagtattaaaaaaatactcaaggtcaagttaaatttgagtagaagtaactctttttgcatgaaaaagaactcaaatcaaatatatgagctacaaaacatataaaggcaatggcaacagaatttactagcttcagtttgtacaaaatcttctcctccgcagtcatcctttgaaactcccttttcttcttccatctcagggatttcaaaaatcttgtcactgccctccttccttttaactttttcctctttgctttgggcctaccagattcatcaaccagcgcaacatcttcttgtttctgctgaggttctgctatggtatgattttgactattgactggtcggcttgtatggatacagcaatatatttgaaggttataactttgccacccactgaagaacccaacatctcggtgaaaaaccttgtgggaagtataactacaacagaatcagaactttgaaaaacaaaagagcatatagactcaaactgaaccacaatacgttaaaccccccaagtgtaaaaagcataatcatgagaacagtgaattgtgcaaatgttcccgttgcggcatttcatcaaacacttgacagtttcagcgagccactaaagtttcatcaaatacctgcaggccgacctacagcagcaatgattggaagcgcaaaactcaggtatccaaatcctcctacccctgatacgcacttaatacattcccatcgagaccgctgaatgtgaatcagagacagaggaaggggatcgatgggtgtttgttttcgtctcttacgatggtgagcaccgccgaggcgcgcgcagctcatggggaggcgccacgctggtagaaccgggggagggataaagcgcccgggacatcggccgccaccccttctccatcctccggagcaagagcacccggctgcccatggcccacgccacccgcgcggcgcagcgagagtcggagaaggcgcgcagccgacggggggggggcgaggagacccaccggcctccctcctcgggggtggtgcggtggcctcaggcacgccgtgccggcgtggacggccgagcaagtgcggcggagccgcggcgtgggagcagcctgcactgcagtcgcagggcgtctcgcgtcgtctcgcgtttacatgggctgctctacccactgggccgtacaaaaaccggctgtgcgcgagactaagtaggccgattaactgagccgcaggagttgggccctgatttgatcgagcaatggactctctcgccgtgtgagttgtcaagtggactatctcaactggattcaacttgatatgtcatttttcaaaaaaaaaaaaaaaaaacttgatatgtcattgactcattgtcaccatacgatgtccccacctgtgtttgccatttgccaagtagagagaggaccgaggaaagacggcgttggaatggctaagatagtagataccctcggtcgcacgtaacgaccaagtgaaaaacggaaaaaacctgtcgttcgtcgccgcgtgggtatctgcagcagcagtttcgtgttgacaattagacgaggaaaaattcctacccgagacaaaagggaaaaacggccaattaataagtcttgaccttgaacatgtagtaaacgaagaagctaacacccggacaaggtcatacaaccttgtaaatgcctcagctggattaggtcattatagccaactattgactccaaatcatttatagttaatttaatagctaattcatacaccaattacatatatacatataaacacaattatggtcccacctatcatatacacatgtatcttgtagtccgtgctacagctagctacaaatctgtagcctgctgctcttctctctcttttcttatcttctcgaaatatgtttacagctggcttataatttgctattatatctgctcttagaatcagccataacggtcttctcccattttaccccgcagtctcacagtcacacacaaaaaaagtccaacattagagacgacccaatcagaaagtaaaccgagctaggtagtggccgccggagtggtgtggaaagattattaaagtcagctcagctggcccgtttctagttcaaagtcaccgctgacaacacaaggtaattaaccatcggccgcgatatgccaatacgtagtacgccatcgatcagtaatgtggcgcaccatccaacggttgtaaaagccactctcgtagtctcgtcctcgcgcacgggctacggatgcgcggctcgatcgcttggcgcgcggcgctcccctacggccggggacgtcccgacgtgtacccccgtggcgcgtggaccgcgcgtaataagccccgtaaattaaacgcgcgatcgatcgaccacatgcgcatggccggcgccgcggccgcgggcatcgcgcggtcccctccccgtccggctccgtgcctcctgcgggtcgagagagaaatatacgggtgtgtcggccagccgcgcacgcacacgcacgggcggtgcggcggtgccccgtgcccgtatggtcgtatggccagtacgtggccgtccaccgcgagctgaggccacgtacgagaggggggtgtcgtactggcgtctggcgtcgtgtggtagccggacggctgcctctccagtcggtgtgctgttgttagagcaagttatagccaactactaactctaatttatttatagtagctcattcatacaatagttacatactacactattaatatctggtcccacttatcatacacacactgcatcttgaagtccatactacagctggctataaatctgtatgcttttctctcttgttatttatcttcttaaaatatattttcagctgacttatagcctactattttacctgctcttagttgttacatacagtacgcgcgcgctcgattgtcggcccaagcctctgacgctccaaagacgcatcgaaaacagttctgttgttaatccaaacgagttctgcctcaaggcaggttcgtaattatgatcggtttttgcgaaaaccgtatgttttttaaaccgtcagattccgatttgtaaaagccaatcgattttagttgattttgtttaagttgatgttaagttatatgttttatcggtttttgcttgggtttcgataaaatcaaaatgggtcagtttacatctaaaaatagaaattggtcttatcggttgtctcatattgtctaatggcttattagagaataaaaaataatttataggtaaaactctctctatatatattcttattttatagcgacttcaaaatttaggtttaaaaatttaaattttaactttggctttggtttattagggcaaccaatgagacttgtaaccattgatatcaaatcctgcttgaaagttggaaaattctgacaagcatctattgagtgatcaattggcgagaatataacatgtaaaagttggttttctcaacttcttccttctagtttgttttcttggaaatatggagtgtttaagaaacccggaaattttacagctgccagcagaagctcttcaaccagatcctaaacttatgatgaggagaaagattgggtgagccaacgctttagattcatctctcagctgcagtttatgttttgaagggacgattactataccagtactcctttgtcgtttaggaacaaactactgttcattggtcccgattctaagcactccaaacatgcaaatcgacaccaaaaatttgacaaaaggtacacaaataaggatgcactagaatcgacagagaacagtagaaaatgattttgagatgaacagagccagaagtgcagaatccggacctttcgtggactagcaagcaggggtacccatgcggccatgcatggagaggcagagcaggtgccaaaatgttcacctttacagttttacacgagaaaaaccctgaaaattcagggaaaaacagaatttcttaccaagaaattcttgtacacttagttaattagcaatcccatcaatcttaacgaacaaaccaagaaatttttggagcatacgtggggttacgtgatttccttgaagaaagccagtatctacacctgatctaccagtatgaagcagaagtgaagagatggacggatcagccgagggcggcgaacccgccgccgcgcatcatctggaggaactcgtggaagtcgacgcggccgtcgccgtcgcggtcgaccttgccgatcatgcgacggcactcctccgccgtgcggccctgcttcagccccagcgacgccagcacggcgccgagctcgtacaccgtgatgta

SEQ ID NO: 34756 - DNA, 15201 bp, Oryza sativa
cttccccagcgagtcctccagctcctcccgcgtgatccgcccgtcgccgttcctgtcgaacagctcgaacacgcgcgccagctccgcggcgtcggcctgctgctgctgcttcttcttgctccccgctcccgctcccgctcccggcggtgacatcttcttgggaggaggaggagacgctggcggctcaggcggcatggttgtcgtcgtcgtcgaagaagcctcgcaggtggaggcggcgccgcgcgcgactgggaggatggaggagaggttggcggggaggtaggagaggaggccgcgcgggaggagtgggaacttaacgaccggcgaggcgggcaccgtggggacctggcaactcatgaggtcgatcgctttgcttcgctgtggtgtggtgtggtggcgagcagatggccgcaacctttatcttcagctagcttccgccagtgaccatcaaccatggccgtatttatagctagctatacgacctttctcactctattagagcaagttaaatagtatagccaacgaccagctccaattcatctacagccaatctaatagctcatttatacaatagttatatactacagtattaatacttagtcctacctgtcatgcaaacacggtgtcttggagtccgtgctacagctggctacaaatttatagcctgctgtccttctctcttctcatttatctcattaaaatatgtttgtatctgacttataggctgctattgtacctactcttatacggagtactactacttttcttgctttttaacggaaggagagaatggacggacttgtacttcatgtcaagggagaccttttcttttttatttcgatctaacatgtcgaattgacttttgaataaagtaggtttgtgtaatagcattagggatagatatatcaaattgaacaaaatgaaaatgcatttgtttgaaaggatgctggattgctgggtagtggaaagccaggacggtagatgatccaaaaaaaaatcatgtacaaattaaaagagagggagggttcaaaggagaaattaggggacttggtggcacgttgaaattcattgacttcacctacaggaaacaattaattaagagaaagaagttatgcttacttgactatttccatagtgtaatttggtcaggttgtctatatatctattcagactcatactaaaaacatgccgtcacgtataagccatgaaatagaaagaaagaaaaagagtggggaatgcactcacaaatagtccaattagaaagaatagttaatttacactcgatttatttaaaaatggacatcttgtcacgtctggtgctcaaaaaaattttaaaccctgcaaaacgtacttgtattaaggagtatgtaaaaaactttacatgtaaatagtgaggattgtctacggtactgctaatgtagtagtagaccctatgctgcagaagatgtgcatcggcttacaaagcctcgtaaagaacaaaagaagaagcaagaaaacagctccaaaatgaaaagcaaacataatttctgagctcttgccgtcgtattcattccgttcttaaatactacatccgtctcaacctcgtaattgcataggtagaaataagatcttttatgagtactctactaataagtttattataaactttaaccgcttatttgttaaacagttttgtaaaaatatgtttatattttgaagtgtgtagcgtcgataataagtggcgaatctcgaatataaattgaggtggggctacagtaaaaatatcaaatgactaaagcaacttagtttttatcaactcaatattgtttctaagaaacctatatgcatgtaatgaaaagaaacatattacttaacagataacaaaatctatgaccaaattatgaccaaattggggtgtatggtgtacttatttccatatttgtaactcttggcaagcatgaaggaggtgtttagattcaggggtgtaaagttttaacgtgtcacatcgagtattatatagggtgtcgcatggggtgttcgaacactaataaaaaaactaattacaatatccgtcggtaaaccgcgagacgaatttattaagcctaattaatctgtcattaacacatgtttactgtagcatcatattgtcaaatcatgaatcaattatgcttaaaagatttgtctcgcaaagtagtcgcaatctgtgcaattcttatttttttaacttatatttaatacttcaagtaggtgtttaaacattcgatgtgatatggtgcaaaaattttagggtgacatctaaacaggcacgaagtcattagtagccaaccaacccgatctgccactgtcgataatataagcatacaattttcgtcgattatgatataatcattcaaaagtaacttgtgtataaaatgaaatggttatagttaacagtgtcggttattcgagaccgaacggaatacttcctccttcctattgaataagacgcgcacacattttaatacttcctccatcctaaaatatttaactccatcctaaaatatttaacgctgttgactttttaaaaaatatttgaccgttcgtcttattaaaaaattttaagtaattattaattctttttctatcatttgatttattgttaaatatactttatgtatagatatagttttacatatttcacaaaagtttttgaataagacgaacggtcaaacatgtttaaaaaagtcaacggcgtcaaacatttagggaaggagagagtattcaactttttaaatatttaaccaataattattttattataaaataaattttatgcaatgaaaataaatatcattggtttgatatttgaatttaattttatatggttatgatttttttggctacaaacataaggggttttttaagttggcaaaaatttttgtccatgcatgtgacatcggatatacagactattaaacgtagtttaataacaaaaaaaaaattacagattccgccagaaaactgcgagacgaatttatgaagcctaattaatccatcattagcaaatgtttactgtagcaccacattgttaaatcatggcgcaactaggcttaaaagatttgtctcgtaatttcctggcgaaatgtgtaattatttttttctacatttaatactctatgtatgtgttcaaatatccgatgtgacagcttgaaaaatttcgtttgggaactaaacatgtcctaagtacatgaaaaatttaagtccaaatttaatttagtgagatgtagcaggagtatatattttggccttgtttagttcccatttcccaaaaacttttttccaaaaacatcacatccaatcttttgacacatgtacagagaattaaatatagataaatttaaaaactaattacatagttagaggggaaatcgcttgacgaatcttttaagtctaattagtccattattagtcataaaatgctacagtaacccacatgtggtaatgacggattaattaggctcaaaatattcgtctcgcggtttccatacgagttatgaaattagttttttcattcgtgtctgaaaactccttccaacattcagtcaaacgttcgatgtaacacctaaaaattttcttttcacgaaacgggccctttacgttgatgtaagtgaggccgtgttaagttccccaaattcccaattttccatcacatcacatcacatcaaaaactttactacacatataaactaccaactttctcctaacttcttaatttttccaccatctaaatacagcctgagaatcataaagatactgatggaaaaggtggcccctcaccatcatgtcgcacgcgacgcgtttttgcaggtagttggtttgcactctttaaatccaagctactactaggaggatatagtacagcgaaagaaaaaagcaaagaaaacaataggtcaactgaaaccgcgtggagcatcggcagctaaaaactttcatgggaccgttggatccggatctcggtcgtcgatcgtcgctggcaatccagccgtccggtccggcatcgacggccgtcggcacgacaggtgtgcgcgaatgcacaggtagctgcacgtgggggccgcacgtgccgacaggcttgaaatttcaggacagagatgcagtgcagcttgagctccaccggattgcagctcatttgtggaaatgtggcatggcattattgggacgacttgaattgaaaaccgtggcactcagagactcaactggaactgagctgtggtgtacgtgcatggattgggtagattaatccccgtgctaagaatctctgggacatcttggattagagaagagggcaattgattccctcttgaatgccagttcatgtgcacaatgcaggacaggagtaaagaagagacaatgccagcttaaatcaatgtgttgtcaagaggtttgacaaaaaaaagttcaaactgaagtgaccaccgtgctggcctttgctagtttactgcaacatgacaattgacaacgttgaaatctttcacttcggtctagacaattaggtaatgctgcaatcataaaaggcagtgaaagacgatgaaatatgagtccttggacatgtgacaggaatactcttataaaacggaaacattgggcaccctggctcgctcatctgacaaacttacgaggaagcaaaattacaaatcccttgttttccgccagattgattgcctagttgcaaaattggcatcacctatctacaaaactcaacttttgtcctatacatgctagagaacatactgaactatgtagtatacatagcaggctttgttgataaaattgagaagcaaaattgaatatagcaaaactgggtgaatttgttgcgtagcggtttcgctaccaacagggggaaaaagctgtgcaggttaccaccgccgccgccgccaccaccaccgagagctgcacaggactacaggagcacctccacaagaggacagcccagattacatcaagccaccaatcgcctcactgccttgaaccttgaaccgaagccacggtgcgtaatcttggttcacagaagggcaaccaagactgcacaaagataaaaatcacatcacttttccgtatcacaaaaacaatcatgaaaaatgctggaacgattccacatgcttcatgcttgtacagactagagagtgagttttcacctggaagtttatatctatagctacctcaaatctaacttagttttataaagagaatgtaattccagaatccaaagagattctcaaggaagggagttaaagatttggcaagttttgattctttgccaaagcaaacctgaagtgaataaagagcaggctgccaatcagctccagattgtaggatttttgaattgtaaacatattgcatcagataagaactttacaagttcctctcttttaacttccttctccctttttgcatccagatgtcgaaccttaatagaaggaaaacacataaaattataaaaaagtttctgcataaaaggttgagcaaaattctaaaacagtaaagaacttatttagttttcctcaaataaaatggaccaatgaataccaaagacgttaagtttgtgtttatgtcggatgaattcattatcacacatggtacttcctgacaactcttttgaaataggaaacatgaattacataaatttatgttaaacaaccagtaatttaatcagtatcgacacaatataactcactgctgttcatatgaaaatacagttcaaattagtcctacattccaaaaacatgaaaatcattacttacttgaaagtacagctaagatacaagcagcacaatggtaaaccaaagttcaaatgctttaaaaaggtttgtactcactactcaatagcagagcattgctcaaataagtaaatgcatggcagtaaggtatgcacaagacatttccccgattttttaatctgttggtgagaattataacttcttgacagtgtaaagcacaaatgcacctgtaacacaacgttaatgtatttaccttcacaagttctgtttgtgagacacctgcttcagtgatgaacacaaggcatttgatgtcatgatcactggcatattcatattgttcctgaagacttggatcttcctgagggacaaattgggcctgataatagtaaactctcagtactgataaaaacagacttgtgtcacaaacccttgcaggtaaagacttctgcagcacctacctttatattagcttcccaaagttctgcaacaagttccatacgctcattcaaaagaccgccacctccctttgaacaaacaagaacactgatgctcggttcaatcctaaaagccacatatgttagcaagtaaaaaaaaaatcccatcgaacaattggagatggcgtaaagcatagggaagcaatttatttgttcacttggaggtaaccttgggaacccaatgtcagacgaaggactattaggaagaaatttctcaagtgcaatgctgacaccaacagcacccgggggtttggatttctgtgagggttatcaaatacaagtagttagatcacgtaggcaatcacagtagaaaatattgtcatatagtagtatatgactacctgactcatttaagaaacaagtagacttaagaatgtctaaatatttgatgacagcatagctatctaagtggtctttccatgttctgcctcaaggttttcctcagaaaacaaagaatgagatccaggggatggcatgataaaaaggcgtgcacacacaaaaatcctaacttctcctcatatggagatggccactccttttcactcctcttctgtaggatccaatctctctacttctcctgaaaaggcctataatcttattggaagtaaattatccatctctttatcaggacttcttattggaagtaaattatccatctctttatcaggacttcagtgaaaaagaacaatttgaaacatgtagaagcaccactaaattgctggtgaaaagactacactatagaacagctggatgtgaaccctcggccatggtcagagtgtacttagccaagtggtcatcgtaagcattcacttagtattattagaaccaaatctacatggacacgtataagtatacaggaagcatcaaatacaacttacatatgtcctatcccaagcttgctctatcaaccaatcatatcgccccccaatggcaagtatcttttcatgggaacttgatccagggtttccttctttcacatagatctgtgttgagacccagtaaattgatgggccatagtaaaaatatataagtggaatttcagaaaagaaaatatgccattagcgctaaaaaggaatatattaacatgagatctatcaaatcatttcactgaatacacacataatccctccagtcataaatgtttgacatttaggatgagattcagtcaggcttttaaaattacgaccaccaataatttctaaaatgcttagtttgaaaacggaagaaattgtatatggtagatttgcctcaaaaagtactatcattatatcataaaattattctaatataaaattattggctggaattttaaaagtttgaccgaatcttgtcctaaatgtcaaatatttatgaccggagggagtagaagattgttgttgttccattttatcaagtttgcccttttgatgcaaccaaataaaaagaactgcaacactaggttcaaggcggaaatgaactagccatcactcgaacgataaaggtggattgaaaaaaatggtctccatgattatagttgaaaaagaattgctccacatccggttgtagttattaacctgaaaaaacagatctgtgtagtaacattctgaaggaggcatgagtacatcaatagtaatatgttcttcgattgaccatattctcaaacatttgagaaatgctgagatctcatcgagagccttgcaagcagatttatctgcaacaagaaacatagaatgattgacattttagtacatatttgcagactacagcagacaatgtagaggggcttaatcactaccatagaacagggtccctcttaatctagcaagtacttgatctgcagaaccacaaaatctctgatcagctttatgtagcttctcaaccacctcttccgaaagacgaagatcctgagcattcaataaatatttttatacactaacccattacatggaaagatggaaactgttagtaatggaagcattttcaatattcacatgggaatcttgtgaatgcatctcagtaaatcaagcatttacaagggaaaaggtataataacgaacctaattaaataggataaaactttgcatcttgcaaattgttaacagaattattttttccaacttgttcaatattagtaatacgttgatgcattatattgtttttaccaaaaaaaactattcatacaggagtttcactgtagtagtattcagtatgctttattaatcaataaaacaacaactattaaagtaccaccatggtttgattgtgtattgtggtgcttgtacctgtaatagttgcccacgaatcaaactccattgtgacttgcgatcagccttatttggccaatactgaacaagagttgaagagaaaaactgatacacacacagaaaaaaaaggtatcagctgagatgattccacaaatgtgaggaacaggtgagacaaagtactgtacctcagcaacattttgtcgccgttcttgaggaactcctgcccaggaacaaactgcttcagcaagtttgctatgattcagacggataattattgccttcggatcataaaagtgtgccccaacatccaaagtgacctgttgttgcaagaaattaattgtttgcaataacacaaaagtgcatgtttaatgctgaaagcatcttcagtagtctttgcatccatcccaattgatgttgcaaaacttagatactccctccgtcccataatataaggaattttggtgggatgtgacacatcctagtactacgaatctagacatgcccaaaatcccttatattatgggatggagggagtataaactaattatgaaatatggacctcatatgcagttagggaaaacaaggtaaatgagatcacaagatatataacctttacaatttcagcctctggtattggtgaagcacctccaataatgtcgaaatcaccctaaaaggatgcatcatgatatttacagaaaaactactgaaatggcgccgtaagaagataaacaatagaaaacgaataatgcaaactcacattttgtttgacagttgatgaatattcaatgcaaataaaacagttacctgaagaaagcgataaggaattgaatggccaactgctcttcgatgaacccatgatacttcataacgcttaaaggataatatctgtaaatgagttgtgtaaagtagttgctcatcagaattgttcttagcgccatcctttttcaagcacgcaaataaaggcagaagcgggaaagacacagatgttttcagagaacgcccaaaaaaaagctcatgaaatggcaaattggcaaattcagtgaatatccctgggatacagtggagtaccgaacaacttaaaaggcatatgtagcatatgtaaaacttgcacatgactgcattatcatttggaaccaataattaaaaatggtaatgtacccaaattgaacattgaatcttcattagcttttatctagcacatacaacagtcaacacctgaatgcaaataagcacggaagcaccacactgaaaatgttatctacttcataatggtggtgaactggttagtgctagcttggtaggttttgccatctcaaatcttatgtggaggaatctataaatacatatatgtgtttactatagtgccttttgtaaatgattgcacttcccagttatgtgtatatgtatgtggctgtttaatcatatgtgagttatctttgcaataattgagacctagggttcagttattttatttctatctttgaagtttacaagttgtgatttgttgattcgacatctgatgcaagcacaggtaccgtgtcaagtagatacagaaaattttagtgacaattgggaatatctccaactaaataactatgtttaataaaatgttggataagtctttgtggtccttggtcgtgattcttctttttgcttttgggtagtttcacctttttcaggatagcatctaccctttagcatatttttcagttgctaggacagctgcggttagtaggacagcagcagttagcatctcctttatgcctcctttatgctttattcagtttggatgccctctaggacaacatctcattcaaatttcaaattttagactaggagggtgcagcaataggctagcagccagctatggctatatatatgcatccaacctccctcgggtaggtatggcttttgtgttttatgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttctgtcgcctcgagcactcggcgtcagcaggacgctgagctcgccgcagcagaagagcgtaggcgagcaacggctcagaccgctgcagcagcagcaagggcggccagactggcggcagcggagttggcagcagccagggcggaggcggaggcgtcggaagatgcggcacgtgtgacggaggtagaggttgagaccttgcgcagcagcatcaacggctccatcgccggcgacatcaccgccgacagggagcttgaggagctggcaagaggaagggcacgggagcgggcagagcggtgggcagcagcccacctccacggcggtggcggcggcccaagggaccacgcgcccgccgacgggaacccagacgggcgcgggcgtgccggcggaagcccggagcccgcacgtggccctcgcaggcagcgcggctctctctcccctgaccggcgccatggtcaccacggcgtccagacggtggtcagggactttggtccccgcggggggtggcctaccctcaccaaaaccaactacatcgagtgggccgcggtgatgagggtgaggctccaggtgcggcacatgtgggaggcagtccggtacggcgacgtcgactacgacgaggatcggcgggcactagatgccctcatcgctgcagtcccgcccgagatgcagttctcgctttcccagaagcggactgccaaggaggcctgagacgccatcgctgcggcacgcatcggcagcgaccgcgcccgcaagtccacattgcaggcactccgcaaggagtgggagaacctggccttcaagccaggtgaggatgttgatgactttgctctccgtctcaacactctcttacagaaaatggtgcagtacggcgacgacacctacgacgaggagagagctgtcgagaagctcttccgctgcgtccctgagaagtacaggcagatcgctcgctcgatcgaatctctgctagacctctccacgatgtcgatcgaggaggcgttagatcgcttcaaggtcgtcgatggtgatgagccacagcctctctcggggcccatcaccatcggcgggaagctccatctcactcgggagcagtgggaggcctctcagggtgacgggaggaagggggagtcatcttccccgacaggcggccgtaagccgcgcaaggcacggggaggtgtccagctacggtgggcgcgaagacgtgccgagggtggcgcccgcagaggcgcccagggcgttgccaccggcaaccacaagccggcacgagacgacgcctgccgcaactgtggcaagcttggccattgggccaaagactgtcgacagccacgacgcgaccaggcccacgtcgcacgggtggaggaggaagagccggctctgctcctagctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactccagcgtccgaggctccgtcaagttcggggacgcctccggcgtggagatcaagggtgttggctccgtcaccttcaccgccaagtccggtgagcataggctgctcaccggagtctactacatccccgcgttgaggaattctatcatcagcgtgggacagctggatgagaacggctcacgcgtgttggtcgaggacggattcatgaggatttgggatcgccgtcgtcgccttcttgccaaggtaaccagaggcactaatcgactctacatcctcagcgcgcaggtagcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtttgcgtggtgacgaagcagcggcggctcccctttccctagcagacgagcttccgagccaaggagcggctcgagctcgtgcacggggacttgtgtggcccagtgacaccggccacaccaggaggacgacgttacttcctgctactcgtcgacgacctctcctgctacatgtgggtgatggtcctcggcagcaagggagaggctgcggacgccatcaggcatgcgcaggctgctgcagaggcagagtgcggtcgcaagctgcgcgtgctgcgcacagacaacggcggcgaattcacagcggctgaattcgcgtcgtactgcgctgatgagggcatttagtgccactataccacgccgtacagcccgcagcagaacggcgtcgtcaagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccatctgcgggtcttcggctgcctcgcgttcgccaaggagcttggccacatcggcaagctcgacgacaggagcaccccaggggtgttcatcggctaagcggagggctcgaaggcctaccgcatcctccacctggagacacagcgtgtgcgcattgtgcgcgatgttgtgttcgacgaagggcgagggtgggtatgggacaaggcggtggacgatggttcgactccgacgtacgacgacttcaccgtcgagtacgtccacttcgagggagctgggggagtaggcagctcttcttcaccgagcgtgtctaccctagcccccgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggcgaccagccggtgccgggactggtgcctcgcgacctaaggcgcagttgcaccttgcgtgcgatgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgatgatgccttcgctcccgtggcacggatggagtccgtgcgactccttgcgctggctgctcaggaaggctggggcgtcgatcacatggacgtcaagtcggcgtttctgaacagcgacttgaaggaggaggtctacgtgcaccagccgccgagatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggagatgaaggccaccttccagatgagtgatctggggcctctctccttctacctggggatcgaagtgcaccaggacgactccgggatcacgcttcgacagaccgcctacgccaagcgcgtcgttgagctggctgggctcaccgattgcaacccagctcttactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcaagtgcctcgttagctggcagtcggtcaagcagcaggtggtggccctgtccagctgcgaggccgagtacatggtggcctccgccgcttcgacccaggcgctctggcttgctcgactgcttagtgatctcctcggcagagacactggaacgggggagctcagggtggatagcaagtccactttggccc

SEQ ID NO: 34757 - DNA, 1597 bp, Oryza sativa
aatgttgaataagtctttgtggtccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttatttagtttggatgccctctaggacagcatctcattcaaatttcaaattttagactaggagggtgcaacaataggctagcagccagctatggctatatatatgcatccaacctccctcggataggtatggcttttgtgttttgtgaatgaagaaaaccagaaaattgccccatctcgagtgccatcctcttctcaatgagagtaaccattgaaattctaacataaaaatgcaataaattgattaagggaaaaatagagtataacataacacaattgtgaaacagaacatcgaaggaagaacatttacacaagcagaatggagctattatactcataaaaagaggagaagaagcaaggataaaaacatgtggcggacctggttagcaacaactgacatgacaaacggtgtccgcaactcatagcaaagttctagcatctctcctccttgagttaagatcttcactgtctttcccctagaaatttgtagatagcaacataaaattccattacagagcattgttgaacagtcattagtttattctttcattctagaccaaacactaatcagctgaaaggtgtaggaaccaaacacacctgttttcagtgaatttcccttccagtgtatgcaagggggatatctggaatcttttagcacaatgtctcttaaaaacctccttgctaacctcaatgatagagtctagaagttcactgttatcacttttacaagtggattttttactgccttcaagctggcattgagttttggcaatcagcctttcctcatcaaatattgtagatataactcggtcataaacatatgtgtcttctggcgtctgtatcattctaagtacatctgcataaaaatgcacaaaagcagtggtgcaaattagacaaacagattgaagtgacacttcagatctattcagttgaagtagatgcgatatttattagatcatagctctttcaactagaaatgaagtaatattccagaaaactaataaacttaccagttaaccactcatcttccatccgaggaggtagatcattttgcagaagttcaacagcagatggacggtcagatggacttggagacagtaggcgcctcaataggtttgactggccagggaactgtgttgcccatgacaatggagaatcgcctttttgtttgagatcagaaagaacaagatgcctttccattgctgttgaaaatggataccaaagctcaaagaatataacttctaagctgtacatgtcaacctgaaaaccaacatagataagctccagatagaatttgttgatactcaatattaacttgcaatcttattaagagagagaatatgaaagttcttttgttcattttagtactatgaagagttaaaatatcattctgaccttctcgtttatatgtggccatttctgttctac

SEQ ID NO: 34758 - DNA, 4870 bp, Oryza sativa
  unsure (1)..(4870): unsure at all n locations
atatcagcatgaagcccacttaccaagaccaaaatctccaattttgatatcattgcgaacatcaaaaaatatgttgttaggtggcaagtcccggtgtatgataccctggctgtgaacatgcgctagtccctccactatttgtcgaaataggcgccatgcatcatcaactctaaaagatgaagtatatgtctcaaaatactgtcgcaaggttctgggcaacatccaataagatcaaccatcatcaatattgcaatcaatattatgcttaaaaatgataaaaaaaatccagacagaatgaagatatccaaagttcaacagtcaaaattctcatgactagcttagatgaattgttcaaaagctgtacaattatatatttcccttttatagaaaaatatataatataaaactactgtaatggcagctggtctgctcagcaaacaggtgaaactggttcaagtagtcaagcctgtgaaaaaaagccaacctgggctgctcatgagctagttcagcattgtatattctgtaacagaactgctgaaaagaaacacactcatatccctttaaaaaaaacaaacattgattagcacatgcataatcacagaatctgctgtgacagcaactcaaggtatcaaatggagttcttaatagtattacgggaaaaaagtaagacgttgattagggtacaggagtagtcatcctaaatcatttataacaaaaagaagtgcagtgatcagatttattaacaaataaaatacaaaatccataagggcaaggcaatcttagcactgtttacttcatagcatagtgataacacgtaagtacctaggacagtattccatttggatgtacaagtacgtggattcctgcttatttccaccacctgcatctgataagctgatgttgtcgtaactgtacatagagctctcagcagtacatgacccagcagcattcaaaacatgatgttgaccatactcagtttcaacccatgcctggcatatcaatgacaggtgagatgtaattatctgatttcattaacgtgatcatctaacaactttctaaaaggaaaacatatatgcagaaatattcacctggtagtaacgaacaacatgctgatgttgcagtcgtgaaagcgtggctacctctctgaggaccttgtcaaattattaatgagacacataaaaaaagcataacagaatgctggagtaaaataccaaaaagaagaggaaaatacaggtatatcttcctccagtgaaaaaagaagccatattttgacttttcaaaagtcaagcactttgaccactaactttaatacagtatattcgtagaagatacaaagcgtaaaatttgaaaagtatttttcatacaagctcgtccataccattttcatatatccaagctacatattctagaaaacacttttggttaaactttataaggcttaattgcatgcattctagggcgacatgttttttcttgacaagaggccagatggagtaataaacctaagactgattatagaggctcacataaactagaggaagtcacagttcaggctttagttttaaatgtcaaacatactaactacttagttattggcatatgatagtgataactaaagcaacatgagtaacattctttctttttttttgcgggaagtaccatgagtaacattgcatctacagctacatgaacaatattgatggtctggacattggcctcacattgcagaagacttttttttcaatcattgacaacgtattggagaatttattggttcaaggcaacaatatttagaaatataatcagatgctgagccaattagcaaacaaatagtgtttggcttttaaaaattgaaagtctatctacccttcttctttacacttaaagtgtttaatacaacaaatgaacaaaggtgatcgtcaaaaatatacacaaaaaagaaaaataaacatgaactgcacagtgccacagcactcagcacatttcaattaagagaacaagatcagaagtatacaacccttagaatcttttcattcacttgaggacttctatctttcagacgtatcttttttacagcatattgacgtccatctaacttgttcttgcacagtgcaacacgaccaaaaccaccctggcctgtcacagataatgtcttagaagcccttttgtcatgaggatttttgaggcctcatgttacttcatgaaaaatatatgaagatagccaaattgcatccagattcaatgttaaagttgaagacctttgatatacaataatccactctatagcaagcagcagcagaattccacatactcataatggatactaaaagatgtttgagatgctggtagtgataatatccattgcaactcacatgtattaagctagttatagtaactacggaaaaagaaagtccattaattagaggctgtataataaatgcagatttacttgtgtcaccttttatgattgctaagacaaattatacatatagttattcttaaaaatcaaaatttacaattcaaaagcagctttggattatagtaatcaaaagtagggacaatgctacatttcctaaagaaatatgcactatgtaaatggttaatgccacacaaaaaaaaaaaggtccacaataaaccaccacccaatagcttctttaggctgctcgaaagccgataaatattcangtcagtatcttgatatagtcttgcctaggtccacaaaacactatcagatgggagttatattctcaccaagtggacgaagctcctcaaaatcattcaaataacgagaatttggcctggatgatgaattgtcagctcttcaaaatagagagcactctgaagaggtctaatcaatggcctaagaaaaccaagtaaaattagagatgaacaacccacctgtttcggcagaaggaaatcatgagttagcaaacaatagttaggcatggcttaccatttgtggcccaaaaaagtgtccaaaagtttccccaaagacagcaggagatttcgaaattaaatctttagcccattcagaaaggatcttggtaacaggagaaatgaagataattcaattacgaacgatgataaagaaaattacaaaagacatgtcaataacaatacatggacaattgaacacacccctatgttgcataactccgatgatattgctggcaaagaagctgaaagagagtccttagatgcacaagctagacgaagcaagtgtacctagtacagaaagcaaataagatataatagtgaaggataaatctttttaagttaaacattgtaaggtgaagagagtaccagaattaaatcttttttcttattccgtgaagcatcatcaaacatgtcaaaagatggggtatttgaaaatccagagcctgaaccagaatcttcatcattccaatcttcgtctgaaagatcagagtcctacccatattcacaaatatgcagccagataaggcatgctatgagttatctatctattttacttaagtcttatgtagatgcaactactcaaactcaaaggtaagcaggagaacagtttgaaaacaaaagcaggaacaaactacagaagtaccaaacaatgatcacatgacccacttcaaaagaaaagtaggaacaaatgaacatcaggattttaaccaaaagttcacgttggaaaaaaaaacatcatataagccacctaacaaaactagcgaacatagtataatatcaaacaagccctcagaagttgataaaggctcagataataaacacttgctataagactatcagatgagttcataatactagagattttcagtttacataacacaatccctccattacactagtgatgactagcccgtgaacaaccttaggttaacgcgatattatacattttgactttacataacagtatcccttgaattacactatccattggacaacattagattaacacattttgtatatttaggcaatgccatgctgcatcaaaaattagtataacactgagaaaatatacaagtgtgttcattacctcaagttgatgcacactgctaaaactcctctctggagtacctgatgtattttctctgttgctcgtagaaacagttttgctgtcattttcagtttcctctgcaacgacatgcaaactgggaactgtctcccgaataacatcatgcttcattatatttttctgaccagcattatccggtaataaaccctttgcaacattaacctcatcagaagaaacacgggatttttcaataattgtcttcctcttgcttttaagattagatttgacttgagaaccaacaattttcccagcactatcagttgctggatctggaccttgcatgctccaactacctccatcatataattgactatacaggtcaaatgagttatgcatgtaagcaactccatggtaagaaccattgtcaagcttaactttcacgtctacatcagttgtttgttgtactttgcctgaacccacccagggagcctacaagatatgataccaaataacatcagctatattcagcagtactatatatagcttgggagaaatacaacataaaatttgtggactgccaaaagaaaaggataaatgatctgactgacaaaagaaaaggataaatgatctgatgcatactcgacatctcatgaaatgctacatctgtacatagtatgcgattgcacacattaagaagtgtgttcttctgaacgtgaatattaagaatcacaactgggaagaaaggacacaaaatccaaggcccagccattgaaagtagaaatggtgctgagatgacatattagaagctacatatcacatctgtagcaaccgagttccttaatttatacagctaagcaaatgcaggag

SEQ ID NO: 34759 - DNA, 10464 bp, Oryza sativa
  unsure (1)..(10464): unsure at all n locations
ccctctttgtttaggcttataagacagtttatgagccaaaaagtctaagcctgaacaaataagtagctttttcgtctggcctttttaaaagccataagccactcttacactgttaagccaaagccaaaagctaggttggagtagcttttttggcttatgtgaagtggaggtataactccaccaataaacctaagggtttaaagccaccggcttataaaacatataagccaaaacgctggcttaaaagtccaagcttaaacaaagagggcctgagtaaccatgaaaagactgacttaccatgcttgttgaatcattagctggagcaatttctgacaagaactcttgggcagcctctaccaaattgaatatcataacacgcccttctcgggaataaatgtttgcctagtaacaaacaccaaaaagtctgttaaagttatttaacccattcacaccaaaacatgcttgggaaagttatttattcacagtagaatgtaaaaaacaaaacaatttatagagattctctagacaaaacatgattgaaaaccctgtttttccctgaaagttaacccatttccttatttttcccttgcttctgcagggtccacatgtcattgagacatcatgcgcaaataagggatcgggtgaatttgacagggatagataaagaatcatctaaaacaaattaggataaagtaatgaggaattttaatgaatatggagtgtggtgatcggaaaactttcatttatctacaacaaagaggttatactattctatcatttataatgcttgcccataaggggtaaaattttctttgcagttcaaaaccgagcactggaaagaaaaaggatgcaagactaatagtctaacacggttcgatgaaaatgatgtctacaggcatgccaaatacaatatgaccacaagagcaaaggcttcaattaaacattctcttcaacaaattcaatcagaagcaataggtaataacaccaaggcctggtgttagggaggataacctccccactcactcaggttcaagttttagggctaaacgacttcttcagtgaaggaaaatatcagaagaaggaaaatatacctgatcaacaagaagggaaagcaaccgattagcatcttctctagataaggtcttttcaggtagaacccgcaactttgggcacttgtgggggtaaccagcaaaacacctatttgtaaatgcaagctagatgtcaactagcgaaacaacaaagatatatgttgtatgcataacaggataagtcatagctccttaaaattaaagccatacgttacatcaagagtcgctgaaacattcgaatctccaaagcccatgccatcagaataaggcctgtttacatactcataagttttaaaaactttatttgccatgatgcaggtgatacacttaagagtatgttcaagaaacacgagaaagtacctgatacatatagtaaaacgggtctgaggtgattctgatgtcactttgaagtcctcaaggaaaattgaacccctaattgatatgcaaaaggatgtcggttaaaccatgcaatcactaacagaagaaaaggggcatcactaaacaaaattgtagtgcttttatttttcattttgcaaagcgaaacaatcagtacttgactactaaattgttaatgaataagttattcagaacagtgaaactccaattcaaaactcaaaacaaaggaagtaatgcttgctactgcatactgctaaaaataagcaaaggcgaactgcactagctagtggtatcaggttaggtacccacatgctacgctgctcagaaattggacaggaaaaatatccaaacggcacaaccaacctacaatcagcaaaatgatatgaaagcaaactgcaatcctcaaaatgaagaatgctaaaatcatgtgagcaagcatcagagtaatgaatgagtcagggcatcatactgtactaaggtatgtgaactaatggactattccgtacctcccaaggcagggggaaaaaactcgagaacttcggtacagtctatgcaacaccacctcgaaattcaaaatgcggcattcagtataagttggggaaatccaggcgaacgatatgatgaaccacacccccacctgaatctcgtaccagcataggagacatcacacacatgccacctcgcaattcgaaattccaggccgactaactaaaccggcaatgccgcgaatcaactcgaagcacgcgcatcgcacactaccaggcagcaaaccagcaagcaccaaccatcactccatcagcgatgaaccgattcacaaacatgcagaagctcaaactcgaaaccaaccacgcgccatcaaccgattaccacgcgaggaggataagcgtactacgaccaaaaatggggtgggggggaggaggggacacgcttacagtgccgtgagctcgtcggcaggcggctgtcgcctcagctgcccccgggtccttgggncgcttncgcccgcccccgcccttcttcttcttcttcttcctcgcgctgtgccccatcgccaatcgcaatcgtcgtcgtcggcggcggcggcgaactagccggaaaggggaggcggtctcgatcggatagggattgggaggcgatctgcgttggcgccgcggcgagggggaggaggagggaggttttggcgtgggagggggaacgaggggagagcgcgtgcgcgtcaactcgaagcccagattagattgtgctcgagtcgagtcagtacagaggcggcggcgagcgagatctttgcgggagcctcgcgtcggatgagcacacgtcagaaagggaacccgggcacccgcggatgttatttttggcttttccgtgcgtcatcttccttctccttttttgcgaggataataattagttgtcgtcatcttggcagtagaagcggattggcccgaagatttctggagtttaaaattttgcttttgaaaagtttttgcacagccagtgcaattttcctttgaaatcctatgaagatagatagctcaaatttatgtgtcacgctttaaagatagctctgctcaaaccaggactggtagaaaatgagactgcaagattcgccattgagtctgcagtgtagataactaacgaatgattcatggaatatgtccaagcaagtagtaacagttcgtaaatatttctggtatcgtgctctgactaatgccatcaccgtataatttcggtatgcagaaggttcattacaatttgatttctttacttagcaacaccacataggagatctacaaaagggtggaatttccaacacatcagcaagcacaacaactgaggcacacatatcataatcctatattaccaaagaattaatggaactacgctttgcggtatgtacagcgctgcagagtagacatcaaaaaattgtgtcacaaggccagggccccatttcatcttcccagctccttggtttgctagtttacttgaagaagaacttccaaatttcccggtcagctaactcggttaaaaagtggccaccaaggacaccctcctcctccatcaaagctctgagttgccttgcgccgccattggaaccaaccaagttcttctttgaaaccacatacagtactccgtatgggggtcgcaggcactgcaagaatagcagaaacgacgccgtattagcacttgtggatctttatagttgagtgcatcaattaaaaattactctagcaatattgtcctactcaaagaaagaggtttagaagcttcaactcatttattccatcacaaatcacagcttgatctagatgcatgatacatgaaaagccaaaacagcgataacaagtgaggaactgacctttgtgataagggcatagagcttcttcaaagagttcaccgcataggggacctcagaaatcaaaattacatcatagcctccatcagcttggtctgtctcactggccctctcccatgcacggctaccagaaagtttccttgatcgcctggggcaattgtcgacaccaattatgctgctcccatcatggctactgcagccatccataaagtcgtcctctgagaagctaaggtttgttggtgctgcaggtgggtgtacacctgagagaatagtaggagctcctccagtcccagcaaaaatgacatcggggctaacagttgtcgtgatggtgtaacagggctctctgatggtctgttctgcctgtcccgagcctgctcaaggtttgcaagcacattgggtattgctctgcatcttattgtttctgcatttgtgtcctgaaaatgaactgtggatgcaccctgaggaagcatcgaagcattcagtcaatcagtattctgggtaaagataactgaaagcaaagatatagtaaattgataatcatcagaagcaatggaaagatgaaaataccttcaaacaggcaaaaatcccagccagaccagatccacaaccaagctgcatcaattttcaaaaggaagtgagttatgcatgagtccaaattatcaagttgattctgattcgatgaaagcaaatgcaagcacaaagcatctactaaataactaaatgaagaatctgtaacagctagccaacgatgccagttttctcatgggaagttacctctagaacccgcttgcccctgaagctcaactgcccatcacggatctcatttttaataatgttgacgagagtaatggaactctcccaatatttcagagatcctgagaagaagtgatgaataagactccatggtatggaggaaagaaaatataagatgtgcttattcgttatgcccttaccatcatatttggatgcgactacttcagaaggggagaaggctatcatatccgctacactgaccttcccctgaagcataaggagaacacattaaaacattagtgtttgatgtttatatttgataacttgatggtagcaagggaaagaaactagccaacttgaaaattaacaaaataaggaatatgcatgtgctgcttaccttgaaaatgtcaagaccttgaacatcaaccttctcgccagcatatttgtaaggatgagcactctgagataaaaaggatcaagacatacttattaaattgtttacccacgaaaacaatcccaaaaagaacaccaatcgacagtacaacagacagctgcaaaacatttgaagtatttcttttggagttttatatacaaatgacagccaaatcagaaaaaataaatgtacctttgatgggattatctcgacagctggtgatggtagctgtagatccctttctgatacaattggcacacaactcgtagccttgctgggaagcaagccagggaaacactgaacaagcagtgatggcgtcttcatcgtgccacctgttaacttcagttattaacaacagttgaaattaattttgtattgaaggaagaaaaaattagatgattggactgtaccaaacatgagaatcacaaattttcaatatgaacaccatcttaaactaatatacaaaagagaaaaatggagtcactacaacagactcaattttcctcttttgtaattttcatattttgtattttaaaataaagtacaaggttctgggtgggaactggcattccctaacccttgtgtacatggctgatttctgaagaaaacttatatcatttgaacataagtctaataacctacatacatactgatgagtaaaaaacccaacatcacaagctgtgactaagaaccagaagattgctaagcacaattcgctattgtaaaatcaataatgttaactatatgcctgaatgtggacaggatatggagactctgctacttccaaatccataaaggtgcctttaaaaagtacacaattaagaaagccactcctattgtttttcgaacttagtagaatctaaaccccacacatccatagaacacccgaaaaatactcctagcctgtgcaaatctgtcgccttctatcacctcccagtaggaaatatggcagaaataagatgaaaaagattgcctaaacacatggatttgcaggtgtgaaatcaagaacgcacggagcaaagctacctccttttcaccagcccccatccacacgctgcagttatacaacatctgaactaaatccaccagaaattcaggctaccgacacagctaaatcacaactttgatccctaaacccccatgaaagagctggattctccacgctgcctctccccatgccacatgaagcagtggatgcaacatgaagaaagccaaaaagctgttctacaatttcttttccggctagaagacacacatgacacatcacatgccatgagaacttactcatgaggcagtagccgcctgaatccacaacctatccagacgatttccttcagatcaacccgtaaaactaaacaaggcgacgactgacgacagctaatcaaaccaaagcacccgacgaaaatctcaagaaaaacttcctccttttattttcccccaccctgtccctctgcaaaaaatctccccccgtgaaaccgaatctaccacgaaccgaagcagagaaagccgagattacctcctcgacgggagccccaagagggatcagaaccccaacggcaagacgcctcctctcctcccctccttccctcgcccgcaacgcaacaacacccccttcttattctccagcaagctggaccgaccgacccacagaccaatggagctctccgaatcctcctccaacggaattcttcttggacaaatctccctcccaaagtcagaaagtcaaacccgccacacgcctaggaggagtaaaggtcggcaaggcgcgggcttgggggtggggatatataggcggagacccgtggaagcttcgccgcttctgccatggcagccagagagagtccccccgtccgtgtgcagcagcagcagcggtgggagtgcgagtaaagaatcggtctcccgcgggatggcgtaattaccggattgcccccgtgggcgtgggtgagcgtggaatataccccgtgcggcgccgcgccgtgcgggagatgtggactgtgagaggggtgtgaaatgtgaatcccgaggccgccttttccgaggataggcaggaacctttttttttttcctttctttggccaattttagttccaaacttttttaaaaaaaacttccaacttttccatcacatcaaaacttttctacacacacaaatttccaactccgtcacatcgttccaatttcaaccaaactttcaattttagcgtgaactaaacactttcacaaacttcatcacgaaatattttaacctagcatgtgtttaatctggggtaaagttttagcgtgtcacattggatattatggtcttgtttagtttcaaaacaaaaaaaattcatgttgtcatatcgaatgtttggacacatgcatggagtattaaatgtataaaaaaatacacatattgtgtgtaaattgtgatacgaagcttttaagcctaatggtgacatgatttgacgttgtggtactacagtaaacatttgataatgatggattaattaggcttaataaattcgtctcgtaatttcttggcgaaatctgtaatttattttattattagattacgtttaatattttaaatgtgtctgtatatccgatgtgataaccaaacccaaaatttttccccaaccaaacaaatcctatataaggtgccgcatggggtgttcgggcactaataaaagaactaattacaatatccatcagtaaaccgcgagacaatttattaagcctaattaatccgtcattagcaaatgtttactgtagcaccacattgtcaaatcatggagcaattaggcttaaaagattcgtctcacaaaagtagttgtaatctgtgcaattagttattttttaacctatatttaatacaccatgtatgtgtccaaacattccatgtgatatggtgtaaagttttagggtgggttctaaacaggccccctaatatatttcttctgtcccataaaaaactaacattgtgccggatatgacacatgtctaaatttaaaatactagaatacgccacattatatcctagattcgttttttttggaactgaggaagcatgtcatatataagttaaaacattttggaacgaacgaagtagtccctttgtttttgtttcgttacacggcagatgcataagcacatatacataactacacatgtcaaaccacactcacatttctcggaatgtgtcctctaacacgtgctttaaggctaagtttttttcacttcacaagtcacctttctggttttccgtgtacatgttttacaaactaataaacagtgtctattttttaaaaagttttctctacgaaagttgttttaagaaatcatattaatctattttcaagttattttttctagtacttaattaattatacattaataaatcatcatgttttccgtgcgggacccaaacacagcctaaagagacggaaaccatagcaaatctttcatcttaggccatgtttagttcccacataaaaactttttaccctgtcacatcgaatgtttggatacatgcatagagtattaaatatgaaaaaaaactaattacacatattgcgcgtaaattgcgagacgaatcttttaagcctaattgctccatggtttgacaatgtggcactaaaacatttgctaataacggattaattaggcttaataaattcgtctcgcggtttacaggcgaaatatgtaatttgttttgttattagtctatgtttaatacttcaaatgtttgtccgtatatctgatgtgacacgctaaaacttttcaccccttaattgcacactccctccaacccattttaagtgcaaccataagttttcgtgcccaactgatcgtctatcttatttgaaaaaaattataattagtatttttattgttatgagataataaaatatgaatagtactttactcgtgacttatgtttttattttttttaaaaaaaataaataagacagacagttaaagttaaacgtaaaaaactatagttgtaattaaaatgggacggagggattagagccttactataatcatgttaaagatctacttatatattcgtggtcgtttgaaccatagtgacaccacatcgctggtgtttatctttatcttttctctttttttagtcgtctccgctgttgcgtccggcaacccggcaaaccggccgggcggccgccgttggctcgcggtacggtcaactgcttggttttgccgggcagcggcacatccgaggaccttaatttgtagccaggccaacgacaacctgacacgccaaagaaattattcaaatctcgcagaaaaagtagtcctaaattgctgacgatcgattctgtattagaataaatttataaaatggtagtatagttcttttaggcaaatctatgtatatcaatccctttgcttttaaactggtcgtttgagaaaaatagggacagtgggaattttcaaagttcgatagaatattaaggccctctttgtttaggcttagacttattggcttagatttttaagtcagcttattggcttataggatttataagtcgatggatttaatgtcctaagtttagtgatggagtcatacatctacctcatataagccaaaaaagctcctccaatctagcttttggcttaatagtgttagagtggcttatgacttcaaaaaccaaacgaaaaaagctgcttgtttgtttagtcatagattttttggtttataagttggcttataagcctaaacaaagaggacctaattatcctcatatcaaatattttgtttcctgcaaaataaaatatcagaatattttgtacaagacggagtactagatagaaataacacagcctagtattcactgtatatatatatattttttggaacgccgactgtatatatatttggtatatatatttgagatataacgaattgtgagatttttcatgaaattctcctcgctcaccaattcacacagtgaatttttctactctgcaaaagtgtaacgctacacacgaactattacgtcagcttgctaggatacctgaagctctgaaagtccacatgttacgcgtggcaaatccatatggagtacgattgcaaggttttcatactgttgaaacagataagcagctttcattgctcgtgaatcttgtgggctgtggctgatttaatttgcaggtatatacctgttgcagatgcagctataaatctataatcacacgtgacacagctatatactccgtatatgtgtggacgggagcaactggcaaagtaacattatgcagtcaccctcgtgtcagcatcgccctctcgagcctcacgaaacattcatgaacggtacagtattacagttacatgcatagtaaaaataatactccaggtgacatgtctttaactttactcatatgcatgtaatgaactcctttatactcctatttcacttgcaattagtagtagtagcttgatt

SEQ ID NO: 34760 - DNA, 18518 bp, Oryza sativa
gatgatggaaatcatgtaaaaaaagaatgatggaaatagaaaagctcatgtgggtgactaaaaaatgcgttgaaacatgctggcaaacaacgagttcgtgtgatgttttggtccacgcaacgagtacgttaccggctacacggtgcgagccgtctggtggtgccatgccaagcgtgtgatgatgaacttaatttgcaaagttctttttctttattttctccttctttgttgaccttgtgcatgtactgttccagatggcatctactactactacacgcgcgcaatcagttaaattgcgtgagaacttacgccattgattgcgtaattaagaagaaaagatcatcaagagagaatgtcaaaggtgtaggtaaggattatggagagagaaggcactgcactagagttgttgggtgatttgattaggagtaactagctcgccaggataatccttcactgatagtccaacaactataacctaaaaataaaaatttatgaattcctgcagaaaaaaagagattaatcaaaagcacacgactacactaccaatagtaatttatttactcgagccaagggaataaagacaggttgtgccatgagctatatagctcgaactcgcctttgtatccggatcttgtcgtctgcacgcattcatgcatattgtcaaattaagtactagtttatttatccacacgatcgatcaatgaacctagacgatcgaataatcaaagttttggatgatatgcaccgtacgtacgagtcgccactattgtttgtttacgcacgcacgagcactagagtcaaaatggtgcgttactgtgcactggctgtttcgagtggctagctagcttatcaggttaggtgcccacgggttcaagcgtgtcagttactattaaaaaatatacgagatcaaatatgttggactatggcctttttatttagtccatcttggatatgttctgacttatgacatgggtagtgccataggatctgttcgagatgtacaaatttcgtggaaacggttcaatttttagcggaaacatcggcagttttcggaattccaacttccaaccgggtactaagcatcaccaacaatctacctatatgatttccaagactaattttgagggattttagtccaaaaatcagctccagcagatccctactctcctacccgagttttggagttccctccccccggttcctcgctccgtttatatgcgggcgcgaaagtcgctcccaatcacgcaatcccgcctctctccttcgttcccgtgcgtgggagatagcgatctttctgcgcgtgaaagaaaaaaaacataattttctcttggtagtttaaccgaagggcccacttttaagttttggggattgaatttagtctatctgttggagggaggagttttttcacttcctattttcagtttaggaaacccaaaaacaaattgttaggaaaaaattatagataatctattggtaatatcaacagattacctaatctcccccaaaaaaatatttttgggttttctaaactaaaaatagtaagtcaaaaaacttctccctctaacaaatatcctgcattcaatcccaaaacttaaaagtagatccttttgttaaaataccaacagaaattccgttttttttcttccacgcgcaaaaagatcactacctcctacacgtgggaatgggaggagagaggcaggagtacgagattgggagcgacttttgcgagaacacgcgtccgcatataaacagagcaaggaatcgggagaaaggaactccaaaactcggctcgggtaggagagtaggggaactgttggagctgtttttttttttactaaaattcctcaaaatcaattttgggaatcaaataggtagactgttggtgatatgtttagtttgatgcaaaaaataatccctaccaaattttgacaccatcaaaatcaaaatttggccaataccaaacaatgtaaggtagaggtaaatgggtgttgtttggtttgatgcgttactaattctttttgtgtggagctatgtgaagaagaatctagaaaattaccaaattttgacatggtatggtatttgagatatgtttagactaatatgttattaaaatttgatagtaacaaaacttgataagattaaaaatggtactaaagtgaacaagctcttattgttgtgcaattgccatgcaataggtaagagcaaatgttaagcagcagtgactatatttgtcttcattgcattggcgcatggagtttgtgacaattttaccaactacaacctccgttctaaaaataagcaaacataatgcgaaatatgatatattctaatactactattctagacatagcactagaatatatcatataaagtattatgttcgtttattttagaacggatgcttacattgcatgggagggttgggtgctcatttgtttgaagttattcaatccagctatataggagtacgtgttacattaacatggatatgaaaaagaacctgtcatgtagttcccgacttcccgtactcaaatctggtcatccctatttagattttttgggtgtccagatattttatttttctgagtctatgctagattttttgggggagtgtccagatatttctctgatcaaaatgatactgcagtatatcgaaccagaaaacatggatcacctagcaggacgagtgagctactgtgtgtgacagaggcgaggggaaaaaaatcttcgctcttttcatcgctagagttaccctcctatgtactgtactgattgtcgtttagaaagctccaaacttcacaactgacagagaaaaaacgtcggaaaaagacgcatccaactgacttatgtgggttctacatgtcattaagataccgatggcatatcttaaactttacaaaattataatggtatggttccaaattaccctccggaaaacgcacatttcgtatcggttctcacttttcaagatggcttcttcctcatcctctcctcttaatttcggcgacatgtcattacgtcaaacaaaaggaaccagggtcctttactgacgggtcatgtatgtcggcgtctgacgaaagaagaatcagaaaatgtatattccggactctcatccatcgtaccaaccctcgtttcctcctccctgatgtgaatcggtcaggagcgtagtacattcgcagcaatttgcagagcatatgcagttgcattctgcatatgctattccgtcggtcagacaaaggaagaaacgacgacgaagtcgtgcgagatcttgacagatcggggaggaatggaggggagagtaggtgaggatgcagcaccgatctcacacgacacgccgaccgacccgtggagtgagagtaacaagttaacaaaagcgatcaacataccttctagatgagctccttgatctctttccttactttccaggcgatcttctcttgttggtgcatgacggcagcagcagcattagcagatcaaatgtgttgttgacaggtgagagctaggaggaaatcagaaaaaaaaataaaaataagcggttgtctatggagtgacagctacgctcgctctgaagacacaggagaaacggaagaaccaaaagagagacgtgatatttactttgttctgctcaagcttttgacattagaccagggaccattttttccttctttagaaaagttcaatgagcgggcccaattctaatcaaactgtggcacactgcacctagctagtatatgtttgaactttaaactaatcctgctctggaaacagaataaacctgggggattgaaaccaaaataagctgaaacatacggtggactatcagaaaaaagggagttttgccccaatgctacctcagcagtgcatacttgcctcaaattacagttgccgtagctgccctgctatatgatgcttatacatgcttatacatccaacccctctatatatctgtacagaattccagcttcagacaaattaagctggttctaggcttctagcttgtatcacgccaatattggatcaggctgatatttaaattcaggcaaatggtcaagcctgcaaggaaaaaagggtattatcagtaaaacgtgaggtttgtctggttgatccagaagttctaacaatgttactgccggtgaagctgtaatttcgccatgtctgatgtaagtagtacagtggctcaggaaagacaagtttgccatcatagtatgctatagcacaatcaaagggtgcaagctaatcattcgtacctttgtctgactttgagaataccagtgccaagttgcatgggtatacccatgataatgcattcactaactccctctatctgatcctcacgaccactgtatgatgcattaaagagatgctccgctgttttctcaaacgaagccagcatcagcacactacttttcatttttgcaataccatatctagtaatgccaagaatttcaccctgctcggagaataagaaccagcagtatgtaagttactgttgaagggtacacaacatagattaaaaatatagcataataaaatgaaggtaggtgttaattattgtaccttgtatgtcatcaaatctgccagaagcatcatatgtctcgaatcaatgttcatcccatgacttttcattgtatactgaatttcatcaataatagatctcctcgcagcttcaattccgagtgttcggttcacttccatgatgtggttactttttgttttcatagcatcaactcctggagtacccattactgccaagagatttgttctgcaattacagaactatttgattaatattctagaaaaataatgcagaagttggagtaagtcagaaactaagccattccaagagacaagaccctggaactctagtgatctacaaaaataggtcaataaaattctaacaagggtcagcaaatctacaaacggaactttagttcatgctgctaaaactgtgaatgatatgattatatgaactcatacccctcaaccaacaacttgtatcttttgtcattttcttcaccagtttcgctgatcacagctctttcaacagttggaataccctgaattgattagtaggaaggtcagagacagccaaaatggcacatctaacactgcacatcttgataaatgctaaccttcacgatcacttttggaagcatggatttgagatgatgtaactcatatagaagtttggacttatctattccagctggataaattctcaacttggatttatcaataacacgaacatgctgcaaagatgacgtacaataaataatattaacagaaaaaactgatggtcaggcgtatcaaagagctttgttgatacctcagattttagctttatttttggatgattcaatattgacagctgcacagagtcagcagagatgcccatgtgcagggcttctatacgttgcatatcgagtttaacaaccaagtttggttgacttgatttcaacacaatctttatggcttcagccacctgctcaacacaaagaccatccatacatccaaaagttaagggcaaagtaacaccgtgaaattcctaaatttgagttctctccttcataaaatttataaattgtgggcagagcttttcatttctgtaaattgaataacctggtaaatatgatgccactagcttgatgcgtagacaaatatcaaatggctaatatctttgaagtgtattaaatgcatgtcatgattttaatgtatttaagaaacatagatgaagatgtaaagcagactgacttcttgtaagttttaagtgcgtgtaatgatgtaaaatacaagaggatacaattatcaacatcgaaagcaagtttgggggcaacatacctcacccagcactgccttttccatagagcctttcacaatgcgtgcagacaacacatccttctcagaaagtaactcagcagtgataataggtgtgcttatctttttagcagcattgataatttccttgatgcgaggaacaccaagagtaacatctttttacttgttaaggaaagatgatttgaacagcagtgtccaagaatagcatgtatgcattactctacatcaagatatcaaatgctgtagtattgtgcaaatcaattcagattgatgaaagcttatatcttttagcgcatattattgacaatttcatccgctttatcttagatactacattccaatgcccctctaaagtaaataaattataggaaataggccaaaacgacctgctagtaattcttaaaattaaaagcagactttcacgaaccatatagtatataggatactcatgctagctactcctgcaaaatggaaagttttcaatgtcatctgagttccaggctctccaatactttgagccccaattgccccaattgatgctccggcttcaattttcttcaagtggtaacgagataaacatgtgtccaagaaaacctgagccatatggagaaaaggaaaaccattacagaatgacgacacaaggataaaatgcataagcaaaccaataaaaataatacttgaaatcagtttaacatttactgcagaaaattagcatgaccacgcaattagtaagagaccaaaaaattgatcagaaatagactgtgcttgatatttcaggtttttcgcaaaacagagatgaattggtatgtgaaaaatatgaatagacacacctgtagttgcttcacagatataccagaaatattagcagcaatggattcttcaaagctggagtgcctctctccaacatgatcttcatctaggagaagcgctctccttgtgctcttcagcaattttatacgatcctcaagaaaatacgttaacagttgcttgaacttttcgctacaaccatcatcagaggaggcatcatgttcagagagcttgtcatttaaaatttgtaagatttcacctggagataatgtattctgtcccctttgaggacaagtggcctacaacagtaaaatggttagcacacgaggcgcatctcacttgatcaagtaaacaaactgtttttacatgttaaaactgaccatgactttcataaacaattgatccaaatttaagggctttccatctttcccttccatctttgcaggatccatgccatcatctccatagaggaactgtacaataccaccactagcattgcggaccgtctgatcatagaaaactgagagatcttccaatcccttcattaatctgcgggacatatatcctgtttcagctgttttaacctacgatcacaagttcacaaccaaggaaacaagcagaaattatattccaaatttccaacaattcccaaatgtttttgagaagccagaaggcacaatgagtatgctggaaatgcccaatgggttgcaccttggtccagctgaatgcacaagataccagtatagttcacctaacagacctctacatagaactggcatagtgctgtgaaggttttcatgcagcgaactacagtgcctgagataaaacactcaactgcaaggaccaaagcctaaaaggcagagtcaaacggaaacgccagattcaactctggtatgcaagcaagttgatttagtgcccaaacaacgaacaaggaaacatcttccccaatcattgctgtgctcaaaatataaaggagaagtgggcttaattctataagaatgtgatgaatgaacttatcatttgtttctagttgatgatgtgctcttctataatagctgctaagtttcctaatcctatccctgccaggcacaaggagctaattcagactattcctctcacataatatcatcattgtactactattaattcaattgagtagtatgtactgcggtgtaagtctatgtgagcaaatttaagaaatttttgtgctgaaatacagatagagtgcaaatatcaacttatgcaaacaatagatggttttatacatagacataccgctgtatcaacaagaccttctcgcccacccatcgtatggaagaagaattcggtggcagtcaagccagtatagaaagaattagcgacaaagcctttggcctggaaatggaatacaaaacatatttgtatgtgaatataccaaaatgtgctgatttcgtgacctttaattcaaacaaaattgcagtcagaacaagttgaataaaaaaatgttttctctaacaaagctaggtggaggactacgagtcaacgaaatccccactctgaaaaggaccaatttttctacatgataacttccaatagaatcccacgatcctttaatgaaaaataaataattaattagccatttaggataccacatatatatacatcaaagggaagtaatgtcaattcagaactttctataacataagagatattgtgtttaaaataaaacattacatatattttcaatttccagcctctatctctatgtatagtgccccataaaatttgaagagtacttatttgaacagaactagaaatatccagcaccagaaatggatacacaaataagcaagtcatatttctagtactgatgttcttactgcaggagtctttgaatttataggaaagtggggaagagttcgatctatgaagccattcggggcacgacgccctccaactgattgttggccaacacatgcaaccatctgactaatgttgattggagaacctttagatccacactgagacatgatcaatgggctgttcctccagtgaagtgtattcatacagacctgataaataagtttaagtgcattcaataaaaaaagtgcaaaatcaaatttgaataattttgttttgagtcaacaaaataattgcatcgggtctccagtagaagtcaaaatcacgctaaaaatcagactcatgatgagaatatccatgcaacaaaatttggttcaggaaaattcaaagatttgctcactggaaaataatatgaaatgcaaggctaaaaatatttttctatctgtaaagaatatgcaaaagtacaacaatggattaaattaacaaaatattgacaggcttactggctaaggaaattcagaaagacaataaaattggatgaaacatacttttccagcttcttctctgatttcattcagtacacgagttatactttgctccaatgtttgggctgcgttgcaaccgggctgcaaacggagtgcacctttggaataggaagcaataagatcatggcaatctttgtaccctccatctattttcattttcttctcttggtttaaatgttctcccggttggacatcgtccacaccaattgagaaaccatggttccctataaatcttgcactgcaggaaaagatgaatgcaattcaaatcagaaaaaaaaatgtgcactaaattatgtaacaatctaacaccaacaatacaaatgagaaactcagcaaaatggtaataatagagagataaaattgaacgagtgtacaccaactaagctccctgacttaattagtgtcaaatggcaaagtggtttgcgtacaaataaaaaagatggcagattcacgtaaaataaaataaaaagaaggcagagtgtttgacttattagtgatttctattaaccctctcgcattctttaatggaacaaagacagaacaaaaaaataattgcatagcatttgttagttaatatttaggaaagaatgggtccattacgcaattttgtagctcacctaaattttgccaagcggttcatacagcttgccgcagcatgagaattataatctcttacaagagtggagaacatgccatccttattcccattacctggaaacaaaagattaaagattgttttggtttgcttccaaatttaacaagcaggatgaaaataacaaggacaactaactagcacaagtgaacaatacattttccaaacctgattaaaggaacatttattgtatgtggtgattcataagagggtaaaccatgccaggactattgtttatagtccatgcctataaactaatgttctcctaaagagaatatagcatactcctccatcccaaaatatagctgcctttctagctcagattagagaggtacctatatttttgggacagagtgagtacttaggattatcaggttggcagtcgttttagctatgaatcagtactgggtgggattctcacctaaagtggccttcccaacttgcccagatagaagttcactgtttcggaagtagacaaaaccatcattgggacacattgcttcaggttccagagttgaacccttaggagtcttataaattttctctttaacagtaagattcagaaacacctttgtacatgcgttaggacgtactaacacactgaagagttgtttaccagtccaaagctcaataggctgtacaaggagaacataatcactgaatcagtatacagagaaatcaggaatttgatgagaaagctaagatgcacaaaggcgcagctggaaaagagacaaggtactgcctcttgttatgcataataatgctgaaattcactacaaaaattactaaaacttatatgacaaagtaatccagtttgataatactgtcgaagtcaaataaaagtgatggcatgctgtcccccatgcccaaataatatctcctattaatgacaaacattggttgaagcattaagaaatagcatgtcttcaatctgatacttgcaaagtgcgttcctatgaaaaagccttaccttaatcagagcaggtgttggcaaatcaatgttttccattgcatcaccaagatatgaacataagagagaaaatgacgacctgtcataaaagttatcttttcttgtaaccagaaaagaggaagtcaaaaagtcttgcgtggatgcaaccagtatttccccattctttggggtacataaattgttctgaacctgcaaaagtattaatgattttgaatattagctacagaatagtggtagaacatcaaaaaaaaaaaaagatggtcaactgtaaaaagaaagagttagcaaatgctacccccatgagcataagcgcttcagtgcgggcttcctcagtctgaggaacatgcaaattcatctcatcgccatcaaaatcagcattatatgggttacagacagactcgttaaaccttagtgttctccagggcataatcctagcctgtgattaaatacaaagagcaagggaccaatatgaggtaacattttcatgtagcgggtgcagtgtaatgaagagcaatttataccctgtgagacataattgacattctatgcaagctcggttgtctattgaagaggacaatgtctccatcttctaaatgcctttcgactacacagccatacttcaaatctcgagcagcaattcttctatcgcaatactttaagtgcctaaaaatgtaggataattgagtatatacgctgaacttataactaatttcagtgcatttactgatatgacttacagctttgttccatcaggttgtatgatgaaatttgcccctggatgtttgtgtggaccattccgtatacactgacgcagcttctctatgttatagtatgaaactctttcaggataagtcaaaactcgagccatcaggatgggaatagccacctgaagtgttaattaatgatgacgttaaacatcaacaaggaagtgaacataaaaaacttctatattgccatgtacctctgttattctcaagtttggatcaggagaaatgacagtccttccagtgtactcggtacgttttccagacaagttaccacgaaatcggcctgtcttccctttgagtcgctgaacaaggcctcgatgttgtgactcgggaagagagggtgcgtcactgttgatatattcaacaacttgaagttgaaggtgttgccagcaatccttcaaagattgaaaagaagtagatgtaatcatttaaagtaatatcaaattgttagaatgcatatcgtacagtcagaatattttgatagcatagcaccagaggaactcttgtgaaagagtcataaaaaacacaattttgaatgatctaaatggttgttttccttcatagagacgagtgcatttttctcttgaaacagtagttactgacttagtaatttagttagctaaataggaataagcattttgtcacacttaagtcggattttcaaaactgtaatactttgaacctgtcatgctgataagacaccagcccccacatgaattctgcatatcaaaggaaagtcacaatctgacttactacagaataatcaatcctgttagaatatgatttctggctttcatattttctacttgtgtaaatcatcaagtttcctaaatattttgccttgtaggttccatacagacaaattgagattaaccctaaactagattatgggtctatcaagctgtgtgtttcatgaagatacagagacaaggtgatttctgagtttctagcaaactatccgaaaggaattctaaacatacagaagttgcactgcactaagagaaaaaaatgggagaaaataaacaaacgaagagctgtgagtgtcttacaaagcacttcatgaactgaccaccagtttgaaggttctccttaaggatggaattagtattagcaatactcttcaatatgacggtaatgctatcttcattgctgtgggaagcaagacaattcaatgcattaaaaggaaaatgtggttatgctgaatcaccatttgacatataggtactaaaaaactgaagagcaaacctcattcttccaccagccacgaaaacagaaggacgtataggtacaggtggcactgcaatctctgtcacaataagtttctcaggcctatcaccgaggtttagcaactcacaatcctgtagagtgcataatatcaaagtgagagaaaacatacataaaactaatcgaacaaatctgtagtctgtacaatacaaattgtggtactctcataaaatagtaatcttgaaagacaaaaaaataggatctacctcatcggtcattcttttgaaaagagatagaacaattgcagggtctagcatgcgaacagcactaatagatagtttctctttcttatgtgatagtgcgtcccgaagctcttctgtgcttccatccaatgttttgctacaatcatgaagaataatcaaccctgctctgccctttttagcaacacctgtactaccaaccaaagaaacgcaaaagtgagaaatgttctgtaaaatgttgacagcagtcaggtgaccattagtaagccatcctaaggaaaatttaagtggcgaggagccgaggataaaaaggagtatcagaaagtagcttgccatttatgaatccacaccaggggcaacgggatagtttgcatttgtccctcacttttttcatgatagcacttttctgtagcggatctgctttgggatttctcattttcttcaaaaactctagccgatctttctccataagaagaaccctgctgcagctctttaaataaattatggaacaagtataagaataatcacatttggtggatttagacaaaacatctaatcttattcgtgcagtgataccttgcagatgcacttcaatacatccaaaatacagttaaagaatccaacattaaaaactggaagggcgagcttcaagtaaccaaaatgacccgggcattcagcaaatgaaccatggcaagtactgcactccccaagcttgtttgccgcaccctgaaattatatgaaatgttgtataaaaaagaacaacaatgaaccatgaaacaggatccggaaagcatagcccagctgccttcctatgatgaagcaaatgaaaccacatttgctcaaacatctgcaatcaatgagaaactcgaagggcaacacgcatttaccatccgcgtgtcgagcaatccattgggcaccggcttcatctcatggttgtagatccggctgttccaaacctgcacctccgcggattggcgcacctcgttccccgagaacatgctgaaccggatgctctttctgaaccggattggttcaaatcgaatcagaaaacaaaaccaaaagtcagtaaacacaaccgcagcgcgacgacgacgacgacgatgaaaacacgccggaccgacggggccttacatcctccgcgtgccgacatcctcgatgaagggctccttcgtgcaccgcagcttctcctccggccgcgccatctcccctcccgactgggctccgctcgacgccgccgttcgcgagccggagccgcttcggatcgtgaaaacctggcggaggaggcagagtaggaaggggagagggagaggtgacggtagcaatggggaatggagctggggttttgtaggggcttagggcgagggagagggagagagagaggaggctagggcgaggtggagaaggagaggaaaccgtacacaacgcacctacgggccttctcgccggcggcgcgggagaggaggcgaggcgaggcgaacctccgacagccgccgcccgccggctcgccgctcgcgcggaaaggggaggaacgggggagagttggcagcggcgcgggaccctagatgacttcgcttttttcggcttggaggaaataaataggtagggcgagtatctacattgtttaattaattttattcccgtatcttagccgtatgttggggatcgacgggttggcttgttccgttttatgtaacagaggagtcgcgggttcgattcttcttcatatcatcaccttttttttcccctaaaaaatattttttttcctttttccctaaaaaaatcccctaaaaatttttttcccttttttccctaaaaaaaatcttcaacagttaaaggcatgtttaaatatacagcccccacacagagttatacaagagactctcacagtacctaagccaatcatgactctaaccattaaaaaaattggtatttttctttcgtttacacccttatacaacaaaagtgtttattttatatatgctaaagatcgttgttgaaccatttaaccgtagcaacaatttattttctcatatcttgtatatatctttaaaaaatatatttatctgtgttctttcctgggtgattgtgtgtgagtttgtttcgttttccgcgcgcacgcttcccaaactactaaacggtgtgtgttttgcaaaaaaaaaattatagaaagctgcttaaaaaatcatattaatccatttttcaagtttaaaatagttaataatcaattaatcatgcgataatggctcacctcattttgcgtatcttcccaatcttctctatctccttctcctcaaacacagccctgttcggatatggggagttgggaactaaactccccgcacagaaaacagaccagtccattagcgcgtgattaattaagtatttattattttttttcaaaaatagatcaatatggtttttttaagcaacttttgtataaaaacttttttgcaaaaaaacacatcgtttagtagtttgaaaaacgtgcacgcggaaaaagagaggggtgaattgggaactctgggttccgaacacacccttagtatcaacaagtattctctttatcatcatatatggcaaagtgctttttattttactggtgccaagagtcgttttgaggcattgttaaccggccaacaatgtttctctcctataatctttgtcttctatatgaacgaatagttccaattagtaaggctaaaagctccttattgatgaccattgtactggtatttcgtttatggccttgtttggctctcttgcagttacaaaccagcacaaaacagttttttgtgccttcggttgctatagcgcagtcgcaatcctgttacaagaatatctcctgaacaagccttataagattaagggtttgtatcactcttttttgttatttatgttgataaccaaatttggaacagacaaatttgacaagaacaagccttagtatttttcaaattatactaagccttgaaaaatactaatgcttgttccggagatatggctattgctctgttttctgtaacagggcagcaagaacggccaaatttgaaaaacactaagactttcccatgaaggccagttttaaccgtcactgtgtaatcagtcagaccaaacaaatatgatgtggtcaggccttcagcatagagtccgagtccaagtaaggaatttcttgcgtttccttattttataccgagatttcttgagtttgatttctttagcctaattggatcctggaaagcaaatccacctttctataaatatgaggacgaaggttgattagaaaaacaacaaatcaattgtcaaaatcaatttatcacctaaaacctttattctacatcttcctcctgtttgctatttatcccaacgtctattctcctcaaatcccacaattgtgcatcattttttttgtctttacattgttataggacgtcctggctagcctatcaaggctaggacaaactgacgcgtgttcatcttgagggggtccctcccaggtgttcattcagcggcatatacctctccatgtgacgcgcgtctttggttgttgttgcgaattgcacgtaatatgctcaaagtgtggtagcgcgattcaacgtctaacaatttcctctggtagcttttttgttgcacgtgttcgttgttgttgtctatccaagtattgattcttattttacataacagatagtgtataatataattctagagaatacataacgtgaaaaactaatttcacatgataaatataagaatgaggtttgaatcagtcatatgataaatcccgaattgatggtttttaaatatgtttaaaggtaaaagctcgatatgagcttctagttcatttcatttaaaatctatcccctcatgacaaattttagactaactttttactactttcgtttcattttcgttactctcgttcaacaaaaatctcctcttttctatttttcatatcagcaaatctggtttagcttttttaaaatcctttcttaatctaaatttgcatttgttggcaaggctatgaacgtgctatttgtaggtcttgtacatgcgcttgttttttttcccctttgtatcgcctgacgccgggtggactgttccaatttccaaacaaaagcccacaggtcaatacgtcctatgttagattcaggcccaaaaaggcctatattcgaatgcaatgtgtaccacacatcttggatcgaacgtctcacagagtacatcctggaacgggattgccgagtaaatccagaattccaaggaaggtgagggccctttcgtgaaaactgcctgcctgacatgcgggtccggctcgaaggtgggcccaacattcaacgaggaagagaaggcatctccatttccctccacggcgtcgccgccggcagccggacgccgcagaccgtcggttctcacctctcgtcattctcgcagacctataatcgccagtataataatatattattaaattttatatcgacctaaaacatgacaaaatattagcatttccattacgtgtttatacgttgttaatggattcaagataatcactagtggctactgattactatttgatgaaaacaaaaaaaagattcaagataattaccgcaaaatccacactaatggcttctgaatactatttgatgataacatgaaacgcattcgacataatcatctcaataaaaacttgcaaccatgcgtgagaatttattacaaagctggcaaaccatctaattaactttaggcttctaaagaagcagcgcgacagccgtcacggcgaggacaccggctccaccggcgaaggcaacggcggcggacgaactctcctgcgccggagccggcgcaggcgaagggtagtgcccgtagtagctaggtgcttgagcgccttcgtcagcgctaggcggggacggcggcggcggcggcgactgatggcggccgtcaccgggagtaggagcaggggaatactgaacatgcgacgacggcgccggcgccggcgccaggtggctgttcgtcccgtggatcaccgctggcgctggcgccggcgcgtgggccggccacggccagctggagtgcaccggcgccggagcatggcgatcatgatgcgaactcggggcgtgcgccggggcagtagcagtagcatgacggtggtgatgatggccatggtgatgatgatgatgcgaggggcttggcttgtcgtcacggaccggagccggggctggagcgtggtgatgccactctggggcttgcgctggctggtccgcgtggactggcgccggcgctggtgcgtggtggccgtgagcgccgtggtcgggagcgctcggcgactgagcccgcgccggccacggggcgtggtggtgagggtaaggcgcgtaggccggcgagtggtggtcggcgcgcgcggccgacgccgcagccaggagcgaggaggccagcagcattgacatcaccaaggccattggcgagatggaggtggccatggagagaagctgtgaggttcagagaatgcgagctacctcgtgttgccgtcgaaggcgagcgcgcatatatatagtcacaattcaaagatttgtttccaaagattaaaacttgggaaacgttgctgattatttgtcgggtatacttggcaag

SEQ ID NO: 34761 - DNA, 4734 bp, Oryza sativa
  unsure (1)..(4734): unsure at all n locations
cccccccccccccccccacagaaaccgatcttattgattatcttaatattggcataacttacgacattcccccaattcaaaagtttctttgcattctggaacaggatgaataaatttccttgagaattggccaattcattattacaaggttacaacatcattacaacaactcagttcattggtggcgcacatctgctagtacgcgctacttccatagaacaacacaagagttacagatatcgatatagagttatatacaggatgaactagatgatgatgagcgaggcttcaaggataccgtcagttgattaaaaaaattgggaatgacctgaggttttttagccatagcacatgatgagttgagaaaatctaatttgcataggcaacagttctctgctaatacctcctcacgccagctccactgttcattgaaaacttcaactttgcatatgttctttaccaccaggtttgaaccagaggtttctcaaccaatggagtcgagatctaaaaccatagctatgtaatgctatcgatgctggttgttacaagcctggcagtttctggcagatctggggttagcatatgtgcactggtcacacgtccaaatgttgctttcatcgacaccacggctcgagccacctgttttggagctggtactggatgctctgctcttgctactcttacttttactgccaagactcttcgaagttgcgctcttgctgcatgtaccatggctagtggaaggacctacatcatttaatccagtctccaaagcccggacaaggttctcgaaataattgcgagtcacactgtcaaataaagagagaacttcagatgaagatatagtacaaacaaacgaaatttaaatgatcatctttttacaattaggagtgatcatgtcgtcaaaacaatcaaagaaaaccttccaaaggacacaagcatccgagtaataaggataggaaacatgaaaaacagaatgatctgtagtacctagttaatccagccaactttgtacggaagtcattgaaatcttttgagggagattctgcttcaaggtatacttgaagttctttctctgcacattgatgcagccgctccaaacctgattccgcctcacctagataaataagcaacaagaataaaccagataagtaactgatacttgcgtatgctatttagtattacagcaaaactacgaaccttgcagatattcaaagaactgtcttttggcatgttcatgctctgggaggtaaaaaccataagcataagtccacttcaataccctcctacattcgacaatctgcgtattgaaattattaaactcgcccatgagagatctaggaggcttatgagagaactaaacttggcaatgaaaactaacctgtaaccaagcctctatgatgaacttgagctgtgactctggttggctttgtatatcacttaacttttcaagctgaaaaatgatttgtgaatgtcgctgttagcatatgttctggacaggctggagtagctgtattataaatgattaatacatgaacctaacatggcttcagtacttttgggtgaaattggatataaagaggataaaggagagataaatataaagtatcatatttatataccttgtcggtttgcaaactcagcagatctcctaatgccttttgcctcgactgcataacgagaagatattaagaaaccagaaaagttcttcttgagtattgattggaaatcttttttactacttatgtaaaacacaatgctttgttcaagtaacttttcttgtacccaataacttaccgactgattggctgcccaccgttcataatagtgtgtatatctctcaagcgagttctttgccatttctcttctcctttcagattcatcatactggaaccagtgcgaagcagcacaaattaaccacaatattaaataaaaataataaagtattaagaaaatatctcagattagaactgtaccgctccttcctgccttgctgcctcataacggttacaggcataaaatccaccagtccgttctccatgctccgaccatggaccaagacacagcctgcgttatatagaacaagtacatacaagccatatgagactgcaagtgctatgaagagcataaacagagagattatgattacataccagcaaaactcaaatttgcatggaggtgtgcatgtaatgtgcatgcatccctggtttttttcaatgggccgcttgcacttaggacaaggctttgaattagctagaatcctgaaaccataaccaacagaaagttcaacatagttgacacaagaaataacttgcagtaaaaacataagaactactactaatatgacaaaaaaataaagtcaaaatattggtgtttcagaaaatcaccaaacaataaaatagcaaaagttttcagaaccaaaaggaggaatgagattaggacaaagttttcagaagaaagatcaaatgcaattaaaggaacaaaacttacaataagaaaaatgtcagtagtaatgaaaaagaaagctgtgttattctgacaataccagttcatattttcagactccgcactgttcttgaggatccactttgaaacagtggcacagtctaccggacgatgagcttcctcagtgcactgcaaattttatttcaaatggtttatgccctgctgatcacaatgaaatgaaatggcaggtccagtactcacgttccaacaaaagccgtatgaacagttgcagttcacatcatagctaccactgcccatgacaaattctacagcatattcacatccaggagcaggacaccattttgtctgttccaaataggaatgaacttaatgaacatatgcttaaaaaaatagatacataaataccaaaacttgagaattggccaaatatagcacttgatcatttcctatgaaggcattcacactaattacaaactgtcagcaccatttcaaaaatatattatgattgccacattaactgtaagaacatcaaggtttattcaaaatacagagagttcactccatttttaggaaaaacaagatgcaaaggcaggagaatggctggtttacataaaacatataataattcacagtagcagccatacagattttcatttattcatttgtattatgatcaacctaccttcctattatcttcaatgtaagatctgcgaagatatcgcccatacttttccctatcctcgtcatcagccagtgaattgatcatatcttgaccaacagcagctgtgcaggacggatcaggacatcttaacatcaagcatcctggaccatcatttatagaagtgctaatataacctgtcaatgtgcactatgtaagtggtgatcccacacaaaacagaatccggggttgataaagagaaatatctcaaggttagattgtcaaacctctccaacatgcactacagaacggatggccacatgcagcagcactcattgacgtacgaggacaattttcgaaacaaattccacatgtcaactgtcaagtgaacaaaatgtattagtattgaacagctgatgatattcatgtgttctaagtaatgacaggtaaaaaccatcacaaacaggcaagagaaaaaatgagatatgaaatgtttgatgcacattcttcccacaactcacaagtcacaatgtatagcactatagtacaggcaaaactgagtgccaatacatgtgtactgcatgacacaagcatactatccatttttttctcaaaaaatcctggctcgcaggcatacaactgctagaacttcaaattgtttgtacatcccccaaagtttttaattgtttaactagtaaggcaaaggcatacttctctgtcatttggcatttcaatgagcttttccggaaaaccaacaaccttacgaacatgttcttcatcagcaaaccattcatcatgcaccttactgacactcctgcaggggggcaaaaccaaataatagatgcatcattctttgtgctctgcttcantatggcaataacagatgaagtacttccttcgtccacaaatctaagggattctaggttgtttcgcagagttcaaggttgaggtgaaattactttgatgcagggaagtttatttgattgggaaagatcacgcctagcaatgcaactaccaaaagcaaaaaatgcagtagttggatagattaggaaagtagtactccaaaatcccttatgtttgtggacggagggaatagcacatttgggctagattacatggtgtactgcattaatgagccaatgcagcatgaaataatatcccacgaccacgattaagccctcaatacaataaattttgataattcacaaccatgtaagtttaaatcagtttgtttattaatagcatgtccacgagtaaacaaatatgacatggacatggatgaattatcaggtatgagaatcaaagacataacaaacttgatacagatagagcaccaaaaaagacaaaaaaaaaaggagtatgaggcagcaatgtgaaggcaggtaatggccattaccagttataattacgaagaagaacacatgcttctgactttgaaattgaaagaacagttgaaaccctatttatatcatcctcttggcgctgttgtatatcggcttcacttaatatactgtaattttgctggggcataaaaagttcatataatgttaaaatcacacataacagaatagcgctggacaatcagttcatataatgttaaaatcacacat

SEQ ID NO: 34762 - DNA, 14291 bp, Oryza sativa
  unsure (1)..(14291): unsure at all n locations
agtacgatttttctgttagctcatatgatgcaaaggcctcctccagcttttggaaataagagatttccatgagatgacctaaaaactgttggaaagtcgtctgtctttagggacaaataatcattttggtatattttcataaaaacaacatacttcaggaaccaatagcaactttcacacaaaacattccttataactgaacagaaagatcaactagagaaggccataaaaaattctttgacaaataaactggtcggcagtgagcaggatatagtgggatagtccacataagacattaagacataactcaatggatagtatgtctaactcattgttggatggagacctcggcaagtcggcatcagtttatttggctagcttaggtgacaagaaagcaagaaataagaggtgtacttgtgcagatggaacaaggaatagaaacaagcgggaaccacaaaagctaagttaggaaggatattaattaaggaggcttctagacagcgtaccaacaaaaaacctattatccacaagtaataactaataaccgcagtgctttcaaaatggaatcaagcacccatacaataatcaatatcttatctagaaataaattcaatcatctacaaccagttagaactaaatctgggtaaaaatatgcaagttatagcattttgtacctaattagttgaagggtacgccacagaaaacattgtgctcagttcctatataaacataatagaaaccaagtaccaacaccgtatgactgattggctattttactagtgagtcctacttcatgaagacaatttataacctgcatttccaattgaggatcagattttggagttacctcatcctcatgagatcgcgaccctttgcgaataatggcggttgtttcagtatggtaaggatatggatatatccacaattcatttacagttatgccatagcctatttcctgtagactatctttatcccatgaatttctcgatttgtcatggcatgcttgtattaaattaccatgaccagaccaaatatcgtcaatccaaaggtacaaagaactacagactgaactactaactactacctatcatgagcttactacctccacaccaaatgaccatgtgccaatacatgaaaaagaaaggaaaacattcagagaaacagatgaaggaaggtttgaacatgcagttcatcatctcatttgttaggacatcacaaattcttcagaactacaaggagctccagtcaactatggttttttggtacatacagaacattttttttgctgccacattattaatggctacgtacttgaataggcctagcatgagctattgtaagtttcttcctttggttgttctcccttcatttagcgcatctgccagtggataatcgaaaatctacacattacatatccccgctccccaccctcccaaacaatacacccatagaattcccattgtttttctgaaaaaaaaaacataaaactcccattgtgaattgcaaaatccactaatcttgtgattagtttacatttgtcctatggaacatgatgtagttgttgatgacagagtataagacgcctactgccccacatgtattttattcgtcaacactattgcccacaccaccaaaaatctcggatccccacacttcctgtaagaaaaataaatgcaaaaatgtataaatgtttcagagaggtcctagctagcatcgacgcattgattatggatggcagccaatgcaatatcattctcccggactacatcaaaatccaccaaccaacgaagcatatacgtgcagcatggcagcaaaccttcccatcgatcgcctagattcacgatcctgcaatttccgggcattcccaccccgtgacagatcgaaccacgagctacgcccccaccacccccacgccattccaaagcactcatcgcccacagggcgcgcgcgaacccgggatcacctgctgccggtgcgagaggagctccgcggaatcgtcggagtcgtggtcggcgaagtcgtagtcggcgtccccgtcgtcgctcccgccgagcccggcctccccgccgctgtagaagtcgtcgtcggcggagtcgttcgcgtcgagcatgtcgtcctcggagtccatcgccgcccctcccccgccgccgccgccgacgccgcccccgctcgccgcgcgccggagccccaggagcagcgcggatcgggcggatcggagcggcgcccaccacgaggaggaagcaatcgggcccgggtggtgaggcgcccgagcggattcgggccgggggggcgaggcgagaggagggggtgggatgcgaggcgaggcgaggcgagaaaagggagaggaaggaatagggtggaaatggggagaggatcgatggattagtaggtcggattcgcttgctcggggctgcacaggaaggaagctagacacgaatgcaagctatttccctctcctttttccctctcgtctctttgcaccttttttttcgtccccttgtaatagtgttttcgtgtgtttttgttaaaaaagcttttctggcttgttttgtttagtactagctgcttttgctttcctacaaccgatggtttcctaccagctttgagtgtaagctagctggttagcctaggcttcagattcaaaagcatcgtgcacacagtatcaacgacgaaaccagctaactcgatgcgtgctaacttggctgacatatgggtcacatgactaggggggccacgtatcagccattcacaccagaagacagtatgtcagtggagtcttgatcattaaaaatctggtatgagttgagtttaatgaatatgatagaaatcacaaaatgtatactcgtagtgacaaacctaataaatttatcttaagtacactatgcataggatggatatgactattatcatatacacttgtaatacgagacatttaaagagtccttaatataatatcatatgtagttacggggctggaaatttttccaataaaccaaacaaaatgtatatgggtgatcgaagatgttattgaatgttttagtaacactaggcaccttgcaccttgtgcgcaagcacgaccacctgtctaagggcaccaatcctttgggccatcaatgatcatgcatgtgcggaatgaaacaaaatgttccatgttgcttgtaaagttgcaccaatgtacacgtagacatcaataattacgcacaaatgtgtttccaattaatgaaatactattaattatttgagtaaatacatatcttgtattaaagaaaataactcttacattattgatatggtgatgctatcctatcctatgtatattactatatagttggagcatacttaatatagttattactataaatttaacatgcattgagccatatcatccataaacaagagttgttggatcatgcacatacctttttttgtgagaaagagagtacttcattgatagttaacaaaaccttgtagtaggtaggaacatgctcccgccataacgcacaatgcttcgttctgctagccaattgtgctaactcatatgctaccttgttgcatcctctttcggtacgaggaatcttcacctttgatagcaactcctttgtacattgcacatcaacgataatatggcaccatctggatcggttctcttgatgagactttggttcattaactataaataagcaatttgtttctagcactattgacctatgaacccatttggtggctagagcttaaccttcacgacatgccaatagttccaattcttccgccacactccatgttgcatgtacttccaagatgatatataacaagaatgaatcggagctatcacagataattacgccaatacctgcattgcctaaacttacacaaaaaaacaccatcaacattaatcttagccgaaccatgttatggtaattcccaggagttgcaaccattgcccgatgtcctacttatctttgggttagaggtagtgatttgtattgcacccaaaactcctttgctttattggtcaggttcttgtcccacggtttgcacgaaagggagtcatggtagacttgtaccttgtaaaaacgttgtagacctagccatcacctcttcacctttgccatggacaacatcattacataaataccaagctctacaaaacaataaaaggatatgagttcttgagttagttggaacataacttagaagcataagcagccaatttgtcctggaaaaattaaaagaactttctcatgggatatattatttcctgcgcattgcatgtcacaaagctttcgcctttgtgcatctaaccactgcatgaaaactattcttagatttagatcacatattgtacacttactagatgccactagttgtctgttggtatttcttacgatcacagataaaatctgtaagcgcacggatataccgctgtagcacttcccctacggagtattccaagggtatcgaatccaagggaacatgtatggtcatatcttcctccggttcatccaaggacaccaagcagatgataggccaggatagagaggatttactagtgagaaatagtgtctagggaaagcttaactttaatcataatgcaatacttcatgcactggcaacccgcggttcccagatgtcgctctactacatacccgaacaggagggacttaatgatttcgagggctgtcaccacctctacacctacctcaaacatactgtgggatacgcagcaattactggataacaattacctaaacaccacgtctaagcaattaatatctactttagtgtttataactcaccaaagcaatcactatattttaacaataatcccatatgctatttaggaactaaccaagagataattctcacaagataaatctaaattactcaagcagaatattatattgaattcagagtaataaacagaataaaagaaataggagaagattaccgacaactctggaattctttcgacttcttctactctactctcttcctattctagtatataatatagtaaaatagagcttctcataattcagctcaagcttggaggtgtgtgagtaaagtgagggagtgatgtctttatatagaggtaggtataacggttggcaaagggaaaatgtccgaagtgccctccaaccgtcatcagggatgcatctgggacgtccacgccaaaccccacatccaacggtggaggtggtggttcggccgaaccagggggttcgcccgaacctgggctgggtcctcctggccaggctcttggcccatcttccccctggacctcctctatctattcttcggtgttttgggctgattctctggtatttctatgaagttcacaacccatccttgtatgaatacatatcccttctcactttagtatgattttccttccaactttaggtttcatcacccgcatacaaatacacaccaacacttgtggaatatgtgagattaagcccctttcactatgttggatgttctattatctgaactttatgtaggtgttggcggtatagaatcgacatttaatagccgccaacattgtatttgaaatttattagcttgagtaggaagattgtctcgtattaagtgccaagtgaacactggggcacatttgttgtccatatcatggactaacaatgtctactcctatcacttgcgttgttagaaggacttatctcttttagatctctttcagctagatatcatttttctcatagcgccaggcaaaaaaatctttgtaggcattgcgcaccgaaagataccatttttctcatagtgtcaggcaacaaaatcttcagacatttagggtaagcttgattttttggatttcatcagcatcgagagtgaaaattatgtgccgaatcaaagcttcatcccattccttttatctgcagccatgagttgatatacccactttaatcttgatatcttctttcttgcctgtcacctcaatccaacacccttgggattcactgatctcaccaaatccacaccttggcaccatcacttatcctccatattagtcatttttttcaataactcaaagccatatttaatgctcttccaagtaactggagatgttgaattaaaaactgtatcaatgatgtcaccagaaggatataaaaatttgagtgcaaagactcttaggaaaaactaataggcgccaggactgctgttctaataacgcttggttgaatagtttcatatcatgaaaacccattccaccttaatttttagggagcatcatgtggctccaatatcataagttcacaaccatacatatgttgaccatccattcattattaattgatagaacaaataatctacatcgaccatttcattgtctcaacttaacctagctcttcaagtgttcttaggatgatttctacgttaccgcaacaactcacaaaggtatgcactggtatgttataagattccttctataaaatatcttatgttgtatgtgcttttatggaaagaaattatatattactcatcgaagaaccctcaagtttatcctactttgccattaggcttctctcatgcggctggtcaatttttcttcatgtgttagtacatcacttatgcaattgtttttattgtcgacttacttaccttggccattatatgtcatacctacaatggcattgtggcaaatgagttatccttatgtaagcattaaacactttcaatacatcgagaacaccataggctcatagccgacgaggtcgaagattcattctttgctacacaccaaacttgttagacgccttgtctgcatggatggcctcaactaattgtcagacttataaaacagttgtgggcaaatagtgtgacagagactttcgacgtggagactgcttgaaggaagaactagagaataacaacatgagttaaaatagactagttgcattggttttttttataggtaacatatgtttggagactgatatgatacaggtgctcgggctatgttttccaagcgtttcgagcacgaagactacttgattgttccagagtattggcaagtgatttaactagatttaacaaattactagtatgtacttatgtatccacaataactttgtaactcaccacacaaatagcatgggcaaattttcaagactggtaaatagctaacaacacatatcttatatgatcacaacaaaaagaatcgtaatgagtggtgaaaaagagaaactacctccgtcctaaaatatagcaacttttagctatgaatctggacacactgttgtccagattcatagctaaaaatgcttacattttgggaccggagggagtattgaacaaatgtgaagacatgcgtttacttccaacttccaaggacaaacgcaaattgcaaaaatgggttattcaatggctctctgaaatgattggttctctagccatacctggtcatcaacaataagagatgatccaagggtattttaaaatatttcaaaaggatgtttttttttgctgcctagtgggtcctcctatcggtgcgacccgatgagcgatggtcacgagcttgcgactcggtgaggaggcatgctttgcagtgaagcccatagccactgaagctcaccagtgatgaaaaacatgagcttaaagatgattttgcatatctttgttaatggtacctctagtctctctctctctctctctctctcccttagttgtcctccagtggtaccggtagacggcaatgcgctagtactccacgaccaatggatagtgctctagggagagtgcaatgtcagaggggcataaatttgggcatggtcaccactgtgagctccatatctttgcatgcctcgaatctaataggctttgtgtcgtgggcttcgacaacttatagcaaccttgaaaacacactaggtggaaaatccaggtaagcaggttatgtagacatgttcagataagctgcaagttattaggctcataaaaagcagaaccccaaaaaaatggctatgagggcaatatttggattggtgctaatttggattctattaatattttgataacttcgacaatactttggtggaatttggattaagaccgattttttcctaggtggtagcaaatctactctgtcaaatttggtagtgcctaggttttgacactatcaacgttttggtagggcttcaaaccaaaccaacattgaatttgttactttatgccttggcctattgaatcgttcttgttgaattcatcccttcaaaattgggccttgttggatggatgaataatgtattatatgattttgtgataatatttaaatttacaaatggataaattaactactctaaagttaaaaggttgttttaggaaaaaaatattctaagcaatttttatatattttttttcaaaaaatttaccatctaggagaacataagccaattatattaagatcgtggaggaattttacataaccttacaaagccaacaagttgcaagcatgcagcctgatgggagccgagcaagacacacctgcaaaatttgttgtgactttattaggggaaagctacaattttacctaagggttgcccccgtcagtcccgtagcacgccatgtccaccagtttttttgtgatggctaacccacttagcgatctgctaacaccatcgaaggtgtttcgctatctgcaaattatcgaagtgactaggctgatggtcgtgtcgagcactgctctactttgttttgccatggcttgccatgcttgggaccaccaattattgatgatatgctatacctatggcccaattgagaaattcagttgtttaatattctcctgaacccgttgggtgtatggatattgggtgaacaagtgtgcacaaatctggcaatgcgacagtcgacacataagggatggtatggacaacttggctagacacaaggttgtgtttgtccgatgttaggtgactgccccttgttgctaagaacacgaagaactttgcatctacgtgggatttttgcttttccgaatgaatttgccacatggagccaatgtttttcccaaggaaaactatccgataagcagatgtaaatgaacactattcattcgaattggacttccgacttagttcgttggtggcattcgatttcaggtcgatatttaccgagaccaccaacaaattggggtactccaacaatgtctgcttagagagaagccgcgggtgtcggcgtgtcgcgcatccattgattattgtgcatcgttgcacccctaatctcctatcccttggaacaaaagagaatatggcagggttgtgcccaaggtaatctataattcacagggggtctaagatcaaattcaatggctctctatgaatgtctgcaactcaaagaatcaataaacatgctgcactatcattctatgatctatcagcacttcattatcagaacatgtcaacacctgttgagcttctattaactaaataatacttactcaaagaatgttccgtggtgcatagatctcgagggtctaatatcgagcacgttaggacacatcctaactccacaaatgaatgcaaatggtgagttggtgaccggaacaaggagtgggaaacgacggtgatgaagatacaagctgtgctcgagcttgacgtgtgcgctaaggctgctagggcgctggatgctgccaaccctgctcgctcgcggagtcacgagcacggccaccgcagtatgaaaagcgccgaagacgcgggcttaagcctgacgagcatggtggccaattgacgaggtgtactggaacgtggtgttttggcttggccggatgctcgatgctgcatacccaacaaatcactaatcaggccccgttcgaatctccaacaaaagttggataaacttttagataaacgtggcacgtttttcaaactattaaacggtgcgttttgtgcgaaaactttctatatgtaagttgttctaaaatatcatattaatttattttttaagtttgtaataattaaaactcaattaatcatatgttattaccatctcaattcatttttcaagtttataataattaaaactcaattaatcacacgtcattaccatctcattttacataaaacatttaattttatttcatcttcatgactcaaacaccacctcagtgttcacccgtgcagcgtgcccagctagggcaaagcagtggaactgaccgcccaggagaatgacgtacgacttcaccagcgccggtggcacgtgcaaaaggcgcaacaagcgcaacaagcgagaggccttccttcgcagccgtggcgcgggggccctgcgacgacaacgacgcggccggtttccgcagccacgagccgctcacccatccgccacgagcgcatctccgtcaacctcccacagggcaatcacagccgcggtgacgtgactcgtgagaggcggcagttgggctggatggccccccgggccacccggtcccaggcggcggcgacacctcaccgcgctgatccacacccaacggacgcggatgcttctctgacgccaacgcgcgcggccggacggaataaacagatcggataatggcggagatgtgttcatccgagcatctgaccgtccgagcccgagccacgtttcctggctctccaaggaccaaggggctttcggcgatgcggttcagcagaaacggccttcctctcgtcggtttcgaagcgcgggcggtgggcccaccactggcccacgcacatctctcccgttgcgtctagacgcttttttttttcatgtgacgaaaaatgaactaataccggataaaatgatacggctacaactcattttgcagcctatctttgttcgtcgattaatgatttctccatttgcaattatagccttttctttttttctctcgttatcagcgacttcgtaagattacggaaatacattacaactttcagtaatttatttccattaaacttcttttgccttttgaatcgagagcacaagatctactttcttttgtggaggaatttcatcgatgtcatctgtgaagtgttgctgtatggattaccatcagctttgagtccgtgtttagttccaaaataattctttaaacttctaacttttttatcacatcaaaacttttctacacacataaacttttaatttcaactagaggtgaaagtggttcggatagtttccgtccgtctggaccatttttcggattcggatagtttcggtcggaactatccggaaattcccggattcggaaacgaattcggatttttttctcggaacgaaaacgaatacagtaagggtactatctgtcggaatcgaaaaacggtcggaactatccggatttttatctgttggaatcggaatacggtcggaactatccggattttttttatatccgcagacattgagcaaatttaaaaaaaaaacgtatatatacataactttttcatacggaatcagatggagacaaactttatatcaacattgtagagctcgatgagatctacaactttcttattgattattttattatttgaggtcatttaaggagtctaaatattcattataatataccatattaatttttacaagatctcagaactgcaattcaaacaacaacatctgatggagatgtgttccatatcaaagttgtagaactcaacgggatctaccactttgtagtttataacagttgtatttgaaagcatttaaagtataaaacaaacattacaagtttcgaagatgtgaagtaaaataaataacatctccaatttatacaatggtaagtaagttatacatctagtaaaaggtcttgagaatagaaaatgataatcatatttgcatatggatctctaagagcaatagccatgaaaatcgattttcacatagggttgtgggatcgtctataaaattgacgatataaatgttggagatgttgaactaaaataataagcgatatcttttccttaatcaagaaactcaatttgaggggttttttatatactggtaaatattcgctatcgtattcgttccgtctcgtattcgctccgtatctgtattcgataatattcgatttcatttccgtatccgagttttcgattccgatttcaattcaaaaaaaataaaaacaaatatgataattccatccgttttcgatccgatttcattcctaatttcaaccaaacacgacctgagttcaggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggggtccggtcagatttggtgggagcgaagggcatgacgatcgatttgtccatgcccggaagctccgggctcctggacgacgtaggggggaagaagcacatgaatttcttcagcaaccgctacgtgctcgcgctcacgggcgccgcaggaatcggcgggttcctctttggctacgacacaggtatatggttgcatgtgtgccatttaccttccaacttttgcctgaacgtttcatcaagtgtagctgttctcgatgaatttcccctcgcagtaataagcgacatgtttttggttgctttggacttgttgggttacttcattttcatatgatgaaacattcagatggtgtttggtccaatttgatatttgacagtatgttcaggaagcctatggttagatatcattgatacaaacaaacaaagtttgaagtggaagtctgaaatgagatttatgaatagtggacttattttgttgagttcgtgctatgatctctacagtactgcataaagatagatattaattttagcagcgggatgaaatcaatgcttgcatcattcttattaatttctagcaaaatcttcgagtgtgtgtaacttcacagaattactgtactgtatacttttgccaaaaaaaaaaaagaaaagaagagaagccagtatgataaatttgtgctcttagctaagaaatttattctatcaggtgtcatatctggagcccttttgtatattcgggatgactttccagcagtcagagacaattatttcttacaggttcaatctaatctagtacaaattactggtcattaaccatatggcacgcctgcaccaactgattttggttcttccgtaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggtagacattcaacctccatttaattagcatattttattccattattcctacacattagcagttttcagtttaagttcttttaacattcaactataaacggaacaagttcaagctgaaaacattgcagttgaaatttttttattgagcttccacaaaccaggtcttgcactgccatggggaacttaactgttaactgcaactaagtatatatatgagctcgcatcatatctttaatgaaaaaataannnnnnnnnnnnnnnnnnnnnnnnnnnnnnnnnnnnnn

SEQ ID NO: 34763 - DNA, 405 bp, Oryza sativa
atccttgcatttacaaattctagtacacatcagatccaatcacatagaaatcaatcaatcatagtatcttcatttcagctcaaatcatctaaacattaaattaaatagagaaacaggattggtgcaatgaaatgcttggagagttggaggggtaattacgaagatttacagcacatgataccaggacatacggatttttcaagtacagtaaccaataggcttattacttctctactctcaagtctaatctgccgctacaacatagagccaacattaagcacactaagcagtatgccaagagggcatgatacaacatagataagtacagtgatcagtgacagtgagaggctgaagatggatatttcaacttagtgaaatgttatccaccgatgcatattctccccc

SEQ ID NO: 34764 - DNA, 2606 bp, Oryza sativa
gagcaacagtctcccacatgcgtgcactgtcagtctcaatgctcatcgttgggtcggagatgtcaaccagggtgatgctcatgttgttgcggacgatgcaaagcttcccatttaatgtaaccaacgctgcagcttcaaaggcgcgcgagctgcccaggtggtgcttgctgtccatgaattttgcccatgttcctgtgtttggatcatacaccctaagcttgcagccatctcgacaatcagatgaatagagctttccgttgaaggtaatgcttgggttccgccagccggtaaccatttcatcatcaatggttgaccataaattggatgatggtaggtagacttcactcgtcacttggcgatgggaatcaagccctttcaggaaccacttgccatcatatacaactccaatgaaaggtaccatcccattgttcatttcagcaacgcaggcccatctgttcctatttggatcataaacttcagcagacgggagtgtcctttgtattccttcacactccccaccagcaacatacaagcaattgtttatgacacaagaaccaaaaaagtgtcgtttccgtaacatatctggagctcggtgccatttgtttgtccgagcattgtaaaatacaacacgcctcatagagcccctcagaggatccttaccgccaaataagtacagatagcaaccactcagaacagcacagccaaagcctaatgcttctgaatattctgctggaactggtggaagtgacttccatagctggtgcagtgggtcaaaggcatgccaggatatctttccttcacggtcccttttaaagacataaacccattcttccgccatcccgtttctcttgcgcaaggaataatagtaattcccagataagagacggttccatcttttgcaaactatccgaagattgggatgttccactcgaggaacccgtatgagacaagcaatagcaaggtcatcaggaagaccaggcaaaagtggtgcttgagttcggctcctctccttacgagagccccttgatttgcacttgttgggtttgacatcaggttgcatacacatctttgctccaggaacaaactttctagcatcaacaacagttttcagaccagtatctaatctgcagtagcatgagacagactctacctgagaaatgcaaccatacaacatataaattagcaatcaatgtactagaaggggaaaaactgcaacgcatgaaaaccacagctcatattcactcagaatgtgcctacttgtccaccaacacatgcaacatataattttatccaccacaaaaatatcatgcagatcaaatttgctctgaaacagcaacaattttcaaatccaccacaaccctattttattatgcgagatatgacatggagaaaaatagacactaccactctaatagtccaggttacactaggttatcagatagatcaaaatatatggatacatggccctgagtaaaattaatcactaaaaaactctggagagattgtcgaacttgttttacaaagatcaacactgcaacatgatgttgttgatttataaccattttttttattttcaaaagctaatttctgtttaaatacccaaacagaagctaatgtggattagcgacatcataagatttaactgttagcacatatgggtaaaaaaaggttgcaggatagcctccataatttacaggcatgtagcagacaaaatcaacaaagcaagactatgagtggtagttgcacatcaaaagctgagatttttcttaactgcgaagtttaagattaaaaccatggtacagactaagcttaagaaaatcacaagtcaggacaaaccagctcatgacaaacaaagcattacacaaaagaaaaaattaagcacaataagcatgttaagtttgtcaagaaatggtaatggaaatgcgaagctgggttcatgatgtcagtgcccagaaaccagttgaaagctaaagatactaactaatctacctacctaagttagcagatatctgtgtgaacacttgaaacggtatggacgagcttagtgtaacagttaaagacctgaccagaacaattgcaactttccaacccaaattatcaattggccaaattcaaggccaaaatggacgcccaagctatacaactacattatggttagaaacaacaaaattctccagactcacagatactcgccgatcatttgttcatctcattacttgagcagaatacattcccaaaaaaaaatgaagaaacttaactaatcgattgcacacatacagggagcttttagagcatagcagaagcccatctgctcatgcaaactttccatatgcataaccagggataccgaaatgcggttgcgaggaacatatatgatgtccggcagaatcttatcctaacatgttgtaccagccacagattagtgctctaagatcactaccaccaccaccacaagtacctaaccccgagtagcacctgataccgcgatgaaattccacaccagcaaatctactacttgcctatgatttccgactcattttcaccgatttcccccacattccaacaacacggtaacccttccaagaaggcacacccccccccccccc

SEQ ID NO: 34765 - DNA, 1205 bp, Oryza sativa
tttcggttaagtttttctaggggtctatttgtaaaataagttttcaaaaaggaccaaaatataaaaattccaggttgcctcgtaactgttggttgatttttattatctaatgccggttagttgggataagaataaaatcttactggtttcctttcctaacaagaatcaataagagataaagtctatttttgtgtgatcggtacaaaaacacattcagattctaattagagataaagccattgagtcccaccagtgtcctatataagaaagagtagagaaaatagaggtgacaactgaactctctctaaccctaaaaccctaaatcaattcgtccgatcgattttgaaccctaaaaccctaaatcaattcgtccgatcgattttgacattggaaggggttcgtgagagtttccttttcgtcaaccggagagcgtagcagaagaggagtgaaggagaaaagcaaaggaataacatcaaaaccacataccggtttcaatggcttcattctcaagccagttagatcgcccatgtaattaagcagaggtgattatgtttagactaagactcaaagtaattaagaagattaaactccaacagtaaccaactccatttcctcgcccctgtcgtcaaccctgccaataagcaggttagcacttaggccctgtttctttcggtttgagattattataatctagattattgagtcagattactataagctagattgttataatctgtagtagaataagcggttagttgtttctttcctagattattagagcctaaattattgggtttgcaagtctaaagagagagtggggtggtatggtgggtaatttttcactcaataatctggaaaaagctcacctaaatgagcttatcagattataataagttgggctccagattataataagctacttcaataagttgtatgtttctttcagtttactcttagtaatctggattataataatcccaaactgaaagaaaaaaggccttagcaccctcggctactatgcctcgtcgttgcaccgcccagaacagcaacaggtgatggagagagatgaaggttgaagaaaatacaagagacgttggatatcaaaccaatggtgagattcaatcgactatctccttcaatcggctgataaataggaaagcccgtacaaataatcactaaatagggaagaaaactaactaaacaac

SEQ ID NO: 34766 - DNA, 16638 bp, Oryza sativa
  unsure (1)..(16638): unsure at all n locations
acaggcatatgtacaacaaaggtgcatgattgcatcccagggcctcacttaataaggccaagaaacaaacaaacaaaaaaaaaacagagaaaaaacaaaaaattacactcacctagctaactaagcaattatatgccacacttgctgctgatggtgattaaaagctccaggttgatccaccgggttaactaataattaattaaaccacccaagctaatcactaattaggagacagtaattaattaaaaaaacattctgtccgtgacgtcacttcttcttggcgatagcgccgccgccgccgtcgtagcggcggctgctgctgccgccgccgccgccgctcctcacctcctccggcgcgatgaacgactccgggcagaggccggcgacgttgaaggcgacgtcgtcgatggtccacgcctcctccatccgcgtgacggcgcgggcggcgccgacgtcggcgccgaagcgggcgaggtgggcgacggaggtgcccgcgtgcgccaccacggcgccgtcggcggcgcggtagtcgccgaggcgggaggagacggtggtctcccagtacatcgccggcgcgccgggggtctggatgcgggtgagctgcgagtcgtcgaggcgggcgaggaggccgctccgctggctgaagtagcccgtcatgccgtgccggatcacctccgccgcgccgtcgccccaggcggagagcaccgacggcgccacgtcgagccgcagcgcgaagcagtcctcgccgtcgacggccttctcgccgacgtgctccgccgccgagaacaccgacgcgatcgtcaccgggtccagcccctgcacatgcacagccatgcacacatgtacgatcgtcagcaccgacacttcatcggcatgcacacgtggacgcttctcattggtgcagatgcattgtctatattctactcaatccatcctaaaatataagtaattatgcttcagattcatttcagattcatagtaataagatatttcattcaaccaaaatctttaggacactgacgtgtctacgatttttctatgggtggtccaaattatatatatttttcaaataacctaaatataacaaagttaaaagtataaatggatcaaatgtacattataatatattaaatatgagctctttttttttctcaaaagttttcttttcacatatatgtatatttatgcattgggctaggatttttttagtggtcgtatgaccaccgggatcatcctctagatccgcttatgctttaggagggagagagtatccgtttcatattattataagatcttttagttttattccaaagtcaaattttcttactttcaccaaaattatagaaaatgcactaattgttcaccattgcattgcattattttgctcctatttttcctgtagttttaaaattttgttaggtaaactcattgatggggcatcaattttgtttcataattaaagatataaaggctcatggcatggcctttttattagacatctagacagattcattactgtggtacagtgttcatataggatgccattgagccctatgaggatgaaaggtgcttggtagtagcatctttttggagtcctatgtcctagaactgttgttattgagaaaaggttgatgtccttatgctgttccaaggacatctctgctctcttatggatgtaaatatgagccataaattcagaggcaagaacatgcaggtgcagtgtattttattgtgccatgggagacaaaaaagaatgctgtgtgaaatagaaagccagtacacttgtatgttgtatcaaacacatcatgcccaaagctcctctcttttcacagtacaaaaacagctaagacactctaggatgcccactgatatctgttcagcagtattcactatagtacagagcatccagcataggatactgttgagagtaacccccatccagtttcatttcacacacttttgccagagagatttggtgaagtttggtgtgttggcaattatacagcatgaccagcatgcagtgctgtgtgattatgtactaaattagtactaacctgacatggggactatgatgtgttccatctccattgttgatctgggtcagctaatcaattgccagaaaggtacatctcttaatgatacaccatgcatgtaaatgatcccagttattctgatagtctgattgggtttcagaaagactaagcaaactgtttcagtgtctataaggaaaataacatggatgcagactctcactcaaagtggtttaacatgatgtcccatgttcaacagaagcttaactttctttgccatgctgatgtgaggcagcttacaaaaagtctaaatcaattgacctaatagaccaaattggtgtaacactcaggacagatacacctacttagatacgcactgctgcatcctaaaaatatttaaaactatttgataacatgaagattttcagaaatcagaatgcatgagtggcagtgcatccaattttcctactgccaagctgttaaagctgtactagccaatcatagtagctagagatttcaaaggacaggtcagtggcctaaccataatcataatccatgctcttttatttggtcctcctatgaggaccggataaaatggtttttcaactagctatctcagcagttgctagaatatccagatatatattaaaaacagtactagtcgatcggctaatggtatgttcagatatcttggttaactttcaccaaagaagaatgatactactacttggcactagagtatcatcaatttcagacacagatttatactagcctcagtttgccaaattgctcaagatatatgcctcaaaagccaatcttgtaaacagacgagtgctacttagaaggaagcaaagtctgcggactctgcatcctcacagaaagtttttttcaagagtatctcaagagtgatctgaatttttttttcaggaaatgaggggcagcagcctcagatcccgaggttgaaacagtggaaatgaaagaatgccatatctgcacctttattttcagccaaagattcttctttcacaaatgctccccaattcttcaccctctttttttgcgaaataatactcccacacacccagcacacaaattaaagcacaaaaggcaaaggcgaattcagcaaagcgatccacaaaaagaaaagcagcgatttctacgtacacgctcatacacctctcacattgcttttgggtagcttcccagtgtactccgacatacataaatttcagcttaaatttttgtctagagatacttgttatttctcattcaaaatggtttaaatgttttaaatatatatacatgctcacattttttaggataaaggaagaaacttttattgttgaacttggacaattatatcaaggcaacatctacataactaagcatacagccaaacctattcgcatcgttctccgaaaaagagtttacatcattgataaaggaataggtttccaaagataagatcacctaatgtatgtctgtatgtgcttgcaaaattatcaggtattttggtcactttttttataaaaaaaatgacatgtttttttttttgacacattggtaatttctattcgccattcgaacaaaggccccatgtatatatttgaagaatacacatgaagtactcctatttattttcttatgaattcctttgtacgttacgtatgcttgtacgtacaaaatgtatgcgtacgatttttttttttcgttttgatttctttcggtttagacatttataagtctagattgcaatgcaaactaatgcaaaactaattatttttttgcctaaactgaattttaatcggattagaggaggagctaatcagaatggccaaatggcagggacatgcggggtgccaacctggagggctcgccggagaggtctcgcgccgccgccgcgcgcggcgtgggcgtcgagccagggcgtgcggcgccacgcgacgcggccgtcgcagccggcggcgacggcgtgcccggccacggccatctcgacgagccacatgtccggcacgagctgccacactacgaagcacccctcgtgcccgcctccgccgccgccgccgatgccgatgccgccgccgggctccggcgccatggccatccgcaccctccccgccgcgtacatgctcttcgccgcgccctcgatcttggcgcaccccgtcgtcgcccggaactgctcgaggatgtactgcgccgacgacgccacctgcacgacacgacacacacgcacgacgtcgtgagcgcgcgtagcacgaagaggaagtccggcagagcgagacgcggcggcggcgacggcgagacgtacgttgcgcgggtggcgcgggaggacggtgacgggggagagcgggcaggcgaggacggagaggagcacgcggaggtcgggggaggggcgtacggctccgccggcgacgccacgccttcgccacctcccccaccgaaagaaacccgagcgggatgcgcgcccgcgcccagcggtggagcgccgcgtgcaggccggtcttccaccgcgcccgcgctgcttcctccccgccccccggctcctccgccagcgtggccagctgcggcgccatggacgaacaccttcgttgcctcagctcagctcagctcatcacttgtgttaaaaaggagggaagagaagagacaagggggagtttgacagtgtctggatggtgggcccggggaaggttgggttgtggggcccactggcagggagggtgtgactgtatgcctggaaggtggggcccagggctttgggagagctttgaagggaggcaagaggattgagggggtcgggggagggtctaaatcttgggtgtgagaaattggagctattttagcactaaatgctggtatgggataaaacattttgatcatgttttttttcctactatttcaacatcgattttttacggctaactattctttggtatgtcatgtacctgctgaaaacaaagcgcttatagcaagttcgtcaatctattgatatgctggcccaatcttttagagaggcttataagggtaggaataggatgtatgaaagtatgtttgtggggtgagtgtgcatgtatttatataaacgtttgtgtttgtgcttttttttaaaaaaaaagaaaatatacaccagaaaagaatttcttaataatttcatattatttatgtatgcaaattcaatgttcaaagttttaatgacagtgcatgtttgcggataggggtaaaaatatttttaaacacaaaaataaaaacagtgtacaatctaagacaagggagaagcctaagaagaacagtggatttgacagatcaaaactaattaagcatgaagtccatgaagaataatgagcaacatgacatttcggtttagcaacaagaacttgctgttggtgtggtaacccatcctggggtgatctgatggccacctgacctggagattacatattgccaaatcgttgatgattcctctcaaatcatggcattttcagaatgatctcatcttctgaattgaaggccccatcacgattcccaactactgcattgcattacatggcatttcagggccttttatttttctttttattcagatgatggcgacactgcaactctttttcgtagctcatgtgtagtgtatgtgagatggagaatgaagaggagggtattgagggtgacatggcaaccagatgtgtaataccttacctactactagtattgtttcctctgtatttagcatgcattggtagggttttttttttgtactggagaagaagaatccaagctttgatctttttgcattgtgatatttcagaacagtattgaaaaaaaagacttttagaaccttgagctttcttttcttgtttttggaaccaacttgagccatggagatcaagacctgaagatgaaaagaatgacaacttaccatctgagttttgagctataggtgttgaagattgatcttgtcaggaaaagaactttcagagttacattccaggagttagtgtaaatgttaagcttctgtaaaacaattagctgtcttatttaacagctgagttatgaccttagtaacaggatttactgccatgttaattcatgggtcctcctgctctgctatgttagtagtatatatctatgactgcttcaagacccttttctgtggcatttatcatgatcctgtggacctcaagtacctcactggcaagtcaatccagacctttatttccccagcttttctggttcccaatgattttaagctatttgatccgtgcactgatcacatctgcatagttatgtcagtattaaaaaccatggcttcactgttgctgaacccctgatgcatactcgttcgtttcaaaatatagctatttcttaaaaaaaaaaattcacggagattaacaagataggtaaaaagactaggttatcctttattaattatcccagatggtgggatgtgggtgggggttatggaaatgaatagtattttgaatatttcatcactataaatacctattagtagtttataagtagttatattttaaaacaaaatttgaacgctagaatatattttaggaccgagtgagtgagtatataatagctgcatgctttactgctggtcatagtgtgccccagcaattatcatttaactgatggatgcctttattttgttcagtcacagaactctcatggacttttttttttctgtattggtattcttgctgtatatccatccaattcaatacggaacaagggtcaagattaggatagaatactttctgattcattacaggaagaagaagaattaaaaaaagactagtagttgtagcttgcaggcttatccaggaaggatttaggagacagggatattttcaactacttgcattgcatactaagcaaagagagagaatatcagtttaagggttactgtcacaactgatggctgggttgctgtcacttgagccctctcatgtactgaaatgaagccacatggccaaactgttaatgaggttgtttttcatatgatatgatttcttttataggttcagaactatgataacagtcttacaggtggctgtcattttcattatgcaaccagtgtttgttggcaggagaataaaagtcctagattgcattgaacacactaatccatttacttgagaaatgtgaatttctgaaaaaaaaatgatatgcattcagtctcactgaacagaagaagaatttatatatagatgatcaaatcaagcatctattcttatgttcataatagcctcatcatcaggatagcactgtagttggatttctctgttatcatcactttgacctgacattgtaacagtacacttccaaatttgagtgtcagacatctctttccctgatgctattttaagctggaaaaattattttggctaaacctccaaaagcatctgttggagctgacatgataagccacttctttttatgagcattgccatgctaatgaatgaattaattgttcctaaatttgtgacctcctgcatcgatttattttgtgtagttatgatgtgccactttcggttattcactctctcaagcaacccatagctgtctaattgctgtccttgaattaacctctggaaaaaaaaggacaaggattagagacagcattagaaaggtagtctctgcttcttctgaaaagacaaaggaaagggacaatactaactctgtagaattactgcttccatgcttgtctgatcatggccactcattttgtttaacttctaagcaattatgcaagctaatgttttcagactcaatgtcacattttattttccttgacaaaggaaagtagaaatttttcacctgctgaaacaacctttttagaacaggcaggatgtaaaatctacatattttggagatatctttacttgcaaaaagtccaatcaacaaatgtcctagttgtgaaaaagaatagataaactcttcagcagaattggaagctgggatgctgacctggaaagagtttgagacaatttcactagggaatatttccttcaaaaaagaatttgagacttatttccttatataacttgttcaatgatcaagtactacaaattagacaagaaaaaataaataaatagctacaaagttttaagaggtcatctttgtgtaggcctcaaattatggcccaacaggtaacaagcggggtgcctgagaagacttgaaaattgaaacttatttaatgggctgaggtgagatccaagcccaactcaatttcacacaatttgatgtagccaagagatgaaattgtcagcccagtaaccatagctgaaaaagatgtgttgtttggatggcacaaacaaagttgaacaaatttatgcagcatggattttttttcccatttagttaagcctaaataatcaatccaccaaagctgaaaccacaaactgcaatctgaactagtcatttcagaaaaaacagtaatctaacatgcactctgaacctagtcacttcaaatcaaagggttaacatcttggcccttttgttagctcgcccaagctgaagttctaatctaacatggtaatgacacctgagttttgttagggcctgtacatattggagaattatcactgttcctgtgaaatacctgtcttcttgcaggcagcattttcttcagggcagggattcagtccatccctatgaaggtcgaactgacacatatcatgagtcatgaccgagatgtgttccagttcatttttatcttaatgaatgaatggattatggttatctgattttgtggtaatattttagaggaaaaaacgaataaattaactattgctgtttaaaaaggttgttataattaaaatactattctatgaaacgtaacttatatatagaacttctgaaaaatcaaaccatttaaaactttggaaaacatgctcatcataatctatctagtatatgtatatatggccacctatttttatgtcaagctaactccatgcagcatccgagccaagagctctgagacggtgagacctgcaggaccaagggtagctaaaataagcgaactgagcgtagctggtaaggtactttgtgttggctgcttactcctagacttatgtggatgtttgtatttacggataattattttttcagtggtaagtgacgtacctgttaacagtgagacacgtgctaattttgtctatcttaatatatgttggcccggttttcgaatgtgctcatagagataaggtatgtgtttcgcaaaaaaaatatatatatattaggaaagttatttgtgccatcgtaaccaactccagcaagtcttgtaaacaaacccctcaaacaatttttagggctagggaaaaaatgaaatcgagcctagagctctaaaatcggaaagcccctggcgctatatcctaccgtacatacccccaattcccaaggctctagaccacagcccccattctccgtttattcacgcgggaggaaatttatggtctcgtgcctcccactcttcttcaccccatgcgagagccaccacactgtaggccctatctagccagtggcgtccctggcttgccccgtgactccgctgccccgagcttggccaccgatgcctgctccgattgaggctgctgcctccctgccctactttagtggccacttcaccacccctccttttatttgtccgtgcgccaccaaaaaaatggattgggtgtaccgctgatggatctggagatccccatgccatgatgccagtcctcaccttttggatgtccctaagcacccctaacgtcacaccatcatctccattcccgagttggaaccctagcagaaaccagaatatcgtgttgccacctcttgcacttgatgacctcggtgatggcgtaccacgctcctcacccagaacccctaccttctccatatggcactgtcctagcaatcgctcatcgttcgacaattccgcttcgctgccatgcgtatcgtggttaccgtgccagcatcacataacgtgcatgtcacgctacttggacttgtgtcgctgacgtggggatcctaggaaataagggtggtttcttggatttggtggagtcactttggccctcaagaaattggggtagacccctatttatcttttaggactgtaaaatagggctatttatggagattcttagagttgccaaatcacatatactctctctctctccatgatgtcaagaaactaataggaaataggtaaggggtccataatgattccataaagccacagggcaggcaccgaaatggggcttatattagcagggactaagaaataaacgttgtctactgaaattggatactgaaattggatgcctcttagaggtcttaggaaatagggacggccctcatttagtatttggggctacaaaatactagtgactattgctgaatatgctcatattattatatcgctctctcttttcaccatcatctcaagaaactagtaggagctagataacggatcataaatgatgaattcataaatccacaaaaggcaggcaccgaaatggagcctatatggctatatattactgcccatggctcaccatcacaatcaccagccagtcaggcacagtcatcagccgtgtagatgaaatggagagtatgcaaatcaccagtcgccctcatagatcacacccatgtctcatctcatcctcatcatcttgcagatgcaaatgtatctagcatcgatcctagctagctaattaacctaatcttcctccccaatgaacttgcacacactgcagtagcatcagtgatcagtgatcgatcagcttctgctgggcccctgcatatgtctgtctttgaggtagccaacgcggttacacttttactagcaccaacaacccaagaacgaactgcgaccggatgcttcgtttcagtgctagctattagcttcactcgatcgtcgtccagccagctgtggctagctcactctcacttgatcatcaggagtcaatattactcaaccttcagttcagcgtgtgcaggtaggtagggtcgatcagcctagctataacgatgtggcatgcattattaggcctcgtttagttcccaaaacaaacatttttcacccatcacatcgagtgtttggacatatacatgaaatattaaatgtggaaaaaaaataattacacagtttgcgtgtaaattgtaagtttgcgtgtaaattgtaagatgaatcttttaagcttaattgtgccatgatttgacaatatggtgctacagtaaatgtttgctaatgatagattaattaggcttaataaattttaattttataacggaatctgtaatttgttttgttattaaataatatattttatacttcaaattccgatgtgataccccaaaacaaaaacttttgggaactaaaccgggccttattcatcggtgatcgatgcaatgcaagatctctagcttgatcacccccactacccaactaataatgcatttcgatttgatggttccctatatggacgatggattatctgattttgcgataatatttgagggtgcaaataaccaagttaacaattatagagttgaaaagttgttcttaaatgctattctacgaaacttacacatagacaaactttttgcagaaatcaaactattttagagagcttgaaaaacgtaccgtacgtgataatttatagtaatctgtaaaagtaaaagaatgtatccctcttcgctacaccttattcacatcttgtacaaacaaagctataaactgcataataacaaaaattctagtacatgtgtgtcaacatataggatatcccatctgttcaggaatatttgtctgttttgaacgagagtagatggactttgacaattatccctttaagcaacttctaagaaaataggtttaaatgtaatacgttggtaaagaactttaaattacgaatatattgatacaactttgctgctaaatttctctattatttaaaagaaattattttttgttaaaactagacaactcatattcgaacaattattttaaaagtaaagtgtaaatcttttttggatacggcacagtttaggccaaagataggtgacagatgcaacagaaaatactttttaggatgagatttttgcgcttctactcggagtgatccaaaagccactaagtacagatccttccatctgtgacggcccataacaagactggaatttgcgggccgtcacaaggaagtaatctcaatcgggccgaagtttcgcccgattgagatatggtcgcacagccatggtatatcggcataaaactaaagctcatcatggatgacacttatctgtgacaggctatagttgagacccgattgagacgagggttccatatctcaatcgggccctaaaagaagcccgtcacagatgagggtcatctgtgacgggctccaactagaggcccgattgagataagtttattgcccgtcacagatgacactcttttttgacggcattttattaaggcccgatagagattacttgtatgctcgtcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcatgtcttacttttgcaatactgatcttataatatgtgcctctaatttgttttttttttgtagcaattgatcgaagttggatgtatgccaaaaatttgaaacgtcattctacgaagtaccgaaagggcgtaataaattttatgaatgccgcggaggaggatcggataagaagaaacagtgattacatgtgttgtccatgtgcagattgcaagaacgagaatatgtttgatagcggagaggacgtacacggacatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacctagcccagaatgagagagatggaatgaaattcagcaggttggtaagtgattccgagacgcctttgtacgctggatgcaaagcaaaacacactaaattgtcagttaccttggacctaatgaagctgaaggcaagtagtggatggacagacaagagtttcacagatcttttaggaattttgaaggctatgcttcctgttgagaacacattgcccgagacgacatacgaagcaaagcaagttctgtgtccattggggttagaggtccgtagaattcacgcttgtcccaatgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcagtgacatgagtagtactcacagcacttggccagtttttattgcgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttctgtaccattaatgactaccctgcactcggtaatctttccagaaaaactataaaaggaaagaaggcatgctccgattgcaaggaacatacacgaagccggtggttgaagaaatcacgaaagatggtatacatgggtcaccgaaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgttcgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccatacgagatgcagagacaggtaaagtgtacctcccttcagcctgccacacactgtcgaaggataagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcatcacacgatccaacgtctgtgcgccttcttcaatgcaattggacagaaggttatagatccagaagatctagatgggctgcagactgatattgtgaataccctctgtcaccttgagatgtttttcccactgtctttctttaatataatggttcatctccctgttcatctggtgaagcaaacaaaactatgtggcccggcttttctaagggaaatgtggccgtttgaaaggtacatgggagttctgaagtcgtacgttcgtaacagagctcaacccgaggggagcatcattgaaggttacacgaccgaggaggctattgagttccgtgttaattacatgtctgatgccgatcatatcggagttccagcgtctcgtcacgagggaaggttgtcgggtgttggcacaatcggaaggaaaagaattaggcccgatcaagcatcgtacgcgcaggctcattacgctatgctccaacatatggcagaagttggcccatactttgaggagcacctagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccgtcttggaccatagacacatggcaaggatacgatataaatggatacacattttacaccgtcaaacaagatgacaaaagcacagtgcaaaacagcggtgtccgtatagatgcattccaggatcaagttgggtcaaacacatactacggccacattgaggagatctgggagctaaactacgtcaagtttaaggttcctttgttccgctgccgttgggtgaatctacgcactggtgtcaaagccgacaaggaaggtttcactttagtagatctatctaaggtcggatacgccgatgaaccatttgtacttgcgaaacaggtcgagcagatattctacataaaagacccttcaaacaagaagatgcacatcgtgagggatggaaagtgccgaattgtaggagttgacaacgtcgtcgatgaagaagaatacaaccataatcttcatgtaagacctcacattgaccttgacgatgatccccaagagcctgtggcatgtgctcgttcagatcataccgaaggcacaaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttgaccatatttcaatttgaaatcatttagtatttacaaatgctgttaattagatttgtcatattgtcgaaatcaatttcaagctgttgggaaaaaaattatatagaataatgaccaaaataaaaatagtagatcttgaaaggctctacaactttgttgttgaccatatttccatttgaaatcttttactatccgaaaatgtattatgactaataaaatgaattattacacagctgctatatattttgcactcataacaaatgaaagatggaaaatgagtcatcggtgatgggccttagtttacggccgatagagattaatctatctcaatcgggctttgccgtagggcccgtcacggatgactcatcggcgacgggctccatactaatgcccgattgagatgacagccgngcccatcacggatgactca

SEQ ID NO: 34767 - DNA, 12138 bp, Oryza sativa
tgactattttttcatttcccagataagtctctatatttgtgagcacaaaatatagagctgctgcataataatctattttatcagtcataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatgtaaacagcatttataaatattacatgactttaaatgggaaagccataaacagctaacttgtacagctaatcaagatctacaacttttattttggtcacttcttcatctgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggatcaactttgttgttgaccatatttccatttgaaatcatttagtatttacaaatgttgattatatttgtcatattgtcaaaatcaatttcaagctgttagaaacaaagttatatagataaatgaccgaaataaaagttgtagatcttgataacctctacaattttgttgttgaccatatttcgatttgaaatcatttactatccgaaagtgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcccgtcacagatgagtcatccgtgacgggcctgaatgtcatctcaatcggacattagtatggagcccgtcaccgatgagtcatctgtgacgggctctacgacaaagcccgattgagatgactcatcactctaatataactagggtttctcagatcggatcgaaaatttttctaagtcccgctacagtttcccacctccttagaaccctagcgccaccgtcatcctccctcgccaagcccgccaccgtcgccaccgagcccgccgccgccgcagtcgtcctccctcgccaagcctgccgccgtcaccaccgagcctcctcggccctccattcggacctccaccgccgagcctcctcaccgacgaccccccccccccgagcccgccgccgccgccaccgaggctttacaccgaccggaccggtgttggccttcctcgtcgtcgccgctcgcgtcctcaccgacccatgtcgccgacccccaccgagcatgacgccgcccgcccggtgccgacctgcccaatcggcgtctccaccgaccggcgccgccctccaccgagcccgggcgccgccgccaccgagccccaccggccatcctcaggtgagtcctccatcgcgccgccctctgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtggttcatttaactttatttatatgcaatgcggttcatgttgggatgaaatgtggtttatttatgttgggatgaaatgtggtttattcatgttgggatgaaatgtggtttattcatgttgggatgaaatgtggtttatttatgttgggatgaaatgtggtgcattaatgaaattattgtgaaatatggttaatagattgtaatagattgtagcactcaattgtgttttttttgtttttttggaaaaaagtagacaatgtctcagcaaggcgaaccaatgtcgacgacaactagtgggtcctcaagggcacgtactcctaggacagggaacaaaattcctaaggaacggttccgcataacaacggtggacgccgtagggttgccgacatctccaaggaaaatattgagccgatttatgtctatctgcggggtcatagggaggcagaaattcagtattctgcaagacgacttcaagctcgtgccggccgcagagaaggacattgcttggctaacgttcaaggagagctttgattatcctgcggagcatgaggaccgtctcaggcgggctgctttcaaggttatgggcactgcttggaagaacttcaagactaagctagtcagcgagttcgtctacaacccggcaaatccagatccaagagagaaatttccttggatcacggaacaggtctgggaggaattccatgcgaagaagtcgagccccgagtccagagctagaagcgaggcatatcgcttgctccagaccaggaaccagcatccgcaccggcttggtaccgccggatatgccggtaaggaagaggaatggcagcgtgaggatgaagaagcggaggaatcgtgcaccggcttggtaccgctcgtgtttggcgatatcccacaccctcgggctaggaactgggccagggctaggtaccagaaacatgatgatggcacgatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaaacgttgggcaacaaggaacaccgtggacggacacggggcgttgggtcttctgttctctggaaatatggatttccagactacgcgtggcagtacaagaagcggacttccaacaaggtggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaacacagcagttgcgcatcaactgagttggtggaaaatccaacatcggtcgacatcgccgtcgaccacataacggtaaccgtgaacttactcaatacatgaaagatgtaacgaatccatatgatatataatattctaaaaaaattgattaatctatcgcaggaaccaacgagctgcacctcacagttagggtgatgccgaccttcactgttccagcagccgagggacttgcgtacaagccgaccccagagacaagagtgcatggagcgcaactcagggccgactgtgcaaaagttcaagtcgacttggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagactgtcacgccccgaactagtcccgagcggaactagcccgtgacgctccaaattaacctgttaatcgataccaatcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcacgacttgggaactaggccgaaaccctaaaactcatcgtagccggcttgctcctggaagaactcctcgtcagcgggatccgcttcatcttcttcagcaactaggggggattatttatatagagcaagggtgagtacgggagtactcagcaagccatgggaaataagtgtttaatgcaggcttcaaagaaaggctgttgtttttgcaattgattttatttgaactcttttctgaaacaactaagtgagtgcttctcaaacgacacggatgagatagtgcgtctcgtccggtcggagtatgtgcaatgtatcagtcttttgaattgatcaagattggcacccggccaacagctttcaaacggccacccgggcctggctgatcccattagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggtacactttacccacacgacattactaacccggatcatccagcccgtgcagaacggccacgactagagaccttaaggctttcatgacaaggcatttcgaaagccgacacaggttcaccatatgccaacgagagggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatgtgttcggatgaaattccaaggaaacggtccttaagtgcaagagcgggaaaccgtacacccgatacgttccccggtccgcgattttggaaattcatttagttcgcaagcaccgactcaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccaccaatctgccttgcagacaggacaagcagattaagtgcgatcctatcaatgcataatatttttcaagcaacataattaagttcaaatataggctcaagatgttcaaaggtggcttgcctcgctcgagatcttgagtttgatcctcgaaatcctcgcactgcgggtcttcgagctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcacggcccgagagaaaggggcggctcggctgagcttaatgggccggccggcccaagaaggcggcccaaggcgcgcgcgcgggcggggaggggagagagaaagccggtgggccgggtccatcccgcgtggtcccgggtgggacccgcttgtcggcgactcggctcaccgtgagcgaggtgcacgcggggcatgctagggtttggggagggaggcgcggcgcatgcgcgcggttcgcggaggacacggtgcggcgggcccacgcgcagcctcacggctcgcggtggaccgcgcgcgcgagggggcggagggaagcagcggaccggggtctgcttgacccggtcgcggccgaggtggcgccgacgtggcgcctacgtggctgccacgcgggccggcgggaggtagacgatgacgccggccggaacggacggcggacgacggcggcgagcggcggagcgaaccatggcaatacaggcgaagacgagcacaccgggatgttgcacaggacgaggggagacgagccaatggctcggattcgccgggggacgctcgacggcggcggattgcggcggcggcaactggcggcgggaggagggggaaacggcgatgaggttacgatgggccgattcccggcggcgagagcatctacgcggctacgggaacccaccccttgcgccggattaggaggaatcgcatcgagggaggccggcgacgagaggcgctttcgagctcgggcggcgacggcggcgagcacacggcgagcgatggcagcagtcggggcggcgtcggctagctacggggaggctacacatgctactaccgaaaactaaggggaagagatggattgaggagggagaacggggagatgcactaccgtgcggacggggagcagtgacgacgggccgacggcacgggagcgatctctccggcctcgggccggggaagaggaaggagagggtgcgtccggagtccccttccgcgtcctaacgcgcaccgactccttcggcacacgtgacggcggcggtcggcgatcggcgagacaaaggggacggcaatggcgcgggcgaaaaacggggaagattgggaggggaaaaggaagggagggcgcctgggtttatagggtggcgatgtcggtttggaaaccgaccttgggcggtcaagggagggagctcgcgctcggcggtcgcggccaaagcggcgacagggggggaaggatgacgccggcgggagggaaaagggaaaaagggggagagaaagggggcttgcctccttgccactttggggaaaaggaggagggagagggggcgatgcggcagagggggggctcagcctccgtcccttggaagccagcgcgcggcggtggcggggctgggttgatgacgacggcgatgacggcggaccggtttggagtggagcggcgacacgggcggcagacgaggggcaggtgcggcaggagctgacggcggcggcgactggccggtcggccaccacggcgcgcgcgcatgcgggcggctcggcgatttgggcggcatcgacgggaatggcagcgagagcgggagggagggctcggcgcggctcacggcagagcagggagagagagagagagagagagagagagagccggggagggagggggagatgggccgagagagattcggcccatcgaacccgagggaggcaaaatagacttttgtggagggatttgatttgggaaggatttggattcgggattgaactcgacgatagatcggggatttgagatctgagatggcacggacactagacaacaagcaaagaaacagatttcgcaactagggtttttaagagatagttttcccgctaggcaccacgacggaacgggcgctacagagacccgcctctgctccttcagcccctcctgctcaagatcgtcatgcacaatcttacgatgtgcagttgcagtacgacacggattttggggaggatcgaacggaggccgacagcaaggcgattcatgaacccccaccgatgaagaagagcaggaaagcacactcttcccctcagagaattactctcgataaacccgaagcaaaggggagaggaaggggaggaaaggtgcaggcctcgcttctagctccaagaaagctagatctaggcaaggaccaggaagagactaagggcaaagaggtcaagaagaaatatgtcgctccacaggagttccaactaggcatgccattggttggagatgacgtgcttgccgctatgggcaccgcttgcaaggaccttcacttatactacatggagaaatctaacgccaggaagccaagtaaagctaccgatatccttggacagcacgatggaaagccattccttggtccaataaattatatcgtggtcgacttcaaggatcttttcgacctctacaggctctgagcggtggacacaagcctccttaagtgctactccttgtaagtattgtcgcccaactcattctggtaataacaatcggtttaacttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattagaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtattgagaaaaggtgaagactttggctgagtttgaggtcagtggtctcaattgtgatagactaactacattttagtacttatatatgatcgatcaactaatctggaattatgacaatgtagggcacaataaccaagtctctgactaccagctttgaggaggttcgcgaggagataaccagcttcatcctccgcgaaataattaaccccaaaggaatgtttaggcttaaactaaaatgatgaacaatgttgaacttctatgtttaggcaatgatgaacacttattatgcaactgtgatgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagccaaaaaacaaaatttattttttttgtggattatagtcatctgtgacggaccataactaaatgcccgattgagatgaggtcatctgtgacgggctctagcttaggcccgattgaggtcagcagtcatctgtgacgggctctagtttaggcccgattgaggtcagcagtcatctgtgacgggctctagtttaggtccgattgaggtcagcagtcatctgtgacgggctctagtttaggcccgattgaggtcatcagtcatctatgacaggctatagtttaggcccgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagttaactcttcacatcagtgacttctagcctgtgacggacgctgtgcccgattgagatggggcttaccgcccgattgagatgagggtatccgttctagtgagccaaaattgagtgatggtgaaaacaatgaacattaaacctataaatcagttttaaaattcagaattagctgcaacttgtaagcctcaggttaaacaagccctcaagttttataaacaatagatcagatgaggaagaaagctccgaagttaattattaagttaaagtagatcttagcatcacaaaaaattgaggcttttggaatacatgttaggaaaaacgtagagacatttaaaaaaaaacaagaattgaaatcatatccaagacgttgaactccttgtttatttttccatgaaatcgagctataggaacgtgcaatcctacaactttttttcctttcctttcccacgagctactgggatcagtaggaaaattctttcgaaagttgaatcctataaaaaaatttatgccaatcctctattcacttgaggctccgtggacagaagatatatactcccttcgattgcataggtaagggcatccacaatgtgcatttaaagtgggtagtaagcaataaaatactactactaacaggttgtatatattgtaagagtagtaagtaactaataccaggtaatatgcttactacctagtcataaggaataaacaaataatttctctcatctttctctcatggctagtgatggtggggtccagcttactacccacttttgttctttcaccattgtggctacaacaacagctaatacccactgatgcagggctcactcttatacacaaagtaggtagtaaacattggtgatgccctaagtcgtattaggagtttaggacttatacacctgtagatgcaagcatacagtacagaaacgacacagctggtgattctcagcctaatagctcgcttgcacgtgtgtcggtgcctgtacggagaggctgtgctgttccatcgtacgtacggaaacgtactgccggtgccagctcgactaggcccagtttgaagattattcactattactggtacattattatggccgattggcgattatctatctatctaattatgtggataaattaaattcttttttttagtaatggaatagaatccgcggcctttgcttaacgtgttacagccaattattataacaattcatccaaacacaaacatacctcaacaagtcataaagaacacgctttaataaacagaagcacacaccaactcctaaacaccaacacaagagcaagaccacattattattgaatcctatttttaacctccatccaaagttggcgagaaactgcatagctgttgactcaagattataacatgcagctttaagaaaatattttagaaaatggtaacaaacagttaagaaaaatggtttaaacaatactccctttgtccctaataaaatcaaaccctagaatctcaagaaactattaaggaaagaaacaaaaaaccaaattacccttaattaatgtaaaatttgtattggttgatgagcaggtgaggggtattgaagtaataaaatttctcgatttgcatattagtggcaggtaagaaggtaggagttggtttattttgggacaaatcaaaccgtagaagttggtttattttgggacagagggagtatagtagaagatttttttagggatgctatataacgcgggatgataccagttaggtatcaagtccggtattgggtgatacctattaggtatcaagtgattctaccacgtttcaggtgatacttgcgaggtatcaggtgatacctatcagttatcatgcaattcttgccacatagaaggtgatacttgtgaggtatcaggtgatacctatcaggtattaggcgatacctatcaggtgatacttgcgatgtatcattaggtatcacgcgttacatacctgacatcgacgccgacgaccactgccgccccagcgccccttcctccctagctccggccaccgccgccgatccctcttccgccggttccggcgccgcaccaccgccaccccctccctcccccggatccggttccggccaccgtcgctgctcccttcactggctccggccaccgtcgccgctccctcccctgtctcaggccaccggcgcgctccctccctcggctcgggccaccgccgccgttctctccctcggctccggcaaccaccaccgccctcttcctagactctctggctccggccaccgccgccgccccatccccctactctctagctccagccactggcgcctcagctccggccactgccgtcgctctctccctcagctccggctaccaccaccgccccctcccccagctctctggcttcggccaccgccgccactctccccccgccaccggctcggccattgtgccacgtgctcttgcggctgatggaggtgaaggggaagctatcctgttggggcaacggtatcctgtccccttgcatttcagtttttttttaagaaaacgtacttttagaaaaaaagagtaaataaaccgtggtaataatctagtgaagtggtcgaaaacaacaccttaattagtagctagccg

SEQ ID NO: 34768 - DNA, 4253 bp, Oryza sativa
caccttctctgtatttttcaactcaaacaagatcgagttgtaaaaccgcaaagtctggactattaatgttatattagggaggcaacaggaagaaattaatacacacagagagagagatcatgccatgtcttatctagggatcttgtgtttttcagatgtcaccatccaattgttatggacaaaagctttgatgggacaaatcaaaatggtgtcataaatcactttcaagagatcatcttgtacctcaaggttaactggctgataatatatagtagtatgaagaaatggtcatggagagagaggaggaagagttgttgttgttgcaaccttttcttgatctcctttattacctaagctaagctaggagttcttctagcttgcacatggcaagagattgttgcccttggccctacacaaaagattcaaccgccaacagatggtgatctctccttctgtcaccgatgcagacctggataaaataatgttggggatcagacgatctcggttagcccaaatgcctctccttgatgtgaagtgtcggcaaaatgcttttgcaagagtgtttgataacataaaacttttgcaagcaacagtgtgcaaaaaatgccagctaggtaaaagaaaacatagatttcaaacataaataattcctttaacgtaatatgtgtggatggcaggatgggattagttccaataggacagtaaagagcacatattggaaacacccgtaatttttttattaagcatgggattagttaccgggcaatattggagaatactatcgcaaagatttttaagttggaaaataccattgcatatgttaatgacacgtgggtccaacttatacatctttgcgatggtacttttaaatttttttaccacctgaagagggaataaacaaactagaggcaaaagtcagaatagaccagccatcggttggcaccacatctctctctctctaagggcctgttcactttgatgccaaaaaaaaccttaccaaattttggcattgccaaaatttcgacaagttgccaaaattttgacaactataccaaaattttagcaggatttcttattaagttaccaaaatttgatagcaaactaaatgtagccacttttttagcaactttaccaaaatttgataaggttgaaaatggcatcaaagtgaacaggccctaaattccttcggaatgcttcaaggatgactagtgtgaattgtgaaagcttcttaatccatgcttgcatgtcataagctcatagctagtaatctaaatgttgttatatataaatacaatttttaactcaccgaaattgtcagtgaccttttttttccatttgacaccactgggatggccccaagttttgctttgttatttataggcttgaggagatttgaggcaagctgccctcagctcttgcaacctttccttccttctattctatggctatggccctatttatgtttggctgctcctgaatctcctcctattgcccttctgtctcacatccctgtctcataattaaagtcataattaaggagcttctctaaggtgattgggacttgttgcagggatcaggaggaaaacaacaaggtagagctctctgttcttgattcttgttgtcttttgtttttctgttcatatgttgtgcagattataacattctatatgttgagggggaaaaaagaagggaaagagatgattggtgcattttgggaacaggtttggtgctttcatgaagaaacaagaaattggatgtgtgaatgtgttcttgcttagtttttttatgctctctttcccttgattttcttcagttcttgcatgattgcatcttgttatgttgctcatttgtcctatcatgggatgttttcttgaacaaatatatactatcaagaaagaatgaaaaggtgttcttcaaaaaaaaaatgaatgaacaaggaacatgaaatttgttctgaaaatgtcaaattctttccctggaacttacatttgatgcccattaaaaattagctttgatctgcacaggataacttaaattttggattaacaacaagaggaagtggatcaaccagacaagaggaaaacgtgcaaacaagacaggcttgcaacatcaccttgagtccaaagccaagaaagatggggctgtcaatctcatacccaccagacgactacctgccagcaatggaggacaacatgggcaggctgttcatccggtccctcagcttcgacgacgacatggaggccgccgccgatgactcgccgtcgacatcaccgatgccatcaccgtcggcgacattgctgccggcattcggctccggggggaagctgatcatagagggctccctgagcttcaagagaagagaggctgacccggttcagatggagaccatgatatccatcaggagtcccaagtctgacaaggagagctgcagcagcaagccaaatgctactgctggtgcatcgagatttgcgcttgccggagaccagacaccggaggattctccggtgatcgccggagttgccagccccaagcaccaggcagcggctgtcaggctgcagaaggtgtacaagagcttcaggacaagaaggcagctcgcagattgcgccgttcttgtcgagcagagctggtatgattctcatgcaaaatgcaaatatttgtgcatttttgtcgtagaatattactagcggagatcaccgtaaaagtattctttgtcttttgggtcatagtgtttgaattgtttgatgcttgaattcaggtggaaattgctcgatttcgcactgctcaagcggaattcggtgtcgttcttcgacattgagaagcccgaaacggccatctcgagatggtctcgggcaagaatgagggctgccaaggtagagttcattggcatcatcccttatccaccaccctatgtctcactgacatgtgggcctataaccctggacccacctcgtcggtgagacgaggtgggggatttgcaaaatcagtggcataggagggattaatctctgaactttttaacagagccaccattgttctttcagtaagcatggaatttatactgcattactgacataggtgtagtgttgctatcaccttaggttggcaaaggtctgtccaaagatgagaaggcccagaaacttgctctacagcattggcttgaggcggtacatgcttcaaacattgatctcaacagtattttcatgattgaaatgtgcaatgaaaactgagatttcatctcatgtctgattatcagatcgatcctcgacatcggtatgggcacaatctgcactactactaccaccgttggctccattgtgagatcaaccagccattcttctactggtgcgaatgcgcgaatctccgaagaccgtttcacatctccgaacccagttgacagacaaggcttactgacaaatatgtgattctgaaacacaggttggatgttggtgaagggaaagatgtcaacttggaagagcattgccctagatggaagctgcataagcaatgcatcaagtaccttggccctgtaagttccatcactattcttctgatctgaaaatctgaaccaaccatttagaaactgctcagttgtagaaattgcatctgattaacagcatatgtttgttcttgttctgggattgtagaaagagagggaatcctatgaagtgatcgtcgaggattcgaggctgatatacaaactgagccgtcagatcgtcaacacgaccaaaagccgaaagggctcaaaatggatctttgtgctgagcacatgcaagactctgtatattggtcaggtagatgactactctgcatccatggcacttcttcattggcaaattgctgctacatcttttcatcttgcaaacattctgggaactgatgagatgctggtttttcaacacgattacagaaacagaagggcacattccagcactccagcttccttgcagggggagctacatcagctgcagggagactgattgtagaggatggaattttgaaggtatgttggggatgtgtcgatttctacgagcaacactggatttgctctctctgactcttgaaatttgtttgtttcaggcagtctggcctcacagtgggcattaccggccaacagagcagaactttcaggagttcatgaatttcctgaaggagagaaatgtggatctgactgatgttatggtgagaaccgaagtgtgaataatatcacaattcatctgcaggaaattatagatactgaatagagttttcctttg

SEQ ID NO: 34769 - DNA, 15767 bp, Oryza sativa
  unsure (1)..(15767): unsure at all n locations
acatcgacgaggattccaccatgttcggagagtgcctcgccttctgcaagaagaacctgtttgcagaggaaggcaatgaagaagatgagctggtggaagtaccagaggagatgatcatgaaccgtatcaactgcaagaaggccacgaagtcataccagctggggaagcaactgtccttccaatggagcactggagcaggtcctcggatcgggtgcgttcgcgactacccatcggagctccagttccgagcattggaggaggtcagcctgtcaccccggggaactaggtcgacgaggttttcgtcgccgaggcgaaagcccttgacaccaaatagcattccagttgcaagatttggttgtagccctacagcccaaggtgacaacatggggctgaagccaaggcagaggtgtgctacttggactgctttctaatgttgatatggcatgcaaattgcaaaggcaatgctgcttttcttctccttaactggaggacgatgcaaagtgtatagtgagtgagggaaacatgagaatgtcattctttggttttgtagatgtgtagagcaaacacaccatggcttccaaggaacaagcaataagatgtaccttccgaagaagtaataacaagtaataagatgtatttttagatatgacacatttgacactcgcaaggtgcaagcaaaaatagagattacaggttttcagggaggaaaagaaacagatgccagaatttgtaccacaaaagatgatcaagctaaggaatttgatgtctccaatcaataatctgtagtatgagcaagcatttgatgtgtcatgcaggttcatcacatgcacatgcatttatcgatcactttacaaacctaaagcaacaaagccagagagcgacgtagaagggaatcaggcaatcacaaactcaaacaaataaggacatttaccaagcagatttgtgctgatttgtaacattgacagccatgtcacactcgtagtaaattgaagatagcattcatctaatcagttcatgttgcccaaagccagtagagcataaccatgtctcacaacaatggaactttagttataggcaacagaccaaaactgcaaccagacaagtacccattacatttccattgctcttaactcataacatataaggcctactcagaaagacaaaccattgttcaagaactggaccggaaaagcagtacacgaaataaggcgacaatatggcattttactttcaaaaggcaggaaccacgaaataacacaaccgccacagcttcagcgcagcctcctggcctccctctcagactcgagcagggtgaggatgtcgccctcacggaccgggcccttgacgttcctcatgatgagacggttctggtcgtcgaggaacttcactctgacctgggtcacctgacccctggagccggtgcggcccatcaccttcaccacgacggcaagtttgacctgggtatccatgctgcacaagcaggaagcatatacagtcaggcaaaactgatgttctatacaaaccagcagcaggtaattcaatcgcagtcatttcaatattacagttcgtgaatttatgtatcagatcagatttcaatattgctttcaaaggataaaaatgttcaggcagtttatctacaactcaaaattacagtaacaaatgttaacatctggaattcaaacaaaaacagttcctaaatatcagctattgttaatttcagtcacagcaactacttaccccaaataatcacggtcatagtcatactactctacccaagcaaaagataatttaagaatcgatgcaaatatttcagtcacaacggatcagaaatttcatgaagacgtatatatctattaacgattcactcatcctagaaacaaatccgacgaatcgattaacaaaacaataaaccgaaccacgaccacaagaccaatccatctatctaccggctttgctacccaacgcggatggatcatcgcgacgccgctgacgcaacgatctagcatgccgttacccccgcacagcgcggcgacgcggatggatcatcgcgacgccgctgacgcaacgatctagcatgccgttacccccgcacagcgccgccgcgcgcgtcccaaggatcacggtgaatacatcgcgaaggaagcaaagagggaaggggggaggaagcacgacgacgcaccttctcttctccggctgctagcgacggcggacggcgaaggagggcacggatgcggcggcggcgacggcgcgaggaggaaggagtggaggcgagggtgaaaaccctagggttcgtctcgggtggtttatatagagggagctgagctgagtgggttggtggcctgttaggccgggccaggccggctgactcggcccatcagataagctacttttctttagtttcattttctttttacctatcgatctttcgataaatttatagtttcaaatcttgcgaaaatttcaaagaatggatataacaaattataagtaaaataaaaaagaaaagagacaaacatgtctaaaatcgtaaatctagaaaaaaaacatgtttctaaaattttttttgatgcactgtaactaagtgtaagtgcaaaacaactgaatgtaaggcggagtttctttgcatgagttccctactcactcttctcgtttttatgggcacgcttttcaaactactaaacagtctattttttgcaaaaaattttccatacgaaagttgcttaaaaatcattttgatccatttttcaaaaagaattagctaatatttaattaagagtaaattgcatcgtcggtacacgaacatgtcagatgggtgcaatctagtgcacgaacttgtaaaatgctcgttttggtgcatgaacttgtttaatgcatgcggatgaaggcgaaaaggacattatatggctaatcttattgattcatggactaattaggatactatgtaaacatatatctgagaagattgctattagacatacacctctccaataaaaaatagaatatgacatagtgatagtagaaaaaagatgaaaaaaaaacgagcaatgatattttggtcctcgttcgcacgaactaggcaagttcgtatactaaaacgggcattttacaagtttatatactaaattgtaccattctaacaagtttgtgtaccagcaatgcaatttactctttaattaatcatgctctaatggatcgctccattttccgtgcaagagggatttgatcccaacaagaagtagcgaaagtgtaagttggatatacagcaacatgaatcttgatgcaagatcctacaaagtaaaaataaaatctgtcacaagtaaaatagcaaaacctttgaaaaaggggagtacctattgatctttggataaattggagcttcaaatcttacagaacttttaatcaatggatataacccattttgaatgaaaaatgacaaaaatgtaaaaaaaaaccgtatatctagagataaaaaaaaacacttgtaaaatctaattttagtaaattgtaactaagtacaaattctctatagccaagtataagtgctctgtaatcgagggtaactataaattggatatacatgagcatgaatctggatgcaagatcttactgacgaaaaatcgaaagacgggaaccaaaaatctatcacaagtgaaatagcaaaaccgtttgaaaaaatcattaagtgatggaaaacctgcagtctaaatgtctgaattctggttagcattggatgaacaccacatttctatttgataacttctcgatttagcatgatcactgtttggatgggtttagataggttagtttgggtttgcagtcgaaaatgttttagggttaatcctctgtcctgattccgactcagtttcaactccaagcttttgatgtctaaatcaacggtaaacatttcatttttcttaaaaaaaaattctattggatttgatagtaaaatcgtcgatgctaaagaggcttcaaccatgttaacccacgctaattattaatatattggtgttgcagatttaaattctaaaccccaactcttagcttccttgaagcgagcatgtcacacaatatacaagtctgctagtctgaaatcatccgtagtattcatcattagtgtcatattgttgaagagatctgacacaatggaatacacagcgcagtgagttcttgcatgtcccaactacccatcactagctagatatcacaaatttgaagttgaaaaaacaaaaaccaaaatgcagcacccaatcttccttctgacctttaggggctaactggacttaacatgctatacagacaagaaatcaatcggctgtgagcagaggaggtcatgagctgcgatgctgggcattggagatttgcagactcagcgccatgccaccagagggaagcccagttgtaattcagggctgtttttgtgactcaaggttcggattcacataatcaattcaccgtcctggagatgaattatcctgtaaataacaagtgaagtgaacacacataaggaccaacttcagggcatagcagtagacaacgaaggagtgtgttttgtgtttttaccatgtcaatatcttcggatccatgtaggcagtcagctgtttcggcatttgcatttgctggctctggagacggcaaagcagaatgctgcattcatgtggagaaatcacttaagactatgaaaatgggagaatagtagcattgccagaaaatcgatataatcatatgtatacttgccataagggatgactggctttgtacttgttttctgcctgggtcaatttccgactgaccttctatgttcggagtagttgctgttgatgatatacaaactcagtgatcgagaagatttatgttcacaaacagaaacctcaaaaatgagaggttaatggaagatgtgacaatggtacagtggtatatatttgactaaagaaataaccatgttattgttatctccaaggataatgcacaaagtaatcgagtaactaactatgtaattgaaaaaaaaaatagtaaacattgaaggaacagagttcagaaattctggaaggaaatataaaattaacagacatgccagaacaggttattaatatcttatattcttacgacaatggagccaccaaggaacttgtaagaaatattaaaaagctctctaagaaatgatagtacctgcttcatcaaaaacaggtatcacggtatgctcattagctggttcacactgactacctggaatgctgtttgcacatgataaattaatagcattaagactgtaattcatataactttcttgatgagaattgaaagtattgaatggagcatcacctttctagtttttctctattcacatcttctgttacatcctgactattagaaacaggtgagcttctttttattacctggtatacagatagtttagagagatacttggttttaaataaaagaagccaaacaaattatatattaggaagaacaatcctgcaagcaggacttgtaccaagaaatgcacacaggagataatgcaaatatgcaattgaagctttcaatatttgcatctcatatggtctcacctcatgcccaatactgtcaaatatgtcttgaaatttatgtaaagcaatctccatgttgtgaagctccataagcattgcctaaataaagaaaaacagtaaatatcaacttagatttttggagtttcagagaaattggaaaggcgttatgctataactgaataacctgcttctctgaagtcagtctctcaataatctcatccttcaccaataaagatttcctaaggtaacatcgttaaggagacgcaaccaaccaaatgagatcaatagaaactaagattgactgcaatgacttttaactcagtagaaatggatatttcttctagtttgggctgaaatttggtgttgagtttctcagcctcaaggcgttccctcaattcatatatcaacctcgccctattccggagttcaagctggtaatcattaattttttcttcgaaaaacctaagtttttctgcataagtgaaaaatcacatttagaacagcagattttaatgaaaaatcacatttagaacagcagattttaatgaaaaatcacatttagaacagcagatcttaaaaaggatatcaacttatatatggtcatcattatcaacatatggaaattgcaatctgactacaagaagcaacataccaacaaaatctttctcaagcacagaaatcttctctactttacccttcaagtcagaaactgaaattgcaacataacacagataagtttctaaagaatgcacattagtgcaataaaaaataaaaggacaatcatttggtaaaacaatagtagaataagatgtttcagccatttgcatacctacattttccttgtcgccaactagacatttcacattaccgagtacttgtttcaccgcagcgacttcctttcctactgaactaaataaagccagatgagcattcagcttttctgaaatcacagcaatctgtttatccttcatctggatagtccattgcagagaacaagcagagtcctgcctatcaaacatggtatcatgagccgataatcagtttgattccacatacaggtaattcataattaatgcaaatgtcagaagcaagaacagggcagaattatatgacagattagacaatgtacaataaagcagactccagatacactctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagcgcgtcgtccctcgccgccacctccgcacgcagctcccgcgtctcccgacggtgcccctcctccgcctccttccatctctgctcaaattccacaccaaaacccccaccacgcatcagcaaattcgacccaaaaccctaatccccagcaaacagagaatccaatcacagtccgtagagtaagagagagagagacttggctggcggcgtggagctcctcgcgcgccgcacgctcccgctcctgcgaaaccgtaaaatggaagaggaatcagcactacgagaggaagaggaagatccgacaaggcattggatgatcggcaagcaaagctcacgcggaggagccggtgctcggagacgagcgagagaagctgcagctgcagctgcggcagcgccgccgcctccgcctccgccgccatcgccgccgcgccggtgagctcccgcttcctcttcctctccactcgacgagccaaaaaaaaaaaaaactcccacggggccatatactgggccttgccagcccaaacccttccggcccaaaaggcccatccgcggaagccgaatctccatcgaacgaactcgaccgtcgattcagatccgacggctgagatcccacccaaaccctagcccccactccgccgcctcccttataaatagctcctctctccctcctcccccaaaacctctgccctaatccaccctcgccgccgccgccgccgcaagtagccacccgcgccgccgccgccgccgtcgccggagaaggagaggagcagccatgggtcgcgtgcggaccaagacggtgaagaagacctcgaggcaggtgatcgagaagtactactcgcggatgacgctcgacttccacaccaacaagaaggtgctcgaggaggtgtccatcctgccgtcgaagcggctgcgcaacaaggtggccgggttcaccacccacctgatgcgccgcatccagcgcgggcccgtgcggggcatctcgctgaagctgcagaagnaggagcgcgagcnccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtctagatcgtcgtcgcctcttcgccgccgtcgtcgccatggctcgcctagctctgcgtactactgagttctatgttttgtctttagatctatggttgctttcaagattttgaacttagccgtgatgatgatgctttaagttaccatgtgttttggtggacatgattatctttttctatcgcactggtgaaatcttgagtgattcgatatattaccatgaaattcccatatgctccttgtgttgtaattgcttgttcatgtgttcttcaaattgatgtcttggtatgagttatataccttgctctgtatatcgcgtagaaaatgtttgattggtttgttaaagttgttgataattagtgttactatagactatataacccaatgaaccttaacataggatttcgtttcattgagtgtaacatatgggagagcttagagttggttttattgtctgtggaatagggtagaattctattaactcaatgaaccttaatataggagaattggtttcattgttgtctctagaatagggtagaaattggtgaacaattatgcaggttgtgattctttgatcatttgagttggtacagtgctatccatctatgactgcaattgccttgcgaaattctatactctgatgttcttgattttcctgatctaaaatgcttttggatttggagtagctaggtctccttagtttgcacctatcatacttatattttccttctttggaggaactaaactgtcatatctgttgaattctcgtgccaaaatctgtagaattctaagagcatttttgttctgaattgctggtctttggtatggtagggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagcaaaataatattgcacacagatcaaatttttttaacttatggctttgtcacaagaacactatagattcttccacagttaacttggccacaagaataatacggatagaagtagtaaaaagggcaaagctatatgctaaaagaattccttgaaacaatcaaacatctttttgaactactttattacaagttcgaactaaagcatatcaattatttaaataatatctaaagtgcatgtttcattcttaaactatttagcttgaatgcatagtaattattcaaacatctcagcaaagaaattacatagcagctggatagttttgtattatccattgggtcacatattccttaatagaatccagtggcctacccttcaacatggcagctatattctcatgggtcgcgagataagtctgcagctcaagtcgaaccatgacagggtattccgtcatctcatcaattatcttgaatagggattcatttggatgtgttatatgtgtgaaacacatggtttcagacatattatctgtagcccctgttatctcataaaccacattatcatcagttctaactcttttacctttatcagattttctaccttttgcacgcctagaagatgagctacttccagtattgttctcttgatctggaagacaatctgagtcataatttgatgaagggtcaacatcaccaggactgccatttttatcaccaataaaatcatcatcttcagtcattggatggtcatatggtgtttgcagaacattaaattcccctgttgcatgcttgtcttgaaaaataaactccatttcatcataccaacgtatggggacgttaatgaatttagcccttttatctttggcctacacatgacaagaaaaatgtcagaaaaatagacatccatattatatgtaaacacgatagttatttgcaaggaaagaatagttagaacactcacattagtcattcgaacaacttcaatctcatcatataggattttttttctcaacatcatcaaagttggccccgctcaaattctttgcctccataatcaccttccactgagccttcaacttgtgataaacttgtcgacttgtgaagtttgtgtgatacttgccattaatttgctttgcacattcctcatgatggacttctttaaatacaagttgtcttccatcatgcttggtgccgacggccagaaagttcctagctactacagcccataccatcgacaatccccattaatgcaaaatcagaatccagcaccaaaggcccaaagcaagattactggatgtggaaatagtacatgaagcaacatagacagctcgtatacatccatccatggcaggaagatggagagctttaataaaagaaaaaaagtcctcgtacctgcaaatctagatagacgaggcgccatcggcggaagaaatcaaatctgggagcttctcagttctcaccacgagcaatcttgtgtccagtagcaatcttctgcaagaacatgctctcctcaaatcgagttggccttgctctccgatttactgcgtggaggccggaggctctactgcatttatatatgggcacgggattactgcagatgaatcgaggatgcttgaaagttcggcaaggggaggagggtgattgcaaattgaccggatctatgagccctatagttcagccaagagtgggggaagagagcgacgagatctgcaagcccgattctttggcgaagagtggaggagtaggacgaaattggggggctggttgttgaagaaggtaacaacttttgagaaaaatcgcttcatccttatcaacaacttttttcacgcgaggagcttgccgtcggaggcgagccgattcggctctcccttgtgagctatccttttctcgctcctatgggctagctcgcccccatgggctaggatttttttctgattccaaacgactgtccttgccaggccaggctaggcccctgctagccttggatccaaacgcacccttgataaccagaggggaaaaaaggggagcataccttgtaaaccactccatacccacccctgccaagctcttgttcctttgagaagtcacatgtaatggttttcaagaattccattggcagatacattggcgtcgcagttggatcttgtatgttgttctccagtataccaaaatccacatgtttttgcaccagggaatcatgtttactagttgatccttccattcctgattacataaaaggaacccttagagataacaagaaaaatcctcaaaaccccatacaccaaattaaacacaagttgcttgggtatcctgtgtgggttcggccggttttccttcaattagccgtgtaactgtaaggtatttatgctcggtttctctcttctcaatgaaaaacaagaactcactaccactaccctttcggaggtttgcttcggaaaataataataataataataaagaactgctttcacaatgcaaacggggaactgacagtgagccctgcaagagaagcagatcaagtcggcttttccacaaacaccttgcatgcacgatgcacatttgataccgtcgtaatcccaaggaattgattcatccattgtctaaaacgtcatttagaccggaggtagcaatgtgttccctgctcctaagaactaatcgtgcatgcaaagaaagagagagagagaggactcacaggatgatccgatgaacaacaaaaaagaaaatgaaaaaagaaaggcaagagagctgcaggaggaggtagtcagatggtagctcgcacgcagaaagaaacatcgacgaactaaccggcgcgagttcgctgacggccggcgcttggtatatataaagccatcgatcggctagctcaggaacctactgtcaattatctactctctcgcgtatcaaaatataagaacctatgttatgtgtgatgtagtactgttaatttggacggagatatttgaagtattaggatatgtcctatccaggactacgttctcataatttaggtgctgtgccccaacacacaattactcacacgctatatgatatactacctgtcctaaattataagaacatatgatcggcatagctagattcgtaatactatgaaatttgctccatccgataataagttcaactagaaaataggcgtgccagttgacacgccgattaataaagcctgtggtggtattgttggtcctagtcgagatacatatgatcatttttattttttatttttggagattcgaagactctgtacaaacggaagcaaagagaccaataaaaaagaaaatattagaatgaaaaaaattcacctcgagaacacatattgatagtacccacatggatagttagacatattccacaaagtcaagttagaaagtcaagttagagggagtagtgtaagataagtcaattggtcacatggatagaccaatgtacgtgaaattcatatacttaagagctagggagatcaaatgtacggggttatctaaaaaatagttttatttttattgattaattctaaaagatatatgaaatggaatatttgtgatattcctatttgaaaaaataatatggaaatgtataattctcaacaatatatatgttataaagtggcaacaaatcctaagtggtttctacagttggatcactcttccaaataaaaacagcttagggtctataagtaaatacctctatatgcaaattttaagtggatcagcatatgtgggagtacatccttttgatcacatctaatcgaactgttctagatgttgtatcgttaagttactactttttctttaaaaaactgttaaggtactacatgcttctagaattatcacataacacttttgttctctatttttcttgatcttctgcattttttttccttagacgaaatccatgatttatttgataagccaggggcgccatggggaatcgtataatattatggtatgtttgagagaaggggaaaataaaaagatcttaaaagatatgaaaagatactaaaataaggtgagtcattacaacatgattaattaagtactatttttttaaattttagaaaataaattaatatgaatttttaagcaactttcttttagagtttttttttattgtttagcacttcaaaaaacgtacatatgagcggagaacaagcatctatagcatgaaattattttagaatactcggtccataattgtccactcatgccgaacagaagcctgtccataattaatttatataaagacataacagcatctatagcatgaaattaattttattaaatttatcatagaatactcggtatattttaaaatgcacttatttgattttacattttctataaacttattagggtgtgttctttgtcacctcttcccaacttctactctctatttttcatggtacactttccaaaatgctaaatgatgtgttttttcaaaaaaaaaagaaagttgtttataaatatcatattaatctattttttaagtttattttagctaaagcttaattaatcatactctaggatcatgccttagagtatattgtgacaaaagtacccatacactaatctagctacgaatttaagattgtgtcatgaactacacaattaatatcaaatttatcataaaagtatataccacaaaattagtcatgcggttatcaaacaactacattaaaagcttcaagaaaatattcatcccattttaatgaaagggagacagtgaatcatatttttttcaatgttagaaagctgtagtttttgataaaagatgtaaatatatcgaaaattagtagttttaggatacattgagcaaaacatacatagcctagcgcgatttacttaacttattacagacattatatttatgcatatatgtttgataacttgtgtcctattaaaaatttagtgtagataataagtcatttttcaagtgataaaacaatcaagtcgtgacaaaagtaaataatatttacgtcaaattttgaaacaagataattataaaaatgcaatagatatgtttaaaaactactacctccatatttcaatgtatgacgccattaactttttgtctaacatttgaccattcgtcttatttaaaaagttatgtaattattatttattttattatgacttgattcgttatcaaatgttctttaagcatgacataaatatttttatatttgcacaaaaattttgaataaaacgaatggtcaaatattggttgaaaaatcaacggcgtcatacattcaaatacggagggagtagtagcgttattatattatttgaagacggagagagcatagcaaattaagaaaataccgtcgctagcttctcggcgtgaagtacggtgtctctgggtgacggggttttaattgctgcggcagcgaaggctcaaacaaagaacaaaaactacttgaagttgtagtggtagaacgaggctgaagttgccacgtaggagtacagaaagtcaggagtggggcccaccggaataatctgtctcgtcactagaatgttgtttggagaaaaataactgaggaagatagcactagaaaaataatctgtctcgtcactagaatgttgtttggagtggtccggcaggattcaaccgattcttttgccaaaagagagtatataatctgtaacttgtattgtatttggatcacaatctgcattcataatatcgttgtaattagtctctaatttgtgttgtgaacattttctcgattgttgctgggtgaacccattttttccgaaggaagatcgccggctgattttattaacgaaaaacaaatggatagcactccactgctccaattttaggtggagctaaaattgtttgactgggctcgagctgcaaccgtgcaaaacataccctacaacaactatagcaactactttctgtcttaaataagtttatttttttacctattccacacatattaataaaaaatagaaaaatagaatacatccactttatccaataccaatatagttattcctcagtttatatattgctaatacatttactcctattttcataaactcagatatataattattgaaaattgaatttaatttgagataaatgggaggaaaaaaatgaatttattttaaacgg

SEQ ID NO: 34770 - DNA, 28834 bp, Oryza sativa
tcaaatattggttgaaaaatcaacggcgtcatacattcaaatacggagggagtagtagcgttattatattatttgaagacggagagagcatagcaaattaagaaaataccgtcgctagcttctcggcgtgaagtacggtgtctctgggtgacggggttttaattgctgcggcagcgaaggctcaaacaaagaacaaaaactacttgaagttgtagtggtagaacgaggctgaagttgccacgtaggagtacagaaagtcaggagtggggcccaccggaataatctgtctcgtcactagaatgttgtttggagaaaaataactgaggaagatagcactagtatttacttagcttatcttaaatatgttaaatgttacttccctaactctaattataagacctgtatttttttacacggtcttcaataacgaccactattttattttattctataatcctaacaaatatgaaattagcatcacatgaaaatactttaaaatataaatataatgatataacatgcataacacttagtatatatatatagttagtatgattattagtcaaaaaatatcgagtttgatttttcttaaaaatagggcgccctataatttaggacgtactaagtattaccagtagtattattacttctgtttgattatgtcgttgatctcttttcacatgtttgacaattcatcatatttaaaaacttttttataattataatttattttcttataagttattttataatttaaagtattttaagaataaaacaaattgtcaaacatgtgtttaaaagtcaacggcatcatctattaaaaacggatggttatatatatatgttaatgattggaggtcgtatttggtttggtatatgattccttagaataaatacacacggaagtcatggctacctaataatctggtacgagctgagtaatagtacaaagttatatatcatatggtagtttaggttatccggtagttatacaaactaacatgatactaaatttaatgaaattaagaatgtgttggtttccaattttttttagcgtgtgtaaggagcaggtgtatgtgtatggtattatatatatacagtggtgtatgtatgttttttttaatgaatcagcgagccgttaattttatttaatatagaaggagtaaactgtaaaaataaaaagctgtatatacacaggaccttaggtccagcctagctaaaaattaaaaattaagccaatcgctgagactcagtgtatgtatgtttaatgtacggctagtaagaaatagaaaagctggtacatatttatacatactatagtgtcagtatggaatgaaccatttgagatgtcaaatcgtctcatatggttatacggaattttagaaaaacaccgtttaacgcacaagcatccgtccagctcggtcctgttccggcggtccggcaggattcaaccgattcttttgccaaaagagagtatataatctgtaacttgtattgtatttggatcacaatctgcattcataatatcgttgtaattagtctctaatttgtgttgtgaacattttctcgattgttgctgggtgaacccattttttccgaaggaagatcgccggctgattttattaacgaaaaacaaatggatagcactccactgctccaattttaggtggagctaaaattgtttgactgggctcgagctgcaaccgtgcaaaacataccctacaacaactatagcaactactttctgtcttaaataagtttatttttttacctattccacacatattaataaaaaatagaaaaatagaatacatccactttatccaataccaatatagttattcctcagtttatatattgctaatacatttactcctattttcataaactcagatatataattattgaaaattgaatttaatttgagataaatgggaggaaaaaaatgaatttattttaaacggaaggagtaaaaatgaaaatatgggataccaaaaaagaaatacaaggagtaacttagtatttatgatagtataaataattttaaactaattaaagatgcacgaattatactcgtggatatcataatttgaaaactagtgatgaagccgtgtatctactgctccacaccgcacattgatggtgcttcctcgtaaacttcgacacgaatattagggaatgacgtaatatcaaataattagaaagagtgaggctttaaacccaggtcatctagtccaccacattgtgaagctagctggaaaatccctaggagtttctcagttcctcgtaaacttagtactgaataccgaagttaataagaaagaactgattatgtttctttctagaactagaatgttaaagctgaagcgaaatgagcgtagttcaactggttagattttatacggtggaacaaatccatctagatttaagttctagatttgatacgggtgttcacatttatagttaattattctttcagtgatatgcagtatacctatcgacagcgagatgtccgtgtgagcgtgtcaagggagcaacgcgaatcgagcaccatgatggttgttcttgccatctgtgtttatctttgttatgggttagcaattagaactactcacttcgttccaaaatataaaaacctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacaaagtgagtatttgtttgggatgcttagggtcatgatccatgagttggacaattagggcttgtttggcacagctccagatccacctcttctggaactggagctcagcctaacaattttagcttcacctaaaatgggagcagagctgggtagagctctctcacaaaatgaactagagaggtagagctgggtttaggcaactccacaactccattccagacccaactcctggagctaaatttaggagttgggactctaccaaacaggccctaaatatacccattcatcaatttaaccaatacaccagatatatttcatgtctggtgttttggttaaattgatcactttggctactcatcaatcgacaaccccttctccgatgaggtgcggaataaagtagagttaagagtgggagtacaagaaggaaaaggaaacttatcaagccaagccttggagggaggccttgaaagcagatccaatacgcttcatgtgcaacttctgacaaaaagagaaaacactctaatacaacaaatgcaataagatattgattataaaaataatcatcaaacttcaacaggagactacccttcaccttcttcctctactacattggctgaattcgccttcttcctatattccagttgccaaatatgggctccccataatataggctcacagcgagacagtgtgagagcccaaatttatagaaatcgagcttgcactagagagaaagggcctcacgatatcagctcatatggaggtggcacgtaatagatcaagttcttcatagtccgaggctccgatgtgtatggctataaccattgtggtccgctccatatcccttgttctccattgttcctcacaggatcaggggtggagagtgaagagagagcagaacgagtattatttctcgtcgcatcggatcacaatggttaatctaattcctgcaaaaagaaaaagatttactattttttatgctaaattcttctgaaattcatacctctgcattcaaaagagccttcaacggacgaacgtgagttccctcaatcagaatcagcggctgagatctctgccagccgtccactccatgttccaccacctccgccgccgcctcctctgcaccgcggcggcgccgccgatccgcgtggcgctgacggagtcctccggccgaggggtcttcgccacccgccccatctccgccggcgaggtcctccactccgcgcagcccctcgtctcccacccttcccctcccctcatccacgaggtgagttgctccgctttactcgcctctttgccgccggccaccgcggctggaaactctaccttctccttttacggacggagcgaaatggttcggattgggctcctcaggtgtgctacagctgcctcaggaggaagtccgggagcggcggcggctcgagcgggagctgctacttctgcagcgacgcgtgcagggagcacgccaaggtgaggccttaacaccattgatttatgtactagtagtataatgacttgtgatgctacaaaattttcaagattcagtggatgttagtgtactgttcttttgtcatttgctcatttccaagttattacgatgctgtatcaagatccagtaggtgttttgcaacaaaatgtgaatggtagccttccatggtcagagcacatgaatggccaaaggcttgcaatctttcacaataatgttccttgaggaaattacatgtttatttgtcctcccttcgacaagaagatatatctgcagagggcaaccgaggatggtgttgtctaacaaggtgtgtgattttttggccaatttagggattccatggcgttgaaaagaaagcggattggtctttgtttgatgaccactgcaggtatgtctctgtccccttgtgtagatgtgtgcatcctgacctccgcattgcatctatgctcatgctcttgggttttatttttacttgttaatgccatggcgatgctattttgttaagcacgcaattgtcttggtggcttttgacttgaatttatactttgcttttcttcctgaagttcacgcggtctaaagtacccgtacatggcaaagcgactagcttgcatggttatctcaggagctgttagtgcagactgtcttgacatactccagccagcccgtttgcaccaggggacacttacagaggtagctgctttatttcagaactattgttaatttcagaacataatcttttcaactaattcatgtcctgtaatgttatttgtctggtgcttacttgaacaatgtaataatatagatggaggaagagtttgcgttgttggattccacttttaggaaggcagggtttcaggaagaaatcacaacttgtatccttcatttttctcacttgtgttatttatggccaagcagtgttgaacactaatactgataaagatacgtaatagaatggatcgaatgcatatttcaatctcgcccaacttatcttttcttatctatttttctttgacaaattagttttgaccaaagagtggtacatcaatgtgctggcaaggatacgcataaatgcattccgcattgaactggttgcaagttcatatgagaaccttctatcctcagcagtagcctcagtatcttgtgatgcggcagttggcaatgctgtctatatgcttccctctttctataaccatgactgtggtatgtcttttgaccttgcgctgttgaactaaagcaatatttaacttccttttgcctacggaatatttaaacagtgtgtcttgccatgagatacaagaatttgttattgcctttttgttgtgatgcagtaaatggtgactgttatttctaaattcttcattagcatatgtttatatctagtattgactgattggtttaccgaaattattctcgtcgacttaatatcatcgagttttgtggaaccttttggttattaatcactttagataattagaaaacaaaagtcgtttcattccgagtaatttttttttacttggatcaatattatcgcgcttatttttctttgaaatttgagacccaatcactcaccatctcccattattaactttcagatccaaatactcacatagtttggttggccagcgcagacgcgagattaaaggccctccgcaacatcgaagaaggtacgtaaatctgcggtgcgctggcccagttattctatcaccagccattgagcgcagttgaacagaaagacaaacacaccgatggctgccaaaattgttgatactgtggatgttgcatctgctatatactacaggtgaagagctgcgcatctgctacattgacgcgagcatggacgtcgatgcccgtcagaggattctcgccgaaggatttggcttcgaatgccgctgccaacggtgcttgtctggagattaaaacaccatccctttttcgttgtattttccatccttttggcatgcacattgaagccaaccgaggttaattaccattgtaaacttttcaaagatcagttgaagccaggagtcaccaatgtaactgccaggtgctcctgtttggaagatttgtaacgtgttggtgtgtgtgtgtcgacaagagtacgaatactgaatgttgttgattattaccccgatgtttaagcattagacttttggacattattagacatttgtttgacatgttactgccatgccaataacattggtgtttacagaatgtcttgttgtatgctgcaactttaatttatggataagagggtatttgttctattttcttgatgcaatctccctagtgttgcagttcatctgtaccactgtacaacgcgtcatgcatagacatccagtcctatctataacattgaagattactgatgtgcaacatttcatgccaaaataaatagcagatctggcactctagcgcatccacaagaaagcatgatgttgtgtccatatgattgttcatgttattaccacttagcactatctgtcaaattagaacccaaaatactgcccacaatctgttttgtcaggttttgcataagcggaagaaatagcttatatcaaagacactctaaccttatagtatttgcaaccgagagatcagcttgtctgtcattaatgatagaaggtccaagcacatcagttacaaaaccagccaatacataactcaagcagcttataccaaaatggaattttgatatctgtcaacacaatgccacctaaacatggcttgggaagggtgggtaagagactgaatcgtatgcaatgcgttgcatcctggatgacagcaccattctcacaatgatcaatgaggggcataagtttcacattttttttgggcatcggcattctcatgctatcgctggccagtttagttaccaaagggatccaacaaaattttactgaccagcactcactattgcggtcttagagaaacaaaagaaacaaaacaatacaaattacaacagataatttaaaggaaataatcaggtgttctccgtgtcacatctggttcacctctcctaggagctggttcaaactgcaagaataatccaagttgaatcccagggaattatttttacaacttttacagttacagcacagcaaaagagaattgatccaacaacattactaatctgtttttaaatcagttggtatttacaatttaccatacctgtataatgtgtaagctacatgtagttggctaataatatcataagtaaaacaaaacttggcataataggaaaaggggatcagaaagaataaattggtatgcacctgaataaatgtgtgattcctgcagtcatcaacctccaggatggatgccatgttgccacagcgataacaataattaggtgcactgaatatggtcacgaccttttgttcctgtgcgtggtgaagaataaataagacaatgctagttcggtagcaaaatcaacaacaaaattaaatctagaaaaatgagaaaattccctatgtacccacgaaagttcacctaatcccttatatgcccctgaattttgctcattcccttatgtacccctgaattttagtttggatcccttctacgcccggtcaactagcggaaagggcatggaagagatcaaaactaaaattcatgggtatgcaagggaatgagcaaaattcaagggcgtagaagggattaggtgaaatttcaggggtacacaagaaattctctcttaaatctatgctaagcaacttacgtgcgcccagttatatccttccataactaattgatgagcccgggctacaagtttgagattattggtatggttaaactgctccgatatgtcctgaaaaattgaatgtgtacggttgagaacagaacagatagtctattaatagatgaaagaaaattaatggaaaatagagtatttagtacctggccaaaagtgtagccagcaccacgaggagatatgccccaaccgcatcgatcatccgggtcagaccatagaagatcacacattggtccctcatgagggacctcttgaacacgatctaagctgcgaacactatcaagattgtcgattgatggcgataaaccaccatggaggcagaaaatctctgattcaaccttcaaccaagacaataatttaacatcaataaaattttctgaacaaataaaaaatgatttctaaacttctgagcgagaacagaaacatcaactggttattaagaggaaacaccaagttaaaattctacaggccaatcaacaggtaaaaaatgatagatcaaataaagaatttcaactggtcttgcacatatattatcaactccaggaaacaaaaggaacaggaaagaaccaacaattatggctgcataaacacttggttgcctacagttgttacagcaattttggttttcaggaagaggaaaagcttaatcagtaattaaggcagtgacacaagggatgccagcattattgacccccttggagacaaaactcattcaagaaacaatccaaaaattatctacaagcaccagaaactaatcagtccaaagaggacacacgtttagactactgaggccagattttattttagagagtagtggttgccaaaagttgataaagtagcacatgcatagatgataataagtgggtttcatctgagactaacttaatctggtattggcttcagattttcgtatagaacattgagcaatgttcatacagaatgtcaattttaaaagaacaatagaaaaaaaaatcatagaaggaagaggactacaagttgagcacgcaccaatgctgtcaatggaaaatagtcaaaaagatcggtgaagatcttccagacatttgcacttccatacctaatcaaaaagcagaacaagatcaatcaataaaaaaaatcaagcttgtccactttgtattcacaagtcaatactacaaaaatcaacttagatagactagagttttccaaactattaactttggcatagatacagaataagtagactttcaagcacctaaactgactcactttcgtaggcattcgtcgtagaatccatacacctgtgtgatctgcaattattgaagatttcaagacagtttaaacaaagatggaatgaagagcaaacatcatctagatgagtccaaatgaagaaatggtttaagaagaaaggttgcattttagaatgagaaggtttctgttttaaatttatttgagggcgggaaaagaaaacaaacaatagaatcatctcatgggcatgatgaaatctacatacctgccgactctcatggtttccacgaaggattgtaatccgctgtgggtagcgcaccttcagtgcaaccaaaagctgggcaatggtaccacatcatgtcaacaagtaatacaaaagaaattaggcttcaataccattaacttaaacacaaatattgccgatacatctgctaggtttgaaacaaagagctgccaaaccatgatgcacatggtaaaacatggtagggccaaacgtcgtaaacaaacaaaccataagcatgacattgttgaacttcaattaaaatttcagcaaacaaaatcaaaactcaggagacttactgtaacagtctcaacagaatagtagccacgatctacataatctcccataaacaaataatttgtatctggacactggtaaacagtacaaaacaaatgtcagcttttaaagcatgaaacaaagaccaaagagagcagaaagaaacaaaactaatgccaatggattgagtaccttcccaccaatccgaaagagctctactagatcatggaattgcccatggatatcaccacaaattgtgactgggctcttaactggctgtatgtaaagtaaacaaatggttatagtcatatcttatattttcctagaccttataacataaaggcatacctaatatgttgacattgggtaaaatatttgtgccccctcaacatgcatagttacaagtacagaacatcaccatgcttgtcttagtcgcatatacataaaagattgttctttgtggtgcaatcaatgattaattagttgtgctgacaaaaaataaggaataccagacataagtcacccttttggttgtagctatacacatttaaattgctagagatgaaaacaaaatgtgagcggctatgctatgtccagactgaagctataaggttctctgtaattttaataagaaaattatcttattatgtaggtttccattgaagctcgaagaaataaaaaaggtgagcaagtacagaaggaaaacatcgcagttttgggtatatgagcgtgctggctggaggggtgaaacatatccttgttgtaaacaccctagagttgtgatgggcttgaaagtcactcaccctaatttcagatcttcccccacatttttcactagatatcttcccaatacccaccagcatacagaatgtgctgacggtaacaatataatccgcagatggaagataccttcataccaatcccactcagatacttcctccgtttcatattataagactttctagcattgcccacattcatatagatgttaataaatctaggcacacatatatatctagattcattaacatctatatgaatgtgggcaatgctagaaaatcttataacctgaaacggaggtagtaataaataaaaaaaatatcaacttcttgcatgggaaaagcatgataccgcaaaaaaccattatttttcatgtccatatcgagctagatcctctcacaataaaaactgaaatgagcatgccaactacaaacagcacagtcaccatatcgctggtgttactcgggctgattagagccacacacacagtcaccatttttatcagaagcaaccggcaatcaatactttcagcccagcacgcataccatcatcatactgcagggcatggcataatcgcaggagagctccaccgtacctgaacgttgctttcttccatcaatatctccttcgccttctcgcacaacgtcttgacctgaaagcgggccttggttagttagtaccagaggcaaaagactcacggattccagtacatttccattggtcaacccaaggcatgacgcatgtcaccgaatttttttttaaaaaagaaagaaaacagaagcatcgcatatatccaaaaacaaaggaaaaaagcaagcggatttaagcgacacaggcgcatatgtctcccgcccgagagagattcgattcggcatctgatgcaaaagctcacatcgacgtatcccaaatccccccgatccggccattactcctccatttattccttctcctcctccccccgcaataattcctagattccgtctgagatctaccgaacccgaaccgcaaaaccgagataaccctagcagccgcctccgcggagaagctgaaacccatagggcggatccggcaccagagaggaagccgtggcgtggcggcgctcacctcgggctcggagagcgggcggcactccatgagctgctcgatctgggcgtccaggccgccgccgtcgccgccgcgcgagcccacggactcctccatccttcctcccacctcctacgccgcagacaagaggggcacctggtctaaccctagccgggggagagctcgtcgccggcgagggggaggcgagctggagagagagagagaggagagagattgagatgcggttggggggcgcgagggggagggagatggtgcaagggcagggcaggcagccaaatgcggggggaagcgatcgagccgggggggtcgggggtggggcccgcgtgtcagtgtcgcggggggggggcagaggaatgcggttggattggaactggagaagtggaagagagagcggaaaaatttttatgtggggcccacttgtcagtcagagggaggaacttttatgtgggacccacttgtcagtcggagggagggaattttgtgtgggccctacttttcagtcggggagagagaggaggagatgagggcgttcaggcgtgggcctggtgtgtgcccggcaatgaatactgcccccagtgcgcactccattttatattacaagttgtttggattttttcttaatcagtttattgagagatatactaataattgtaatataaaataaacatattattaaaatatattcaatgttaaatttaataaaactaaatgttatatatgttgctaatttttttatataaactttgttaaacctaaagaactttaactaagaaaaaaaatcaaacaatttataatatgaaacaaatttagtacttaaaaaaaatgaagattggtggtggtgattttaaccttgacagacaaacttaattctaccctatacgatcgcaagatccaacggccaaatcgttaccttcgcactacttttcataagctcattcagaatgcacctaggtgacatttagtctcatcgaggagatttcactccacgtaggcaactggcgtaagctcccaagaagaacctcatctccctacgagagagaggaagaaggagccagtgaaagtgccacggacaacgagattgtcgccactgagctccatatccatcgttgccgagctccaagtttgtcgccaccgagctccatgtctactaccgccaccttgatatgcacctgctccgaaagggtggctcaatctgccctatccaagcaacgaggagggggacgacggccgtactggagagtggggaggcttccttgcttcggagagcccgaagaggcaataggcggtggcagccggagttgaagccgagttgggggagggagaggcgttgacgagaggaaggaggggtgaggtggcgccggcgaaaggtggaagggagagacgatgctggcaccgccactggtgaggaggcgaggggagagggatcgggtgggaattggctgaggagcgaggagggcatgacgcatgagtggggatagggtgagattttatattatttctagattttagggtgtttagtgcaaaatgttggatcactacataaattaataatagaaggtgctgaaatgcaaaatatatgtggggtgctctaatggacactcggtcaacggggtcaaggcctcagtggatactcggtaattctatttagggcttgtttcgaattaacaaagggaataaacgagtaatttcaatttaggaaaaagtcctataagaccctttaagaataaaggattggatctgtaaaattgctatgaaattccgatggaatggcaatgttttatgcgaattttgtagaattcttagcataagcattgacctcttgaaattttccttttgtgtttatcactcttttccaaatcatatgggttgcatgtgctgcatctaaacagttccttatgtagtttttccagtgtttttcatttcttggattcaaggtgacatgacattttaatcatacatcttttctattcacatgttttaaaaattgtgagttccaaagtcctctaacttaatttctaaagaagtgaacccgcgaattattgaacacgcactacactataacatagatatagaagcactcggtctagcgggataaacaactattagtctgttgggaaagacctttaccgacactaattctgccacgagtgtctaccaggggtttagcagttgacaaaagtttttacatatatttttcaccggtagaagagtgccaacaattcttttgtttttgtgccgacagaccatgtattaatggcaaacaaactattcctagtagattgtctaccagcttagggcatcaacaatgttgttcaaaaccagtccatagtcaataaaataatctattcagctacctaaccacattgtggaagtagtcaataggagggaaatagcaaaagctgcccatagcactatggctaggcaagaagaccataaaaaaacatagttgtacagtggtactgttcataaaatattaaacaaaacaagttgtaaccgttggcttctggccgttggcttcctgaattgtgcctacaaaaactgaaacagcatacatacacccctgaacattgtgcctacaaaaactgaagcaacatacaccatctccattcatcaatttgctagaacacaactagttccaatggatccctcccatagaagcatctcaagtttcacaaatcaagactccccaagccaatactctgagagtagtgaccatatctcacctcctacaccccaatctcagtttctctttgcatcaccaaattatctgcaaaacttcaacccttttggtcctccaataaatcagccaccctttggtcactctcctccaagatttcaaggcgttcaacaccaagggagctggctgccacatactccatcaagctatcaatgatttcatttacaagagagttttggttccttaccaactatgcagtttggagctgcagccaacaggccaccatatgtgctgcaatttagctctgcagttggtgctgcagccaatacttcttcccatggatccgagtctagttctccatgccctgcaagacaaaaagagaaacaacatgtcacaattgaagagtcaagcagcagtagtgaagaagaaccaaagaggctgttggcgatatggcatgaggcccttcgaccaaaatctgccgaaagctatgcgaagagtggggattcaagcccgagacgtcaaagttagtcggggcgaagtccccctatggcgaagactacggaacaaggacggcgagaagcaagggatcacgcgggtactttgccaagccagaggcctcttgggcgaaggatgcagggcgaagagtatatgccgaagggggacggactttgccaaagcaagctcgcccccgcaagggccgaagaagcctttccggtccatcaagcctaggggctattgggccgacgatcgcccgacgacccatcaggggcccatgaacctcaattatactatgtacccatgtaaatgtccctttcataggggtaaccatgtaaattcccctgtataaccaaaaccctagtagtaagaacctgtaatacgggctataaatagtctcatagggccatgtaatagggggatcccaagaaaaattctcaaattaatacgctttacttcttttccaaccactgttgagtaaccacgactttcgacgtatgcggttgtcgtttcgacaacagctggcgccgaccgtggggacctccgagcgaaaccactgagggcgaatgccaccaaagaaggttgtgaaggagaaggttacaaggcgaaaggaaagcgacgccggggcggatatagccgccgaagagggagcagagccttcggcgtccattgccgaagatggaggagcgccatctggttctgcacctgcgccatctctaccgccttcggcccctgccacctctgtgcaggtgccgaacgcggctgacatggcgaaggcggcggcggcggcggcggcaagggcactccagaccagggcggagatcctttcgacaagccaactgctggtgccccaagccgctccgtcgcagccggcagcggccccaactgcgctcactcctgtgcaagcccaagtcaaccctaaccctgaaacacaaaccgaagccgacatggaagccatgcaacaaaacatgacgggactccaagacatgcttcgccaaatgtaagaacaacagtaagcatacgaggcggcaagacagtccaaggtcgcttcggctccaatcctccagtattcagcaggctatatcccacaagtctatccacaagtgccgacccagccccttccgcacaagtcgcgcaagcaccaatgtacttcgccgggcaaccatcgaccgcagcagcgcatccggcctctcacatgcaactgcaagctcaaccggtcgctgcccaagtacaccctcaaccgcctggccaagcaccacaaacaatggcagaaggggcttcggctctgtaggcgcagctccaggctttccttcagcagcttagccaaccccacaacatttcaggtacagccccttcggctcacctggaggggaatacaagtcaaggtgcgcctagttggttgccgtcgaatcggccaggtcaaggggcttcgccgtggagtcaaggaccgcagttcgacttcatcaatgctgctcaggcaccaaccattcggccgcaagcaccaatgtcaggcttcggagcaaaccaggcaccaaaccaggtcgccatgacatggtcacagccaactttcgacccctccatggtggctcagcaagcattaccaatcggagcggggcagccgaatgccatggcccaacctcacgcgcaagccgtgatttagccctttgccacgccgtactcgcagcaaggtgccgtgaacagggcggggggcgaaaaggggctaccgctgagtgggggaatcaagaaccgtccaatcccactccagttcaagttcccacccgtcccacgctactcaagcgaaactgacccaaaggaattcctctccatttatgagtctgcgatcgaagcggctcatggcgacgaaaataccaaggcaaaggtaatacatctcgctctagacggcatcgcccgttcttggtatttcaatctgccagccaatagcatttactcatgggagcaattgcgcgatgtctttgtccttaactttctaggtacctatgaggagccgaagacgcagcagcatctactcggcatttgccagaggccgggggagtcgataagggagtacatgcgtcgcttctcacaagcccagtgccaagttcaagacataaccgaggcgtctgtcataaacgccgcttcggctggtctactcgagggcgaactcacaagaaaaatcgccaacaaggagccacagacacttgagcacctacttcgcatcattgacgggttcgcaaggggcgaggaggattccaagcgatggcaagctatacaagctgagtatgataaggcttccgtcgccgctgctcaagcccaagcacaagttcaagttgccgaaccaccttctctcactgttcgccatccccagccagcgatccaaggacaaccgccaaagcaaggtcaagcccccatgacctggaggaagttcagaaccgactgtgcgggcaagactgtgatggctgtcgaagaagtgcaagccctccacaaggaattcgatgcccagcaagcaagcaaccatcagtagcctgtccgcaagaaggtccgaaaatacctctactgcgccttccacagacgctcttcgcacaccacggagcaatgccaaaacattcggcaacgtggcaacgcgcaagatccaaggccgcagcagggagcagcagtcgaagcacctcgcgaagtagctcaagaataggcaccccctgccgaacagcgccaagatgcacagcgcagagtaatccaagtgattacaagggctgacccgccaatccaactatcgaagtgacaaaagaagatgcagctacgaacgatccacaatatcacttcggcaggcgaaggggctccacagtatctgaaccagcaaatctcttttgggccagaagatgccgaaggagtaatgttcccgcatcaagatcctctggtgatctcagccgagatagctggtttcgaggtccggcgaatcctagtcgatggagggagttcggctgatgtcatttttgcagaagcatatgccaagatggggttgcccaccctagcccttaccccagcgccagcctcgctccgtggtttcggcggaaaagcagttcaagttcttggccaagcacagttgttggtagctttcggcacaggtgaaaacaggcgcgaagaacaagtattgttcgacgttgtcgacatcccttacaactacaacgccatcttcggccgtgcaaccttgaacaagttcgaagctatttcccaccacaattatctcaagctcaagatgcccagcccgacgggagtgatagtggtcaaggggcttcagccttcagccgcttctaaaggcgatcttgccataatcaacagaacagtacataatgttgaggctgaactgcatgaccgggtgaaacacgcgccaaagcctgcccctcacggcaagataatcaagatgcagattgatgacgccgaccccgcaaagctcgtatcgctggggggcgacatggacgaagaagtggcggcaagcatcctagaagtactcaagaaaaacagtgatatctttgcctggggccccgatcaggtgggaggtgtttcgacagatcccatcatgcatcacttggcagttaagccggatgccaagccaaggaaacagaagctgcacaagatgtctgctgatcgccaagaagcagcaaaagccaaagtccaaaaattgctcaaggctagggtcatccaagagatcgaccatcctgagtgactggcgaatccagtgctggtccggaagtcaaacggcaaatggcgcatatgtgttgatttcacagacctaaacaaagcatgtccgaaggacgatttccccttaccacggatcgaccatctcgtggattcaacagctggctgcgagctcatgagcttcctagatgcatattccggctatcaccagatccacatgaacccgaccgacatccccaagacagcctttatcacaccatttggcaccttttgccacctcaggatgcctttcggcctgaggaatgccggagcaaccttcgccaggctggtgtacaaggtcctgtacaagcagttggagcgaaacgtggaggcttatgtcgacgacatcgtcataaaaagccacaaggcttttgaccacgcgtccgacctgcaggagaccttcgacaacttgcgcgcagcgggtatgaaacttaatcctgagaagtgcgttttcggcgttcgcgcaggcaagttgttgggcttccttgtttctgaaagaggcatcgagttgaatccggagaaaatcgatgccattcagcaaatgaagccttcgtcgagcgtacgtgaagtacaaaagctcgcgggccgaattgcggcactcactcgattcctctcaaaggcagccgaaagaggtttgctcttcttcatgaccctccggggcgcgggaaaattcaactagacacccgaatgccaagcagcgttcaacgagctaaagcaatacctgcaaagcccgccagctttgatcagcccagcaccaggaagcgaactgctactatacctagcagcttcgctagtggcagtcagtgctgccctcgtccaagaaacagattcaggccagaagccggtctatttcgtctccgaagcattgcaaggagcgaagacaagatatattgaaatggaaaagctcgcttacgccctagtgatggcttcgcgcaagctcaagcattacttctaggcatacaaagtcatggtgccatcgaaatacccttttggcgaaatactccgaggcaaggaagttactggccagctcagcaagtgggcagcagagctatcccctttcgacttgcattttgtcgcccgcactactgtcaagtctcaagtgctagctgacttcgtagccgaatggacaccagcattcgcccttgagcccgagcctgtcgaacagccctgggtgatgtacgctgacggttcgtggtcgcacaggtgggcaggcattgcggcagtgctcacttcgccgaatggtgtgccgattcagtatgctgcaaggctgcagttcgacacaaccaataacgcagcagaatacgaagccattcttcttggcctaagaaaggcgaaagcattaggggttcggcgcttgctaatccgaaccgactccaagctagtggcagggcatgttgacaaatccttcgaggcaaaagaagaaggaatgaagtggtatttggaggccgttcggtccacggaaaagtgcttcaccggcataacggtcgaacatttacctagaggccagaacgaggaagcagacgccctagcgaaatctgctgcctgtggaggcccacattcgccaggcatcttttttgaaatcctatacgcaccaagtgtgcctgtggaaagcctggaggtcatgacaattgaccaggcgaaactgggcgaagatccatgtgactggcgaacatcgtttgtgaaataccttgaaactggctagcttccggaagatgaagcagaagcaaagcgcttgtaactcagagccacaaggtataagatggtctcaggtcagctatatcgctccggggtacttcaacccttgctccgatgcatctcttccgccgaaggcaaggaaatggcgaaggagttacaccaggggctttgtggtgtgcaccaagccgcaataacagttgcctccaaagtgtttagacaaggagtttattggcccactgtgttgaaaatctgtgttgaacaaatcaagaagtgcgaaagttgccagcgtcatggccgaagccaagccgcgccccagtatgagttgcagcccatcgcaccaatctggcccttcgccagatggggactggacatcattgggccgttcccggtggcgtgaaacgggtacaagttcgcaattgtggccgttgaatacttctctcgatggattgaggccgaacccctcggagcgatcacttcggcagcagtacagaagtttgtatggaaaaacattgtttgccgtttcggagtaccaaaagagtttatcactgacaatggcaagcagttcgactctaacaagttcagagaaatgtgcgaagggcttaacctggaaatcaggttcgcgtcggtcgcgcacccacagtcaaatggggcggccaaacgtacaaatggtaagatcctaaaagcactaaagaaaaggcttgagggggcagcgaagggcaaatggccagaggaaatgttatctgttctttgggcccttcggatgacccccacaagaccaaccaagttcagcccgttcatgcttctttatggcgatgaggcaatgaccccaacagagctaggggctaactcaccaagggtgacgttctctaggggcgaagaggggcgcgaggtgtcgctcgaactcttggagggggtaagagtcgaagcactcgagcacatgcgcaagtatgccacaggcacttcggcaacttacaacaaaaaagttcgaccgacggagctgttgcctggtcatcctgtcttaaggaaaaaggcgaacccgatagccgttggcaagcttgaatcgaagtgggaaggaccatacctcatcaagcacaagtccaggacggggtcctttcgactggcgacacttaaaggcgaagagttcgaccattcatggaacgctgcctctctcaaacgtttttatgtctagaacgggtggcacccaaatcgccaacttgtaaaaatgtatatatcgttatgtaagcccttcggcactatgtaagcttttcggaaagaaaaaaaaagaggaaaatgaaaaaagacaaaaaactggatgtagggctattatccaccacggaggctcgaaccagtataaaatctctgtcctctgccctctttttatttgtttgtgcgattgataatttgcggaaaaaccccaaggcaaacgcctgatcagcgaaaaaggccaggggggcgaaacgaatcggccgaagcatcgctcgccgaacgattgaaaccgcaacagcttgtttcggagaactagtcgaacactgttacactcgatcaaaaggaaagtacgagtgcttcctacaacgtagaacaaagcggatcgaaaatgaaagccgaatgctgaaaactcaaaacctatttcgctaatatatgcaaaggggccgacacgttccgacccaacgaaaagcacgcgaagtgacaatgcaaagatagcgaaaaggaaataaaacgcacctttattgattttaaataaaaatgtatcgaagaatacaaacccatcacaatgatacaagtgaaaggaaaagagcaatggcgttacaacccagcttgcagataaattacatcttcgcccccgcgatcactctctctctctgtaaggaataatcaggcgaactaggttcgtcattactactaatatcatacacaaccctaagaggagaagggggcgaaacacagactagactgtaacgacgctgggagatcgcctcctgccgatcagtcttctgatggtttcgccaaaagcgagccatatcctccaaacgtcttgaatggacaagatcgtagtcttctaaggttcgcctggggtgcgcccgaagccacccgacaaccttaaaaaccttatagctacggccgtttatcaccatttcatgataaacaggccgaaataggcatcgcaccttcggcaaatccttaaatgccacaaatttctcgttttgatttcgccaactctcagaaggaggccggatgcacaactttcgacgaacacactggtagacagtgcaaaaagggcaaaagacgaattgcatagtgagaataggccaaaaaagagaaaatattgcataatgcgaaatgggtataatcataaatacgccaaagacttcgaccacaaaaaaagtggctaagagaatcatatattcaaaatatccaaggggccatttttcggctacaataaggagggttagcggcatcctgccgaatatacatcgttcgccattcccgacaaacacaaaaagaagaagggaaactacaaaaatctaaggaaggggcggagggcctcacacctctgggtgatcctgggcatcgcctccacccccttcggctgtcgcatcctcttcttcgcaccggtttgccgcctttgccttcgcgagttgctccaaaaggcgcgtcttggcggtggaccggccgtctttctgccagaactgttttcgccatgcacgaagcgcgggcgaaatgttctgcgcactgatctcccagtcccccttcgcatagttagggaactcggcgacgtgctcgcagccgaactgttgcagaaggcccatagtaaaggccaccgatacgcgcgcacagcaatcgccgtacgcagtggtgaagtccgaaaccgaaccaccggcctgctgagtccactcggagaagtcgaaggccgaggcatcttcggcagggacccctcgcacctttgcacccatgtcagtaagggcgaggcgaagcgtttggcacgtcgttctcgcggattcggtagttttcgccatctcccgcgaaaactgctgtgactccgccgcagcgttcgcgtcggccttgctgacctccaggcgaagagcctccatctttggctcagtaagattataataatccgtcagcacggcggaatgggctttttctttcttcaatttggcctggaggcgatcaacctcagctatggcctctcttcctttctccagttcggccttgaggcgatcgacctcggccctagcttcctttcctttctctaactcggattggagccgcttgttttcggctttcgcctctttcagggtgttggcgagggcctccacctgcaagttcttgcggcctatttcgtcatccttggcccgaagacggttcttgaatccgtcaagacgggcccgcacggttcactctgtcgaatagtgagctacaagaatctggatgcaaggtaggaatgggcaaagagaacaaatgttaattatgtgacatgtaaaaaagaagaggaaaatcaggaagagagaaaaaacatacccgaactgccaagcttttaatagcagaacacccctcatcgaactcattcaattcggtgaataagctcagggtgctggcaggtaagacaagattgcttactccctccacaaagggaataaggtctgcccgggtctcgaaatcgccaggggcgaaatggggcgccgcaagggaatactccgaggcagatgtttcgacggccgaacccttccccttcgctttgactagtggtgaaacaaccggttgacgcagagggctaccgaagatcctcgccgcagctgccacgattcgttccgcggaggctgaagccccggcggcggcgctaccgcctgccccaccagcgccgatggaaagaatgggggcggtcgaaaggtccaggctgcggccagtgggcgaagtcggagtctcttcaaaagactcgtcgtcgctgaagacgcgagcgacatcgacgagtcctttctttttggagatctttttgaccggacctcccttcgccgcccggcctgccgaaaacgcaattagcgccttcgccccatccaaatcctttcggcgaaggggggagctgttcgactccaccccggtctcgttgtgacctggacttggagtaggagtgtagccaggggtgtcgacgcggttttcgactgccccgtccgcggccttttcggccacgacctccgcctcctcatcttcctctccttcctcctcgtcgtcacgctcttcgacgtcctcctcatcatcggcgtcggaatcggacgaagcaggaacccttcgcttcctaggggcaagcttcacttgcccacgcgttcgctttcgcgaaggtcctacatcgtcgtccgccttgtgggggttcacccgtggaggcaattcgccgttgtaaacccggttcgcctggccagctgcttgtcgcgtcagcagctggctatactcgacgactgacacgtcgccgatcatcctacgggcttcggcgtcagcctggtcgagggtcaacactacaaaaataataggtgtagccacatcaagcgtcgaacaaagcaaaataacaaaagcaggagtgcgtagcgaaagagcactcttaccgttcgttccctcggggagaaccaacttcggcaaaccatcaacctcttcgccttgatctactgcgacttgccatgattgagagaggggaaagatgcgaagcatgcagaattcctccaccaagtcgcggcaactaaggcggaagcaaaccttacgcagcagagcgaatcacgcctccatagcgccgtccacagcgatcttgggttttcggttcggcgcaatcgccctacgccggcaccggagggccttcgctgagtcagaaccagcctcgaaggggatggtgtggtaaaaccacctcgccatccaatggcggtcccacttcgacatggcggcattcactggccagagatcggaccgctcggggcgaacattaaagtttacgctcccgaacactgatttcttcgtcccagccggggtaatcaccgtcttcgaattcacggtggcgaaaaatatggcgccaaaaagttcggcgctaggctcaaaactggaagtccggcacgcccagtcgaagatagcgatccggaccagcgtcgatgggcttaactgtgggagctctacctggaaaaggcgaagaatctccggcaacaacgtgttgcacggaaaccggagccccgcctcgaaaaacacggcgaacaccaccgtccagttgtcgacgggcttcggtacaacggctttccccggggcgaaagcctgtccctcgactaacgccccagagctgaccaacttcgccagctcactgtcatctatgagagaaatccctaagtaggcggtggtgtcgtcgtcaatccggccggggtcaagccctttcgccgaagaggggttaggcttgcggggagccatgacgaaggatgtatgcagtgacgaagggtgtgtgcagtggtgaacaaaggaaacgaacgaaaggtctaaagggccaaagggtgccgtgagagcaagaacggaggaagagagcgcgagcggtgaaagtgacaagtctggtggtgaaaagaggacgggggagaatatatagcccacccaagcaacggttcacctacccaccagtaataaagcaccacgtgtcgcgagggtaggcgaaacggtaaattcctatcgaccgagctacatagtaaaaagcccacaaagagaaggcccattactgttcctttcggcccgggaaagataaaaataatatacaaccgcctgcaggaggcgaagagcggcaaaacaataccagccgcaaagacaataaactttatttgtaggaacaatgaaggttttggaaggagcatcggtcgaaagggggcgccacataccataccacatggtttgcacggtctcggccgaagctccaatctcacccttgcccgtgaggggcttgttggcggtatggcatgaggccgttcgaccaaaatctgccgaaagctatgcgaagagtggggattcaagcccgagacgtcaaagttagtcggggcgaagtccccacatggtgaagactacggaacaaggacgacgagaggcaagggatcacgcgggtactctgccaagctagaggcctcttgggcgaaggatgcagggcgaagagtatatgctgaagggggacgacttcgccaaagcaaagctcgggccgaagaagcctttccggcccatcaagcctaggggctgttgggccgacgatcgcctgacgacccatcaagggcccttgaacctcattacactatgtactcatgtaaatgtccctttcataggggtaaccatgtaaatttccctgtataaccaaaaccctagtagtaagaacctgtaataggggctataaatagtctcatagggccatgtaataaggggatcccaagaaaaattctctaattaatacactttacttcttttccaaccattgttgagtaaccacgtctttcgacgtatgcggttgtcgtttcgacaacagaggcgtacacgcataaattggactgaagaagagaatctacaccttcttagctattggatacattactcaactgatcctgtaaaaggcatcgacaggaaatcagaattttactggaaagctgtagctgatgtgttcaacaccagcgcgccaacaaatggacacaagaggtcagtcaagcaactgaagacacattggggtgatgtgaagagagatataacaaagttctgtggagtatatggtagacttaaagctacctggaagagtgggcaatctgatgacatggtcatgaactcagcccatgcgatattcgaaaaagaaaacaaggacaaacctttcaccttggagtacatgtggagagaggtcaaggatttgcctaaatggtgtagaatagtccaagaggatagtggaaataagaggaccaaggtttcatcatcagaagcatacacttcttcatctaaccaagacacaggaggaaaccattagcaaagagaagcgccctgatggacagaagaaagcaaaggccgggctaaaaggaaaaggaaaagatgctgcaccatctcctttgggcaaccaaccaagtcagaatatgattctatatcatgaagctatgtcacttaaagcaacagcaatgataaaatcagcaaaagagaagaagtaccagacttacttaaaactgttggagaaagatacttcaaacttcagtgaagcacaccacaagaggcatgaaggagtcctggaccaattagcaaaagaacttgctggggagtaaataatcagcaagtgatgcttgtactaccattacctattgtgcttgtcatatttagaggtgttgaaagtgtaattttcatatttagaagtgttgtaagtctatttgtaacccttaagttagctattgtaacaggtcgatgctctatattgtatggccatgttgttagtgtatgtgtaagccaaattaatcatattgaacagtagagaaatcacctttgtttatccttagttttgatccatgtcaaggtccatgacagttgtggaacagggcataaagcaaaataatatcagttgtaaaataatatcagtacattataactgttgtggaacagggcataaagcaaaatatagctgttgagaaaaagacaaacaaagtacagttgttgagaaaaagacaaacaaaatatagctgttgagaaaggtggcaaacaaaatatagctgttgagataaagcaatagatagctattggtatttagcagctataaatatgagatgcagtctaggacaccactccctcattcatacaacacacactccctcattccaaaaaagaagatgtccagtgactctcaagatcaatctagtcattcagatgagtctacagaggctcagcttgaagctgagcttgaggtagagcttgaagctgagctgggggctgaattggaagcagaatcagctggtacctctattcggcgtgggggctacacacggaggtacatcaatagagatcatcaagatgatcacaacagattgtttgctaaatactattctgccaatcccttgtacaccgataatcaattccgtaggagatttcgcatgagaaagcatctatttttgcacatagttgaagctctaggtgtctggtctccatatttttgtctacggcgagatgcatttggaaaggtgggtctatcaccactgcaaaaatgtacagctgccatcagaatgttagcatatggttcaccagctgatcttatggatgaaacatttggggtcgctgaaagcacaacactagagtgtttgatttattttgctaagggtgtaagagttatatttggctaacaatatctacgaaagcctactaatgaagatattcaacgtttacttcaagtagcacatgggcatggattccctgggatgttgggttgtcttgactgcatgcattgggagtggtagaattgctcagtagcatggaagaggcaatttacacgtggtgattataaggtacatactataatgctagaagcggtagcatcttatgacatatgg

SEQ ID NO: 34771 - DNA, 5724 bp, Oryza sativa
tcacataggccattacattttctatcacatagtgcaccacatacgtcatactactaacaaatagattaacttcatagataatcacttcttctgttggcgccgaatagcttgcgagcccggagtgtacctacatttgaaaatccaatgtttaaaacatttaaaaacaaaatgagggaaatcaaataacatttgagaatggtaaactcatttacctctttttcgctgcctgagtggatcgcaagttgtattgggtgggttgcgtcccctgaggcgcatcgggaagctgcgacatgtctatctcctcagcgtctggtgcgacgtagtcctcatcctcctcgtcatcgtcgtcgctaggtggagccggcgccttcccctttcccctcccttgtggaatgcgtgacgacgacaaaccaccaacttcttcacgctcttctatcctgatggagtgtcgagcgatacttggacgacgaaccaccgtagtaaacacgaacaagtctatccatctacaccaaaaaatcaaatgtaactttacaactaaaattaaatcttccttcctaaacgtagtccaaaccgacatattataaccaatgtataacttaaattgtctcaaagctactactccacaaaaaaatatttaatccacctacaaatatcaacaagtttactagcgcattacacatcgaaatattacaaatactccgtcatacaacccaacctagttctaagtaactataattaatttctataatgcaaccaaaattttctccccttcatataattaatgagtaaaagtttaacctataggctatagcatcaagtccatcaaattaaaattactttcatgcctcaaccctaatttttcatctatccatctaaccaaaccatccaaaaataacattaccacatatatggttcaaaaaatcgtgacaccaatgagtacattgcaaacatgtagcactacaacaagctaatcccaagaacaaatgctaaaaatcacaaaatttgggctaaaaagaggttctagggttaccctccgatctacaaattcaaccaataaaaacgaaaaaaaaagaggggggaatggaggagtctacctttctcttcgatttccacaaaaaatcccgcgaaaaacgagttcaaatcgagtggatttgaggtggaaaggtgagggggagagagagggagaagaacagcaagcagcggctcaggctaggactcaggcgaaaatgggagtggggaggagaaaggtggtggggcccacggggtttaagggcgcggcccacagaagaggggcgcgccagccatgctagcgccgtcgtatgaggggcgtcgccagggtggctggcgcccccttctgctcagtcagcatcggcacgacagctctagtgtcacggtggcacgggcgcggcgccatggtggctggcaccaccatgttggaggacggcgccagccactctggcgccccaaaaaggaccattcctggtttaagtttttccaggggtctatttgtaaaataaatttttaaaaatgatcaaaatgtaaaaattctacacgaggcagcaggacgtgacaaacggatcccgtgactccgtcggtgacgaggaaagccctcatggttactcttgtttttttatgctacacaaatcgttataagaggttgaagaaaaaaagatatcacaaacaaattatatctcaaatggtctacaaaagcttaactaattccaaaaacatgttttacaacatgatggtgtttcctaagaacattaatgttataaaaccagtcccaaaatcaacatcggtagctaaacgtgaaagaaacgccataggagatccaaacacgatgatgacaccgaggcatgatatttggtaaaggagttcagccgaggcctacatctccgaggcactgattacgggcgctcctcccggatccagcatattacagcgtatcagagttacaacgactcacggccggtcgccgctagcagctgctccctctcgctatgctaagtcaccatgcagttacaacaggtccacctctctatttaagagagatccaaggatagagtccgactcttactctattccaatttctaaactgtaaccgactatatacacatattcgacataaactctaacaattaaaataaaaaataagagtgaatggcaaattggactacatatcgtggactaaaaccacataaatttgcagtcttgcagattagaaaggggcgagaaacattgcaccaaacccccaaattgacaactcaaatctacataatgtaaccaattcaatcaccatataagttagcaccccgttcctattctctatcttgtacttactatatttggcaactcaagccatataacacacataatttagaagaacaaatttgcatggtgttaagtgaaaaggatggttatgccctagttcaatgcgaaactatggttaaaatatctagcctaacgagcaaatcagtctaagaataaacaacttctccttttcacacaaacaacattttaaagtaattaatttcacgagaattaattaaactaacacgtatgaaaaaaccatgtgttctaaggccatggccaacgctccaagctagagcgtggtctagccctgcccgagggaaatattcatgccagctcggatgggaccgcaccctagcagaactacgcgacccacagcagagcgccgcgtttcgtcagagccgtagcgaggaaagcgtgaggaaccgcattgggaagaggcatcgccccgtgtcgttgccccacaccgggaaagaagatatggcgaggggatggatgggagagaatggcctacttgggaggctcaccgatccaccacctccgggcctgctacttggccaccctgagcaccgctacatcgatccgccgccacgttgatccccacctccgccgtcgattttctgtcgttatcacatcgatccccacctccagtacatctatctgtcgtccccgcatcgatcaacgccagggaggtagaggggagctcgagctcatcgccttcttggcggtggcgtcaaagagagggagggcagaagcggcgcagctgagaagggaaagctgacgggagaggtggtgtcgccgaggaaggggaagaggagaggcgaaagaagacagggagagggaaggtgtgggtctttatatatgtttgtgatatttaggggagcatactacaaatattgggcttatatgcgaatagaaaaacacaaggatttaaatgcaaaatatgaccgactaacaacgtccgaaacgcaaaagcaatatgaaactatggttggcactctattagggatatcacaagtgtggttttatcccatttttagcatcttctttcttatgggggctatggcttccaatggccaagcgaagctattcatacataaaaccttctcctgaagggatagcgaacgaggctttcttggcagataaccgcacaaaacctaccatcatacaacaggccactactgtcttgtgtcctcggaaaccggttcgtcccacggtacaccatcaccaactctttaattatttaggtatatacatctatcatttctataatatataacatgcattcattcacatatttcgtagcaaagcgcgggatatcaactagtctgcatatatggctcagacatgctaactagctaggcctggtccggaaagcccgtggccggtgcagttcaatatccagcctcatgttggccagctgcctctctctcatagcaaaccagctgatgaagagccttcaccaagcacaaaatgtggctgcctgtcctctccttgttggcatagaacaatgtctctatcttgctcaccctggaatctgcagaattattcgatcggcttctgataatattgcagtgaaagtcttgcacgtcgtcggcatcctccatcctggtccaaagaaacaaaataatgaagggatgttggacaagctatatctgccctttgtcttgcatgtattttgcatagtctaaactctattcagttttcatgcctaataggaagttggaatgccgtggaagaactgttattccttttttttgttttgctatttatcagttgccaggaaatttcttatttgtcagtcacctagaggtcctagaccaactgcagtttagacttgcacaaaatcttttaccaactttggtgcatcttttaatctggtatgttctttttttttaagagttcacccggatgcgtgtttttatatatgatgattttgctcactgtagttgcctgaattttttttcttggttgtcgttccactaaatttgtacggtgtgttgactaaacttgtatactcttggtacaacctttttgttcttttacagattaaattgctaatttgtgagttttggatgttgatctacttagaagagtgactaatgacaaaaaaaactgtcacttaacaaatactccctccgtcccaaattataagcctatattttttctacatggtcttcggtgacatactttgaccattaatttattccatgttatgtttccaacaaatataaaattagcatcagatgaaagtactttaaaatataaatctagtcccaaattataagcctatattttttctacatgggcttcagtgacatactttgaccattaatttattccatgttatgttcccaacaaatataaaattagcatcagatgaaaattagcatcagatgaaagtactttaaaatataaatctagtgatataacatacataatatttagcatatatatggttaatattattattcgtcaaaagttactgagcttgatttttttaaaaaagaagttgccctataatttgggactgagggagtagatggtcactctctaagtctatttgatgagcaccactgattggtggtatagccaccctaatcttgggctaattgaactgatggaagagacaagattaattcaaattaaatgattaaagctaaaccaaacaaagagttaaatgatgaacaacgaacttaagaaataaaaagaagtgaaactagttaggctataatgctctaccgtacctgttcatcgcctgttcgctagctccatcattgtaactaggtcgtaccccccgcggcctttgccgcggacccaataaaaagcataaaaaaactaaaggatgaagagacatcaacaaatacaatacaatattttggtaaaataagaattgtgtggataatctaaacattgcaaacgtataggagtaaaagatagcaaattagatgtgcctgaagccctgaacattgctaatagcatattagtttactaatgcatacggcgtgtcaataatattggcaaatgaacaggaactgcagcatctcaatacacacattaacaaatacggtacatcataggcataagaacatcatcaaagaccaagtgtgtgcatattggtggtagcatatacaacctaatgattttgcatagtgcattacatatagaggtacgcacaacaacaaacatggaaaagtttgtagcattgtaactgaatgaaggaaaggaaatgataatggtcagcctctgggtttggttgtcgtttgcaactttgcatcgatagtagactaccaggataacaacaaatagatggcaccaataaacaacttgatcaacctgcatgaacatatgagaaaagggaatcaagtagaatgccatgatattactgccaaataatcaaaaaagaatgtgttc

SEQ ID NO: 34772 - DNA, 8502 bp, Oryza sativa
aagctgttttgaactatactgagctcagtatgcatacataattatccgtaatctgtttcagtaagctgaaaataaaatgagtaaatagcacatactatagtgtgctttaagaagtaaagcacaatagaactacctcttgtgtgtgtgttcgtgtatgtggaggcacaactattcaactgaatgtagtctgtttttcgtttgcagcagtcagcgatttataggaagggagaatatatatgcatcaatatttcctgtatttcgtgccatccaatgcagagtttgagaccatatgacatgagggtacacaaaaatgatgaacccatgtatatccaagggaagatcaacaaataataactttaaaagaaaattacctttgtatttaggtgaagaactgcacactacagtgggaacatacaaccacacggaagaagcataacacatcatatatctctcaatttgatgattttgggcaccatgcactacaatctggaaatagtgaaatatatagatgttagaccaatcgatgcaagatataaacatagaaacatagcgatgagaatacctggtaaaattaagcacgttgattcgcgatatcgctgaatatttcagtatacacgacattatgtgggatgaagcaatattatcgaattagtcctcaacgctgaattagtcctcaaagcaatattatcaaattagccctcaaccaccaattttgacatggaagccatcaccacatgtaattgcagatagtagcctcacatcacagctagcggcaactgcaggaaacagatcaagcaatcagggtcaggcagagcaaaaccacagagaaaaaaaaacagggaaaattagagtgggatgcttaatttcttaacctttacagatctctatgaattgaacagggattgggtactcaggtctgatatagggggcattcatggcggaaagacttcatggtacataaagaaaagtaacactacaaaatatagaacaaaggctaacaaatttatgacacattggttgttagctcacctcttatttgttttgcctaatatagcggcctttccctcacgttttgactcacaaagaatatattcgacaggacatggacatgatgttaaggctatgcactcacccaaatcgaactggttcttaacactattctcatgcactgatgtctggtctgacctagatggatttaaaggaaacatgaataattcaagagatagaaggaaatacatggatagtagcagcacacacagctagagtcatagaagctagcaggcagtacctctgaacccccaacccctgggaaaaaaagagcacaaattacagatgcaaccaatgggtggaaacgatcctcctaacacaccatcggatgttctatattttgtatcttgcttttgcagaacttccattgatagtctaatttaaattgggcaacaaaataatctgtcacaacattgatatataagtccattccaatttgagctaaattttatatgtaataatgaaaaacagcatatacaactattttgcatcataactcataaatttaggtgcagtccaaacatgaatttcttgatcttagtttagttctcttggaaactactgcacaatgtagccctcgagcttcggaggcctgaatctccaccaggtgtcctctaaaaaatgtgactactacataacattggtttaactaaatggaagcaggtcagcagcaggctgagtggaggagacgcagggaacctggtgtagcagcaacactacatgactgcaaacaacaatgacggggaagaactacatgactgcaaacaacaataacgggaagaaataggtcaggtgcaggaaggagaggattgaaggaggattaccacggattgggctctcctggaggagcctgagatagctggagctgcagcaatggctacgacgacccgatctttggatcggttgtggggggaatcgaacttgaagggacaataaaaatagcttggagggactatgaaggatcttctagaagtttcaatgtggggaggagcttcgagggtggccaggagtcgggctcagatcggcagcggcggcgaccatctcgtcccggtgacgaaggcagcttgcccagtatatcgtagctgttgcaaccgccaccgccgtcatcgccgtcagatccaccacgggaagccgttgccgcgggtggatcgggccgggggaaaccgccggcaccgtcgtcgccgtcggatccaccgcgggaagcggccggcgccatcggtgccgcggcactccacccctctctcttgttttccgctggtgccttcatcgtcttcgcgccgggtcggtgagacaggagggagaggaggagagggactggcgacgccggtgaggggaaggcgcggcgtgattacggctagggtttcgatggacggccaaaacaactcgcggaaggatcggacggccaaaattagagtgaacagtggaacagtgccaggctgcgcaacaccgagccgtacctcaccgaaaactagagttttttttttctatcaaaaaaaaagaaaactagagtttttatagatacaatctggtaatcacggagaacaaggaaaaggcttattgaacataccacccattttagaaaatactttgaggcaagtcaacaaatatatcagagcaagcaacgtagctgggataagattgttacgaaacgcattgtccaacaaaatcataattgtgatagaaatacaatacaattaacaacccttgttgtggcattgcttaatgttatttgtcattatgagtttggattgaggcataagtttttgtagacatttaagttttcagaaacatctgctactgaaataagaaattacaagttaattctccacgtgtcatgcattacttagttgacaaaacagtccatattgtcagtatggcagattctacattcattttctagatttctctatttgtattgtgttcttgtccatgtgtgtttgtcaccattagatgcaaattgaacagtacagattgagattgagatgatattctaatcatgtgctgatgcacctttatttttgctcatttatacaggatgaaggaggaactaataattcatatgaaaacatggctagatacatgtaatatttagaactctcttcctttgtacattctattatccactcgttcttgtacataaccttctatgcttcttaatttatatgatcatctttaatagttaatattaccttgtggattcagcaattggcacaagccattgcaacattctattcatttcagctctgacctcttcttcagatgtctacgataaaatattagtactgagatcaaatttgaaatagatgaatactgtatgatatttctcatgttgagttgttgtaaaagagagactaccttatctatggacaaaaacggcttcaactttctataaaatactaatttgatgcaaggaggaagcatttggtataatgcatctttagcttccttaggaacagacttcaagactgagggatcggttttctcaaaggccaatgcctgaaaacaatgaagtcataaaaaaatataggacaaggcataatctaaagaaagaacaatgtcaatatctgaccattaagtggtaatttaatatcatttttcatgttgaagatggcatagcaccagagaaacagtgatgtaccagtttatttatctgcaaaataacttttgaatattgcaaggcaagtccagtggaacctaacgtttccccaagcaggttgcccactgcctctacataatggtcttcaccagtatgcaaaaaaactttgttgatctccaaataaatgagcagcacaatgtctacaagtttttgtacaatctgcaacagaacatatggagcattattgtaagatatggatcagatagaacaaatattgatgacatatcaagatgttgcactacatcatccatcttcttggaccaaagtgacttcttctgcaggtttgccacagcaatcctttggttcttcactgaactaattgttatacctgcatacggcagcggttttattgaaaccggcaagagaatattcacattaaatttgtatcttatttggatgcctatgtcaaaaatttaatacaaagttacaaaccactttgtaccactgtaggtttcccctgttcgaacttgtccaacacacacatttccttatacagttcctggcaattaatagaatgagagaacagaaaaggcaacaagatttcaaaaagacaattatcatgaattagagagtatgaatcactgaccatggtgtattgtgcacgttttaatagatattgcattgcagaaactgcttcttctttgctgcatgccagttctgattccaaaataacgtattctcgagatttgtaaagtagctctaatctacattgacaagaagagcaaaaagggatacatgaatggagatgaatcaatgagctccactataaattagctggtaaaaattcatggtaaaaagttgtatttgcagggtcaaagtagcagaagaacattatgttttgtttacttgttaaaataaagatccaagttgcgccatacaggatctttgcacagctttccaagcctaataacatctaaagcaaatcttctcaactgttctctgcatagtttgcagtaaatatatatataagtaatcttggaaagttcatctacaaaacatccacatgaaaatgcatagcttaccttatgtcagcttgatgaataatgagcaattgatagtactgttctgaaatcagagtgcggacaccttcacactgaagcacaacttcattcagatgactcacactttcttcagagagggatttcataaggtttgatccactgacaattgtgttggccacctcaaaggccaggatacctatttttctttctccagaagcagcaccatcagatttcatcatatttgagcccctgacaagtattttggctactccaaaggccatgatctctatcatacttcttcttgcaggaacacaggacacggcggcggtgctttcggtgttcgaagtagatgatctagcccccagcatgctgtcaacataggttgcagcaatgacctgctttgcagtgtttgaggtcgatagtccagtccttgctatggttaaatcatctaataagtttgcagatttcatggtgaacatttgtagtgcctgtatgacaaagatgtgtcatacttagggatcatgatttttctatatgaagtataatgtgattggagaagagtaaattacatgcatgaactccagttgggaatgcagattttatttgtatgttattgttcaaaatcaaggtgctggagtcattgaatgacagttgtacaggcacataggaaatttccaaaggaagtaaaagaggcacttcaatccataaaatattacaaattaaataaatattttaattttacttttaaaatacttgctaatgcattagaatcttttgaccgatagaaagttatattgaaccaaatggtgcatgcaccagcacaaaaaatttgcatatatattcactccaaatttcctatataatttattgatgtagattataccagcaatttgcacttccgaatttgtgtgaagatgataatatgtgtgtaaatataatagtatactgagacagactacattttatattatgatgccactgtctattttgtaatttacaggaaatatcatatatgacaaatttatagacattttaccatgtgttctaacatatcctctattgaaaaattcgatggaaatcgttatgtgttaagtgtaaactatagataccgatgcatgacactcgcattataaaattttatagtttattttacaattgcacattactttttatagtgctctagtaactaacatattctaatggtcaaactcctatgttcaaataatctgcgataacaagtactccctacccaaaataaatcaacttttgtacacaaatctgggcatagctatagttttgtacactatgtaatcaacttttgtacatgaatctggacatagctatgtccagattcgtttacaaaagttgatttattttgggacagggcatattatacaaaatatgagcgccaaaaaccatattgtttctattttcatataaactaaaagaacatccaatcctaccatatgattagtttgatttggagttcctgtggacattctatctttacagaaactgaaattataatcatccattcccaacataatatgatgagctctgttctgtgcagagttcctgtggatagtctcttatgtttccatgggctctaaaactagctctatgtaacaaaaagaacgcttgttctacacctaaatgtttttgtagataatggaagataacatccaggatctgcatcacacaaccattctatacctagttttagcacaaggaattatgatagagcatgggatgagtaatcttacctggcctacatgtgaccaatttttacactctgtttcgttaagcttttggattacatttcaagcactaggccttttctttgggtcaggatcaacacaagcgagtcctatctccatgcatgtgtatatttgttggcaacaagtcttcattgatgtgcatcccactgttcgttccaaccaatccctccaattcttaactacctaacaaattttcatagtgagaaattatgaaaacactagcttaaaattaaattcatcttacatcctctatgaaatgctggaaagattctctggtgcatatccgaggataattcctgtgtcctgttataacctcgatgattatcactcccaaactgaatatatcagatttggttgagattaatccattggccaagtattccggtgccatatatccactacatcataacatggaagttaattagaaatgatacaagaactaaacattgcagtatgtacttgacaaacttatgtagcagtagcttacagtgttccctcacgacttccagtgataatccgtgattgttcatggccgaaaagccttgacataccaaaatccgcaatttttgggcccatatcgtcatccatcaatatattttcaggtttaagatccaaatgaataatatggcattcctcatgaatgtattgcaagccctaggaaattcccctgattattttgtatctcatgtgccacccaagtccataggattcagctataaaagtatatcaaagcacacgcacaagcatacaatcatgtaagaataagatcacccaacacttgtattttcaacaatgccacaatatttataatctaaagtgataagcatgaaaagagagataaaaatcattattgtaccagaaatatacttatcaaggctcttgttatgtagatactcgaaacaaagcaaccgtcttggcatttcaaccatgacatatttcttgccattcacttgcaacacttcccaccgtgattcagcacagtagcctgtaaatcgtactatgttcgggtgcttgagatccataaggaatgtaacctcgttctgaaatttatcatctttcaacatgtgtatctcgaggagcttcttcacagcgatcatttttccattgctaagaattccctgtttatataaattgtctttcaaatcttttttttatagagaaggaatgtaacctccttctgaaatttatcatctttcaatgtgtatcttgaggagcttcttcacaacgatcatttttccattgctaagaataccctgtttatataaattgtctttcaaatcttttttttaaagagaagggtatttttttacccggcctctgcatccaactggatatatgcagccttttttaaattaggaacttagccctcaattaacccaatctgaaattcgctcctatgaagatttgaactcaggaccttagggtgttactcaggtcactgcaaccactaggctacatgcctggtaatacttggggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagaaaaataatattgcacacagatcaaatttttttaacttatggctttgtcacaagaacactacagattcttccacagttaacttggccacaagaataatacggatagaagtagtaaaaagggcaaagctatatgctaaaagaattccttgaaacaatcaaacatctttttgaactactttattacaagttcgaaccaaagcatatcaattatttaaataatatctaaagtgcatgtttcattcttaaactatttagcttgaatgcatagtaattattcaaacatctcagcaaagaaattacatagcagctggatagttttgtattatccattgggtcacatattcctta

SEQ ID NO: 34773 - DNA, 980 bp, Oryza sativa
  unsure (1)..(980): unsure at all n locations
ccggtgtgcttcgagctctctcggggaagcatggagatcgcatagctccttgcttcttctgggcttagatggcttgtctctggaagttgtatcctgctgtactcgtggggttcatccctgtgcatctcctggattacttggtagtcataggggaagaaccacctttgaattctgagacaaataatgcacatcaggatggtttatattcagttgttttgtttataccatggaatgctttaaaatcaaaaggctcaaaccaacacaatttaattggaggaatcaaggaagagctagtaataagtcagtcacaggctcacagctagaaaagtattgagaaacaaaaggggcaacgtgataacaaagatagggtatcttacgataaatataagaagtcgccaaagagagcgatgattggaacaagcaatagtgtgaggtagaagaaaaacgtgctcatcaaaacataaatcacaaaatatacattttcctgcagaaagaaaacagcacgaagttaatgcagttataggaataaaatagtcataccagagcactggatttttcagtaatctatgaactatcccacctgtctgtcgaatgatgtcattattgcagagtagatgaagatgaacataaaccaggctgttatactgccagctacactgatatagtgccatcttgttatagagttgcatgacattagaagtcggagattcacagtcaccacaacacaggtgaaagccattgtactaacatcccaaagaccaagaatcttgccggatgaaccatgaccataccgacttgcagctgcagtgaagtaatagaacactatcgactgatagaaggcaaagaaagcccacactgctatcaccctccacttgaagaatgtattcctgattccttcctggtnnnnnnnnnnnnnnnnnnnnnnnnnnnnnnnnnnnnnnnnnnnnnnnnnnnnnnnnnnnnnnnnnnnnnnnnnnnnn

SEQ ID NO: 34774 - DNA, 383 bp, Oryza sativa
cttttggcattgtttgatgtgtggaatatgtgatggattatgtgaggactatgtgatggacttttggcattgtgatttgtgcaattggaacttgttttagtctgtatgaaactatgaattgtgatttgtattgcgaactgtgaattggtacatttgtgcaatatagattttcgatttgcagggaggcagagggcggcgccaaccaccctggcgccgcagttggggagggcggcgccagccaatgccacgaggcagaagggtttcggggggaggaaggtggcgccagccaccctagcgccgcggtccgtgaggacggcgccagccgtggcccagaggcagaaggtcctaggggggagaggggcggcgccaggatggctggcgcc

SEQ ID NO: 34775 - DNA, 2175 bp, Oryza sativa
cccggcccaccaaccgtaggccaccaggtcacattgagcctgctccaccacaggcccaaccggagccataactttaggtcctaggtctacacaacccaaaagactagtttgatgggtgaggaccgccctcaccttttaaatcgtgctcctccatcatcaattactgatgtgggactaaacccaacaatcttccccgtcacatcaacccatgtgacccctaagacttgttacttgggcctcgggtctaacaatttcccccgtcacatcaacccatgtgaccccgaagacttgttacctagcctctccactatgtgactcatggaaattgttttgggttccaaaccttgggttctgataccacttgtggtggaacaggcccaatgtgacctgggtggcccacggtgggtgagccgagctgcgcactcaaacatttactactatgcaattcaattttattattttttgcactgtctatctttatgaaaagagttgcttgttgagtcactatatatatcctaggtagaaaatttgtgtcacgatcttaatggagtctcacatggatacaccttttttcctctcaagccaagatacagatttgcccgtaggtattcaaaatctccctcacctgaagtttgaaccaagggaactgctcttttgaactcttttgttagctctgttctgtagataacaagctattcaatcatgtttcaaagatccccttaacatatatcatccccttctcactgaacttgagctccttcctcatctgctccacttggacatcatcaccccgcacaagaatttcggatacattcccgtcatccgataaaatcattttgaccttgatctcttcttttcttgatgcctttgtccagtagtatacacccctgaaccatcaagaagggacaggttactacatttgacctggaaatttcattctaaatttctgctatagagttgcagagacatacgccaatgggcttaaggtcataagccagaaccagttgttgccaccctccgggactgcaattgatagaacaagaccgacgctgccaaggctaatgcaggtgcagaaggtaagaagtgctgcttgccccctgctcggcaccatagtgccctcaaaactgcgcaaaaaacataaatcgtgcctcattttgcattgcattttgatgtgaaacaaaatgcataagcttatgctagatatgcactatataaacaacatgggcagctttacactgtacttctctacggtaccagggcaaaactaataaatacaactgctatactagtttgggtttccattctattacaacttccaagtaacttgtgagtatcagaattaatgtaattctagcgtaaagcattgttaagtagaaaatattacttgttcatatctttgcttcaatcaagttctgtgtttgaatcaccaaattactatgattgttgttatggtggagatcactgtgaacctaaaggtacaacccacaacatttggattgcaagaagaataaagaagcacattaacacagctggtgtatgtgtaaaactgttgtacaaagtcccaatggtattgtcacaccgtgctaaaagtatagtccaaaggttatcctgtacttctgcatatcatagtcataactcagtagattactgcattaggatagaaatccgatctggctacttacgtgataacctcgccacggtcagagatggtgaagttgttacgggtgaagaacgagaggatctccccagccacctggttcggcgccatcgtctgcccttcctccttgacgaatgtcttctgcacaacctgcactagccaatttgacatagatgacaaccacacactattggtggacatcatgcgaacagctcaaaccgtcagaatgaaaggtaaccacaatggttcacgattggtggatggaactagcaaacactaatttactagtaccaaaaaaaggaattcgcacactaatccacagcacatctcgcttatgctgctgtagtgtttttacttctcgtacaacttttttatacttgtatatataacttttactcttcatgttttgaatgagactagcatgtctaatgccggttaaaaaaaaaggcaaaccacacaaccatgctactgttttcagcaacgaactaaacaacatcacctaaagaccgcacaattca

SEQ ID NO: 34776 - DNA, 473 bp, Oryza sativa
tcccacgaaagggagtgtgttctgtgtctttgaggggcttccaggcaatgggagtggtgcaaggtgaggtcagtgaagtcgtcaaggcccaggtcttagaggacttcatccatgtggtaaaggctttggccatttcacagagtggaaagataaggcttgggggtttctgggggaggagttgcatgatctgtttgtagaagttcatagaagttcactttggctaccatgtggagaatagcctgggaggggccacagcagcagcggggagccctgtggggataggaggtggtggcctggggcacatggcagtgctgggggtggtgagaaatagtcagattttggatatattttgaaaatgtcaccacaccaagtggtccataggtatagggggtctaagcagtagctcagaggctgtctgatgtcatcacaggtctggacacttttcacccaccccctccaccttcctcagtggt

SEQ ID NO: 34777 - DNA, 1757 bp, Oryza sativa
gagacagcgcacgacagcaagggcactcaacgtcggcaacttttggcacgcaggcttaaatcatattgctggtcgtcgagacagaaggcttggttgaagcgtgtaacaaaggtgcgtgtatatcggttggatcgggccggcagggtggtcagacccagtgccggagccaggatttcaaagttgggtattcccgtctaagcactgagccgttgcctgtccttgcccctcgcggccgctggccacccaaccgacctgaccgccttagcttggcggagtgtcgggcgccgcccgccgtggcaatggcctccccctccgcggtagcacggtccagctcccgctgccgattgccgtcttgccgcaccgccacctagggtttgcaaatggggagtggcgcgagggagccgagccagggagggatgggtcaaggagggagagcgagagggggctgtctggaagagtggtggctaagtgggtcaactgatgtctgatgggtcatgacggagtgggtcgggttggttgaaggcatcgtaagagacaagttgggctgtgtttggatcaaaaaattgagaatttaggtgtacaaatatgtgtacatgtgtatatactagaagtatacttgtttttttataaaaaacgttgggtattcccaggaatacccgagaatcatggtgggtccgccactggtcagaccgacggactggttaggctgtggagttcggacggttagaccgagttcaacagacaggtggttcgttgcaggaacttgttaacgaatccggaagaaggacaagacggttctacaaatggatagtttgcaagtttaaagggtgagtagactggtagcaataggctggtcaggtcacatatgaagttatctgacataaacaggatatatccgggactcgacgaggagttgagatatatggagttaagccagaactgaagaaaaatcacaggcaactgcgggtgaaaatcgttgagggcatcaacgggctgtttggcagtataggatatatccaagatctgcggggtttacacgatggggatatatgaaatctgcgtcactgaagaggaagagcaagcgctatggcggtaattctttgggtgattcaaagcaatggtgaattttctcgaagtatcatcggttcagtctacaaatgcgggaaagcgtggatgttggatttattagctcggttcataagacgataaggaagaaagggttctcttcaagtctggcgagtttgatttatctatttggtgatggcatgggctatctagccatggataagatgaagtcaaatttaagacagtagatagagatgaacatggttttcggggagtctatgatgtggcagctaggaaggaatccaattttgattggcaatacgactgtgatgataggagagaaggtggagcattggtgtaggtggagtccagaggaagaaattattgggatagctgaatctctcgaaggtggtgggtctagcacaggctcgtcgggcggctcgtggtgaagctgcaaagaagacaacccaagtttggaggacaggtggattggcatggtgattctactacttctgggtggcgtatattcgtcaaggtggagttggttagaataggtgtccaatatactgtaaaatcaaaggtgttttttattattattctgagatgaacaattggcattggagattattggttttgatatttggaatttatttgcgaagtggttttggagatgattggatttttacaggtga

SEQ ID NO: 34778 - DNA, 2717 bp, Oryza sativa
gagtccaaatttggtatgattggttatgtaaagtttgtttcttgtacgagaaggtttcctatggggattaggacttctagtatgagtttagttcgtggctttaggctgcctacctcatgtataaatagagagggagcgtgaggcttcccggtatcgcttttgagagcattgagttgctagtttagttagggtttcgagttagttgagatttttgtaagaagtgctgttggtgcactttgtaaacacagagagaagcaataaagttgtcatctacttaaagagtttttcgatttgtgttttctcgggtgcagcggtccaaccggcaggacacctgcggtcagaccggtggcatcgaggtcagaccggcggagcaacggtggtcagaccggtggcagcgacaggagctggcaggcaatctcggcggttcgaccgatcgatctatatcggtcagatcgacgttcttcaggtggtcagaccggcgctgctactttggtcagaccgcgatccttcgaatttgagggtaacttttaatttcgcaaaaagtttgggtttttgggcataccaaccattcaccccccctctggttggcttagttcttgtgattcgatcctacatatactagtcctatttggttacagttggatttaaagttgtaataggtgttagcggtggagttagagtcccacaatgtaaccatggcgactacaatgtagcgtagacacgcagggagataatggaggcgtggccatagactcgtagctgctaggtgctatattggttgggaggagcgcccataatcagagccccgaggatgtaggcttcggctgaacctcgttaacaaatatcgtgtgttcttgtgtcgtcatctggtgtgtcttgggtgatcaatgactaaagcgatcagaaaggttagtcgtcgttccactatatcgaccaacttttataatagtaaatgagaagatgttgcttgagatgttcaaacaagatttttttaaaaaaactgcatcattcgttgcatgcgaaaaaatgtgcaaagtatttccatcacccagctctttttgagcgctggcacaagagatgacaggaaaagattctctgaagtgtaaagtaagaaatacagaacaatgaagcagaaaaacactcggtcaaaaattggaatttcttatctatctttctttacccatacataaaatattgctaaactaaatttgagtgagttctctccaatccagagcaaacacatcacataaagtaaactatatgtctatatactaaaaaactaaggagattctctgaattgtaaaaaaacaaatacagaagaatgaagcagaaaaatcgtagcgtgttccctcattgaaaaaaacacatgacagaaactacaactcgaatatatcacaaaagcaatggaactcgttatctgtactaaagaacttatatgtgcagaccgactcaaatatgaaagatactctcggaatccaacacgcgattaaactcctccatgagttcaacaatgttacctagaagagacacgatcttataattaaataagaatagtttactggagttttataggctggagggagatttacttggtctaatatgcagttacagactgtgagaattgccttggacaaattttttgtttatagtacttgggaatagaagcatcatttaactgtggtgggttgtgttggatactagagagagatgggttagcttcaacatgagtgtttttagaacatttaaaaaagatgatgtggcatataaagggataagttgatttctgttatttactgatgccttttcttaaaaagtgacttagcggctggttaaaaggtggcttagcggctggggagcaaataaggttagtaagttcagggaaaaaaagtaaggtgttagaacagaaattgggggagattgatagcagagctgaggagagagatctttttgaacatgagtagaaaaagaggtggaaagcatttatttgcaagaataaatttggtgacagaagagatgtggggagaaatggctgctacaaggtgatgctaatacttctttttttcatgaagtagctgatgggggactcagaaaaagacacattttctctttgcaatcatggagtagctgatgggggactcagaaaaagacacattttctctttgcaaagtggggattaaacaatttctgagtttaaggatatacaggagcatgtgtatagttactataagaaactttttggtaaggaagagtgcagaaatgtacatttggggtttctctttgcaaagtggggatcaaccaatttctgagtttaaggatatactggagcatgtgtatagttactataaaaaactttttggtaagaaagagtgcagtaatgtacatttggggaatgtttggagtgcttttcttagattaactgatgctgaaaaaggaaaacatgatcagacctttctttcttgagaacctagccaaaaatataaaggagatgaaagctaatccttcccctgggcttgatggcttcccagtggggttttataaggactgaatttgaagggttaatcaaggaaatgttggatgatttacatgtgggctctctcacccctgataggataaactatggtgtgatatttttattgccaaaggttgttgaggctaaaaccatcaaacaatataggcctatctgtttgcagaatgttattttgaaattcttgacaaag

SEQ ID NO: 34779 - DNA, 233 bp, Oryza sativa
ttttgtccaagccaagagcatccctaatgacacaccaagtaaaactagctaaagggcacataaagaggatatggttcgaggtttcttttttaccacatagcttacacaactcatctccccctctccacttccttttaaccaattgagtagaacatggtagtctcccttttcctgccatatacaagaaatgcttgatcttttgaggaattttactcttccaaatactcatcatt

SEQ ID NO: 34780 - DNA, 616 bp, Oryza sativa
cagagccgatctggctgaagtagtggagggcagggaaagggacgtgggggaggacagagactggaaggcatcagggaaacctttgacaaagcttctcagccttataaacaattgctagatgctgagcagtgtcatttccacagaagcaattgtccctagcctgaactgttgctataggctcctaactactgtttcaatgcccagccagttacccatcacccacgtgcccttcacaggacaggtcttatcaaagcgtaagtctgtgcctaccacgcctctgcataaaataccacaatggctcccgaagccctcagaatgaacgtctttctgagatctagcctgtaacactatgtacagtctcatcccctgacacccacccctactaccatcttgggccatttttgttctcgtccatactaactggattgtgggtgatctgtcatacatcctactgttctcatctctccaggcctctgctcaggctgtgccctctgcctggaacaccgtctgttcttcggtcactgcgagaactcctgctcatcctccacaggaattcattcattaagtcgctattcactgggctcttattgagtaccaagcactgttccaatttcta

SEQ ID NO: 34781 - DNA, 9044 bp, Oryza sativa
ttgccgtcgccgatgatccccttgaaccggcactccccctccagcatggtgcgacagtcccagtcgccccacgtcaccacggcgaaccctcctccgccgccgccgccgccggcggcgttcttgacgcccctcgcgtccagccacgcgtcgtgcgcgcgcagcgcctcgcggaggtccacgccggcgtcgacgtcggcctgcgcgatgccggtgagctcccgccagtaatcggtgagctcccggtggtgcaacggccggacgtacgcccggaacgcctccgccagctgctcgccggtggcgccgtcgacgacgacggaggcgaactcgatgatctcctgcgggtatatcctcctccccctctcgcacgtcgcctccaagtcgatgaccacgaagtaggcgaactcctggagctggacgccggcaacgccatcgcctccgcgcgccgccgcggtattcatatagaaacttcaagagagtgtaagctgatcaagcagctacacaaattacctttcgctcaaaaaatcaaaattgtttggtgtaaattcaccatcaagtacgctgatttaagtaaggatgctttcagattttccccggcaattgcctggaaatctgaaaagaatcaggtagacgagaattttgacctcgcatcagcagcgttaatttctggtcaaatatctttcggaaactatgcgcgcgtgactcaagaacgacacggtatgacgcactttttgaggtccccaaacattttgaattcattttctgtacctttagtttttaaaaggaatttatatatattcccttatgactcatgactgcatatgttctcttgctatttgcaactgtcaacaatatcactaatgattcgttttcacacaacaatatcatgcagtatactagccgataatagattttgctacactatgatacggaggttaatgtatatacttttgcgtcggttatacatattggctatactgaacaaacaatagaaagattttatgcatacaaggtcatcgaattaaaaagtatgacctcgaaaaaaaaaagaatatgaagtttgctaccactactttaaaaacggtttttctagacgcaaccctatttattgtaggcgggctaaaagaacgtcggcatgtaaaaaaaattagatgatgttcagttaagtcccgcatggaaaaattgattcttgcatgtggccatcttaagatatccgcttggcacaagagctgtcccatccctttcttctttcctctccccctcctccaatgcctcctctcctctcttctcacccccactcctctcctcacctgaggtcgatgggagaatcgccgctgggtgagtcctctgctcctcatcctctctcactctacaagttcgtggaggtgcatgaggaggccgatggactgcagctccgacagcagtgggtccaaggcaacaacgtcactacaagatatgcgtggctttttgacgtatttaatatgacacatgtcataatgtcactatatcatataatttatgacattttatttcaggcatttcaacttaatgacaataaaaagttgtgtgtcacaataaatgtcatatagctagtctattgtcatcaagtgacaatatttagtatgtcataagacgtatttgtgtgttacaaattatttattgtactattttaaatacttttgtccatgtaggcaagccttactgccacatcagattttattttcattttttcttttaataatctgtttttccgttctaattgggctacctatagaagcctaaacaggccatctattgtgtgtaatgaaccgcctatctgcacccacagatgggccaacctggtgctagcccaacagcatcgtccccgaaatgggccaacccgttactcagcaaaatttcttaaaaaaatgttggccatgggagtcaaacccacaaccttctgtttcaggggcggtgtgcaaaccactgagctacaaatgatatgtttattagatgtttcatattattttatatatcacgtttatatcctctaaagaaactaacctaacaggccgtcaaccttcccacttgagcccataccgcagtcctctcctggcgactccaatctcaacctccgccgccgctgtgcggctcctccgtcatcgtcgcgagcatcactggagcgccgtggtgctcctactcgttgagcgcagttttgaggggtctgccggggtcctcaccggagcgtggggcagcggtttggcgggcgctggcagcggcggatctagcggcgcgctggaaaagcgtggggagcggcgcgcggggcaggcgaagaggcgcagccagcggcgcgctggacgggcagagaggcgcggccagtggccgacggtgatgcccgcggccagcctcgagcggagcagcgcgcggcagcggaacggcttagtgagcaggccgtccggcgttgccagcaatgtggctggggctaatctccgtcaagcagcggagcatccttgatttgttctcctcagagtgccagcctgcaagaaaggtacattcttgcatctcagtgcttagtagtagttgcttactgatttgcaccaatcacaggacaatagttcatggtaataccaatttgtatcctagtgtttgtttgttagcaagaaatatataaagagtatgtgttacctggataaaaaagattcgtataaatttatttgatccattattggagataaaacaatgctcaactattgtgtacagattgcatataaatgatgacatgtcacatgcttaataattttggtcaagtatcatatatatgtaaatttttttgagcaagtgtatctcatgatttttttagcctccatagggcgtctccgccgcatcgggagagaccggctcccctcacaggtctggtggtagcggacctctccctcgtggatctgatggcagttacctcgggagtagcggatctgcgccactggccttaggtgcagcagggtctcgacgatgcgacggtggactgcatcgacgatgacgacagtggccctctccctcacggatccgccaccgtcaacctcgggtgagatgaggtctcaatgacgacgacaacggcggcagattgcatcgacaacgatggcaacaaccctctgcctcatggatccaacagtggttaccacctccctcgcggatctgacaacgactagggtggatttgaactagggtttcaaaaagcttttttttttgcgatttttgtttttgctcgcggacgacataacacccgcccgcgaaaatactttttgcaagttgttgtgctacctgcctgcaaaaattccttttttcacaaacacttgggggctccgcctatgaaaatatgatttagccacatgaaaaaaaaccctttttagtagtgtacttcatctttgtattaaaaatagcccccaaagttgggggcgacttaaaggacctattctaaagttcattttgaaacggatgattagccgcacgcaacaacatataaacttttagtatataatcaattgagtattaattattaaaaacatcaaaaatacatttatttgaatttttaaagcaatttctatgtaagttttcatatggaaaacaccgtttagcagtttgaaaagtatgcttatataaattgaggaattagccaaaccaaaagaacgcattttctgtggaaagaatacctagggaaggtagccaaaacaaaggaacttccatgtgtgaattatgatattaagggtggatccagcttaggaactccctgctggatcatcattgaagagggccgaagaaaaaaaggagatgagtctccctgtcttggatccgtcctggtatggcattgctacgacaaacttggcaccatctacgctagacaaatgcttttagcagatgtttggatctatgttacccagatacggctgaaaagccacgtatccgtatcggatacgctccgatacgtatcccgtacgtatcgttatttacttcgattttcgaaaaaataaattaaatcggatacttcgttgatacgtcccctcccgtcgctcctgatacgcccaaacccatccatggaagacgaagcgccgatccaatccgtcgccgtgccgcctgctattgctccaatccctgatgcagttcccacgggccacgtcctccccatcgccgcatccatgcccgaggcgtgagtcctccgctagctgtcgggttccgccgccgcatcgccaaccaagccgcagggtcccaaccagcccgcaatcgagctcgagcgcctcgcgcgtcgccgcccctgagcgcagctgcgcagggccaccgccggtcgcctcatctcctccaccgggtgcagcatctccactggccgccaagaccaacaccatcagtacgccaccaagctacttggttctttcccattgaagtctcgatctgcatttcttgcgtgtttccccatctcatcttagtgctaagtgttctctcctctcctaaatccaatgagttttggaagtggcagtgcatctctagcactcgtacgtactgctactgctagcgtggctatgcggctgcactttgcagattcattagtagtactagcgaccagacatgggagctctaaggtgagcctgtactaaaaaaatttggtgtattgatcaattgatgtcatgtattggctatctctatttacagcctcataattatttacctctatatatttattattttaaatatatattgacgtatccccgtatcggtgtttttaagaaaatgcagtatcctcgtatccccgtatcgcatatccgtatccccgtatctggataacgtagtcttggattactggtgaacacagcaactattaataaaaaaaacaatggtgtgtggaatgatgaactaatcgacattattattgtttgccattatcaatcgagatggatcatcatcgccatctgctattcacgtggtggacttggttgagagttgagaccaaaagtcgacggcgcggcctcgtcccacacatagtaatcgcacgccgcccctctcgccgccgtccacctgccgcagccgaagaagtgccgcccctgcgtcggccccggcctccgcacctccttctcccggctctccacgccgcagtggcagtagcggacgcgcgcgccgccgccgccaccaccgccgccgacgacgactccctcctcctccgccgccgcggcctgcgccgctggcaacggtagcggcagcgagccggccgtgaaccctcctcggcgcaccaggaccgccgtgttgcgcgcgtcgtcgtagacgacgagcccgatgtgcggccggccatcgaacggcagccacgccatcgcgaccgcctcctccggcgagagtgtcgccgccgccgaagccgaacacttccggcttgacgtcgtcgttgttccccttgtggccgccggcgtcaattaggcttaataacgtattaattaatagattaattctaaggtgtgagtatataggcacggctttatcatctcatccatattaactgatttatagaaagaatcgagcaagaataggagagagaccggccggtatacgagcgtgaaaaattattactctccaggtattttaataaatatataacctcattgactttttaactaacgtttgactatttattttatttattaaaatttttatacaaatagaaaaaatatttgcgtcatatttaaaagaatatttgatgataaatcaaatcacagtaaaataaatgataattacataattttcttttgagaaaaataaatagtcgaacatatcataaaaaaaaagttaacgatatcatacattaaaacatggagggagtaatatcctggttcttaggtgctcttaagggtacaagttgaccacttacaaaactaaatgctaatatctgactcaagtacgtactaaggattggctcgatataaaaagtaaatgctattatcttcacatgaattccctcgataaaaactctcgaacaagaattcaagtacatatataggattggctcgacaaaaggtaaaggagttgttttaacctaaatccatacctattaaaaagcatatcaaagctaatgataattcatgtctacattagagcaatagagcctgcgttcttattatgttttgaaataaattatagagtgaacttcggagaaccttgggctgtacaattgaggtatgaaaaatatcagatgttataacttgttgtgatataactatgagttttatggttgaatattcagaatcacctaatttcaactattttacaaaacaatacagaaccaaattgataatattaatcaattgatcaacaatggcttgttgatatataactaaattccacatagattttatgacataaagatatactatcttcattatcctctatatcttcatcccaaggttctaagttcaaatatccatatgagcgaatttcagattatgttagattagattgtttaagaggctaagtacccaatttaaatggctgcatatatctggttggacataaaggccgggtaaaaaatataaaatatattttattttcttaatagatgacgctgttgattttgacatatgtttaatcattcgtcttatatttacataattttttaaataagatgagtggttctaaaattatatcatgtattaagaaaatagagagactaataaaacatttcatatggatcatatgagaaaaggttagaacacaagtatagctttgttaacgccaaaatttgataagcccgaagttatcatcggcctagagtcagtatcggcttcaaagccttggaatcggccgataggagttgtcaaatcgccagcagttgtattcttgatggagtcggatcaattaaaggaaatttatccagaagagtccaagttcacggaggatgcggcatggcaagttatctattaattaggttattaggaatagtttgtgtcgacgtttgatgtcgcgattctggtatttacatagtacggggatcgttggtactaggatatatgcgagattgtagtaaaggagacagagacgaggatttttatataggttcgggctcctgaattgtcaggtaataaccctacatcatgttggccgaagccggtcgttgctcttattcatcataatcacaccagtacaatatttggggtagcctatctaactgttgtcgacatggcggtctgaaggtctgactcgtagtcgacaacagggtagctttcctcctcgaatccgcatccggcgagatcagagacaacgctatatctctcctgacggtatccgtaggcaccgcaagggactagccatgcctatctctgaagtcgatatccggcgtcttgtcttggcgtatgttggcttgtatgttgcggcttctgttgctccatggtgtacggatccccttttcttctaggggggccttgtatttatacccataggtgtccccttgtccaagtagacctaggaaaacaaatatggacacaatctgaggagtcctggcgtttccatgtagaactcttgttgtctttccttatccggaactccatccctatccgaaggttgtttccgtataagatatggtatggggtggatcctgccgagatttagtcaactactattaggtatgtggtatccataaccctgacagtttgttactccctccgtttcacaaagtaagtcattctagcattttccacattcatattgattttaataaatctatatagatatatatgtctagattcattaacatcaatttgaatgtgggaaatgctaaaatgacttacattgtgaaacggaggaagtagtttcctttatttttaggaaagtgtgtttagtgtaagaactttatattttccttttatgtttagaaaagtttctttcttgtcctacaaggactagtatcttcccatgtgtataaatatgtacacccagggtcattgtaatttatctctcgatcaatacaactactctcgacgcatcgccaccctctttcctaaggtttttacttatcatccgatggaatttggcacctgacgcggggctgcatcggttcagtttgatctccggcgaaggggtaagtcctacgttccgccggccctgatgaatctatcggctatgttggtgttgttcaaggctgcatcgcttcgatctcttggatcgctctggtttagttgatatatttgcctacgtgatatctcaattctatctctaattgcattgtatttaaagacgcatcggtttagttgggactgtctcgattaggtccgatcttctgtcttagccgatatatctctacaatcacaatgttgtcctaaatagatttgttatatccatcacattagatagatctatcggctcatcgagtattagataatcatatacaattttgtgctactagattgttgttgataatataagtcttgttaagccgataggttcatgctaatgttttatcggggtactagccgataagttatttagacgttgcattggcttataaggattgcatatacatataagtcggatctagccgatgacaataaaggtttcactgtttaatctaatcttgtggattttatgacatcgggcctccagccgatgtatgctttaaccttcggatcgatgtttatctatcatatcattattagccgattggtttctattggattatattattgttatttatcatcatcatcggatcgactttatatcattatctacatacatatagccgattgctcaaaaccctatcgaacatcggctggtatcggcatcggctgtaattactccattggcttgtcagccgaccggctcatcatatcttgtttgttgcagggtcaaactgactggcacgtccgtatctcaccaacctttggtcctgcactggagttaagcagatctcccaggtctgtttttggatcaacacattttacattgtactgattttaaacgaggttttttttatcatatgcagtataaaagcaagcttatactctcttcatccgtgaataaaaggaattatactcttttttggtaaaaat

SEQ ID NO: 34782 - DNA, 35695 bp, Oryza sativa
ctgtacagatactatctgaatggtgtcgacgcatttcgcctgaagctgctatttcctccccctgatcctggtatgcatccaatgatgatgctatgcaatgagagagatgaccagcacatggattctccttacttgtgataccattctggtcgattgataggatgagttaggatccaaggcattttgctcttttatgtcagtttgatgatgcttttgtagctttgctgtaactcttgtaacattgatgttttcaaagatagtatcttatttgacatggcattatgtttctttcaatccatgttagacggttgaaaaagaatgccttattacatactccctccgtttctaaatattttacatcattgactttttagcatatgtttgaccattcgtcttatttaaaaacttttgtgaaatatgtaaaactatatgtatacataaaagtatatttaacaatgaatcaaatgataggaaaagaattaataattacttaaattttttgaataagacgaacggtcaaacatatttaaaaaaatcaacggcgtcaaatatttagaaacggagggagtatatttcattacttggcactaggaagaagagtagttggggtatgaatttgtataccgtttcgaatatttcgatccatttcctaaatttatggattcattgatcttactggctaacccctgcatatgcggatatgccacacatcagcatctacccaactacaaactgcaagattcttcatattcattatgagcctaaaagtccttgcaaaacagttaagcctagaagttactatattataattcattttgatttttttcccacggcaaacttatttagttttgatcaaatttatagaaaaatatagcaatattttaaacataaaaacaaaaggccatcaaaatatattcagtgttatatttactaaaattaatttggtgctataaatatttctatagttttctataaacttgatcaaaggtactatcaagaagtttgacttaaataagtcaaagcaacttataatataaacaaggagtatttacatataatcttggctcacacatgcagctacataggatgccaccaatctagccaagctacatgtaggagacgaatcactctaataccttatgcacaaaaattacatgataaaattatatggggaggttatggccaccatcgatgatacgggatcgctagtgcatccggtggcatatgtgaagctcaggaggatgaagaagcagcagcacttggtctgagaataacattgttagcagaaacatcagttggccatggagtaatcactggtatgctggtggtgctgcgacagcatatactgacggagcagcagccacattgtttccatcacaggatgctgtgttccctgggtaggagtagatcgccgaggaagctccataacagtagtaggttccaggtgcatgagtgatgtaagtggctgcctgctcgaattggctcccctcagatgaatgtgccgcagctccaatcacactgcttggcatagacccataattcctaacgagttgtaagtttgtcatagctgccccagttgctgaagcacttggagtagccccagaattacaaactagttctgagtttgtcgcagctgcctcaggtgctgcggttgcaccacttggaatggacccataatggctaataggttgcaagtttgtcgtggccgcctcatgctctgtaccgtaggtaattctgaaattgaagacagtagcaaggaacaagtaagacttccaagtagctgcaagtaatgttctttcagattttagacaaaatcgcaaattatggttctctattgcgcctgcaggctgcaagtatcagttcattaagtttttcaaactatgtccagtaactgaacaacatagttttgagacatcaatgttgtcagcattggcctacacgctaaacataatttaattcggttcggagaaacagccaacacattataaaattgacaaacaggaagtactagaaccataaacgcgtacctctcagatgtagttcctaagtagtgtgatcttggaggatcaactgggtgcatgccaatttggtgggcggcataatatggggcagtatagtagccagtagccgaaacatgatcagaaagagattgttggccatagagattgttggccatagagatattgttggctgagggcaatgaactatatgctgtgtgcgctgcttgatatggatactcagctgttgacatatggtaaggaggtgtagtgaactgcatgtttggaggaggcatctgagcatatgaatgtgcataagattcaggtggcatcggatgagcagtcaaaggaggaatataagaagtttggtgctgctgatgcacataagcagctggctgtgatggatgagaagcaggaggtaggtaaacagcaggaggaacaggatgcctgtcactgtcattatggaagagtgcagattctggcattacaataattggacgaaacaatgctctcagtttctcaacctacagcagagtaacaagaatgatgaaaatagaataaagtagaagtatgctatagttcaaaagtcccataaaatttgatccagaagggaaaaaatgatatataaaggtatattgttctttcatattccatctcaccgccagagtattatcaaaaaaatttaacaatagctcaaaagagaaacaatgccaaagtaacttatatagaggcacatgttcttatcatgccccaaatgtgtttctcttcaaatataccagcaattaattttctcagcacaaaaaccataaatccgttactacacaggccaaaaacaatcagataatttattcattctctaaagtaaaagaatatgagtttgactggaatataaaaaaaaaaagtgatgtgatctgtattatgtaagcaatacatggaaaataataagcttcaggcctcaaaatccaaacatgatgaaaattcacatgtgagtatgtcacacaagatttcagaaggaatatgttttaaggtctttataaaaattaagattgggtccaatttgtttcatcttcacactgatcataatatcaacaaatggtgattcaaccttacctgcacaagggtaagttctgggctgaacttcccattggaataattctcttttatagcagttcttaggctactctctgggataggcatgaaatcaccatcaactgtaaatttaacctgcacaaataaaatgaacataagtggtcactgatatttctatatcgagaataaaatacagctaactaatgaaattttattattaggattcgttaaaatattttaattcgatagtaaacatcacaaaacgtgaggtaggaggaacacaaatgtcaggaaaatactaatagcagacaaattagttcatgtcaggggggctcctaacatgtctgcctctctggctcctaaaagagataaagttgtggaaacatgtgccattcattgcatctgtaattagttctggtgaagagaatgttaggcctctctcagggcccatatgttcaccacataaggtaaatgctaaaaaggaaaaaaatatcttgatttaatccttaatgttagatcttgcagtcctaaattacaataggccagcatgattttgctgcactatatcagtttctgcagccaagcaagcgcatggtctaaggtaacctagcaggccaacattggactcagtcacaactcacaagcaccagtaaaggttcttcatgccatatagactgttagttaactcatcacggaagtaacaaagacattctgcaaaactactcatcacccaatttggcttcatgtgttcaaaatgtgcccctgtataacagatgtgacagagataacagtaataccagtaattgctcatgttggatattttatacaacaggtcatttgaattcacaattttctcctttatatcgatgaaatgcattattcaccacaaaaatacctgctagaattcttggaacttcaaaaccgagcatatatttgaattcaggataacatgtagtatgctactcctaggatatgctaattcatatttcctttgcttagttcgatttgacagaagaattccacaaatgctagagcaaccagaagaagaatggtgtgggaaaaacaacagtttagaacaaaacaatgagtttcggattatctaaatcacagatcaaatttgcaatttccatcaaccatcactgtgagtattgcaatgacataaagatcctaatcaaccatgtcaacatatatcattacttggtgaactatagtcacaacaaaaacccgcttcctctgcagaataaacacacatagcacaacgacagagaattacctgggcaggaaagcggccccggaaggcatccgggacgagtgtgaggccaccattggaatcggcatggtagggcccatagaggtgcttggcatcgaagtcatagagaaagagcgctgtgccacgcctgatccgggacaccacgtctagactccccagtggcaagcccatcacccggtgcctgtagcactcagctttcgtcacgccattgcacatgaagatgtacccagcaggcgatgacatggaggacccactggagcaaccattctcatcattctctgccgcagaatgtggtttgtcacacaccagagaaggtgcagtaggggacatggagcactgcaacgcatagatatgaattagcttcatgtggcaccagaagagcagttagaaaaggaatataagaagtttgatgatgcacataagcggctggctgcgttggatgagaagtggaaggaggtaggtactcagcaggacgagcaggttgcctatcatcaaaattatttgggagtccaggttctggttgcacaataattgggcgaaacaatgttctcagattttcaacctacaacaaagtaacaacaatgatgaaatagaacgaagtaaatatattatgtagttcatgagcccaataaaattttgcacaggaggaaatggaagataaaagtattgtcctttcctattccagctagctgccggactattaacagaagtcaagattcaagtataacataatagagagagctatatgttcttattataccccatttgtgtttttcttgtgttataccagtcatttcttttctcaggacaaaaaacataatttcaatactaaggccctctttgtttaggcttataagctagcttatgagttgaaaagtctaagcctaagaaaacaagcagcgttttgcagctttttcatttggcttttttaaagccataagccactcttacactgttaagccaaaagctaggttggagaagcttttttggcttatgtgaggtagaggtatgactccaacattaaacttgggactcttaatctattggcttataaatcatataagccaaaaggctaatttaaaagcctaagcctaaacaaagaggccctaaacagccaaaatacaagcagaaaagacatattcaatctatgtaacaaaagaatatctgagttcaagataaataaaaaacgcagaagtgtcatataaagaagacactgaaaagaataagcttcatgccttaaagcccaaacatgatgaattgtcagtacattgcaaccctcccaacctcgatttgactccttattcacaagtggcacaggaggaattttagaaggaaatgacaatatgttttatgatacttatagaagttaatattagatagaatatgtttcatctttactctgatcacagtatcaacaaatgctgattaaaatttacctgtgcaagggtaagttctgagctgaacttcccattggaatagttctcttttatagcacttcttaggctactttctgggataggcatgaaatcaccatcaattgtaaatttgacctgcacatatacaagaacataagttgacactgaaccttcaactatattgagaataaaatacagccaatctacgaagttggttattggacttcattatgatttttaactcaaaagtcaaaagtaaaccgcatataactgccagggaaaataaaaggatggtagacaggttaattcatatcagtagagcacttctaatatgtctctctgattcctaaaggagctaaagttgtaagcaaacctgtaccattggttgctctctttttttcttttgaagagaaccatttgttgcttgtggaattagctctggcagagagaatgtcaataaacataacccagccgatatattctcaccacacaaggtaaatttcaactatataaagaatctaaatcaaggtgagtttgccatcccaccaacacctcttatggcttgtaataagattattttgctgctatgcatgcaatcattgcaattgtacaacttatgatatttgattacagatacgttgcgacagatgggtatttggttagtaggaaaaacaatttttcatcattaaccttagattctgctgtcctagaccataatagctttttacaattttgctgcattacaccagcaaggtgctgcagccaagtgatcgcatggtctacgacaatccagtggaccaatgttatactaaaccacgtgatacagcaaggttcttcaagccacaggctgttggttaactcatcagtcatcacggaagtaacaaaacattatgcataattactagtgcaatgaacatgactgattgtcaacccttctgactaaatgtgttcgaaatgtgctcctgtataccagatgcgacagcactaacgtatgttacatttcgtcctgccggttataaaatatgaataatggctcacttgtggatgttatttacgacaaaaatttcaaatgcaatgcataacgtagcacaaaaatacattctcgaactcaaggaactccaaaaccgataagatgtatgaactcaatgaaagatgctaatccttggaaacgtgtgtacgtatttcctttgctatgtttggcatgttgtactcctacaaaaataatgaatttacattcccttaaatagtacattataatcaccgcatagaatgtgtagtaacatgatggctcaaattaccaaattttccatcagtcaccattccgcgagaaatacggttctataaaaatgattaccactccaattccacagcattctcaattcatcaccgttctccaataataacaaaaacgatatcctaaccacgtgacgtcagcatgtgtcccacacaaccgcattcctcctgctgcttgcagatgaaacgcacgggggagcgcgacggcgcggggggagggcgagttgggttacctgggcggggaagcggccaccgaaggcggcgggggcgaggtccagcccgccgtcggaggcggcgcggtagggcccgtggaggtgcctggagtcgaagtcgtagaggaaagagcgcggcgccccgcctgatccgggagacggcgggcagcctcccccggggctggcccatcaccccgcgcgcgtagcactccggcttcgtcgccccgctgcacatgaagatgtaccccgccggcgacggcgacggcgacggcggcccgccggggaggccgccctcctcctcctccgacggcgaggcgtcccgcggcctcttgcgcggcggcggaaacgtggccgccgtaggggaagacgaagggtggtccgccatggatggaagcgaaggggagagagaggggtttttagggtttttcgttggatggctgcggtgggagtggatgagtgaccgaagcgtgacggctgccgcgggtgtactcaggtgatgtctgcttttttttttcttttttcttttcgggtttattaaaaaaaatactccttccattttagattatactccctccgtcccataatataagggattttaattttttgcttgtattgtttgaacactcgtattattcaaaaaaaatttggaattattttttatacttactttattatccaatgtattttaagcacaacttttcgttttttatatttgcacaaacttttttgaataagacgagtggtcaaacagtgcaagcaaaaactcaaaatcccttatattatagggacggagggagtaatttataagtcgtcttgattttgacccaaattaaattgctccaagttttaccaaatttatagataaatatacaacaccaaattaattttattaaatatataattgaatatattttcgtaatatatttatattgggttgaaaatattattactattttctacaatcttggttaaacttggagcagtttaactttaactaaaattaaaaagacttgtaatctgaaatgaagggagtaagtaaaatttatattatataccgacttaaaaggcaatatttgaaaaagatatttagattggaaatatcttaaatttaactctaaatttaaattttgagaacaactagttattttttggcaaacgaggaggcgttcgttacattgatagcagtcactatgcaatttactatgaatagtactcatctattttatattataagatgttttgacttttcttttaagtttgatcaaatttatcaaaagatttagcaacatctacaacaccaaattaatttcattatatatatcatttgataggaaagaaaatcaaaattacccctgctactgtagaagtacgaattaacctcctcaattcaaaaaccagacatttttcatcatcaactttttatattgaacgaattaccctcctaaccaactttagagtggttttgatcctacgtagcgcacacgtggtagtcagtcagcaataaaaaatactccctcattgtgaatgtggaaaatgctagaatgacttacattgtgaaacggagaaagtatataaaaaggttaaaaaggtagggcccacatgtgttgacggcagaaccaagtacaagtatttgttcatcataatatattttacagtatttatttttgagtctgacaagtgtataaaagttttactagcaaatgattttttatttgctaaaaagcaatttggataagatcatgaataagatcgatggcactgggctggttgtttctcagctggaagagaagagaagaggggtacacttgttaaaggtagtgtttttagaatggaattttactaattttgggtggcaatattacaaagtggcattttttctggagtgggattatcaaattttgcccacgttttaaaatggcaaagaaactggtgtcctgcttggaacttggattgtgcctacctaaataatctgacaggtgggtccagtttgtcatccacagtcacagacgcagctcaatacatgccggtttcctcactgtccagaataagaaaggggttcagaaccaaatgacatggagaccaaaagtttcagtcacttatcttcactgaaaccgagctcaacttaaggtgaagccaaattcatttacaagctacaaacagggctcagtggttggatgctaccagtgcatctctgcattcggtcaccaatcaccatggccacattatttcttattgctcatcaccatgagaagaactcaagctaaaaataaaacattggtgccaaggccatgtcacccctcacatcaactgtttgccggactgcggggcgaaattgatgaggaatgtgcgtatctccatggggcccagatcaacgacgagcttggaaggatctacggggcctccccggacgatcttttcatcagcaggagggccttccaccttccacttcagcctctttttctccatggctgaacgttcttggttcgctgataggcttgtctcaacaatcttgacaatctggagaggtgaggatggaatgatcgaataagttgataatggtcatgtatatcaaacatagatgtatatcagaaaatgtgatgatgatcaccttcttgtctggaaatactctcttcaggtcgacgctagctagagctgaaagatccttgtgctctccagcctataattacacagggcaagactcagaaaataaataaaaaggaagatcaaggtataccaaggaaaagtaaggatgatagcacaagacctcgtataggtgagccaaccgaagaagaacagttccgtcttcaagttcctgtccaacgcaggggcatttgacacatataacttttaaagcgacatcgtgcaacacttgcccgatacagatttagaaagcattttcatcaattttgtacatgagcacatttttagctaactggctcattactgtttgtaatcaatgatatcaagcaggattggggcaggacaaagaactagcttgcaccattgcaaatggttaaaaataatataaatattatactgcataaaggtgaaccaaatcagcgatagttgggtagtcgataaccaaagatgggaataattctggttcccacctctagaatcaagtaatccatcagggctttcaatgtagttgttagtgcaaagacaagcatttcatttttacttttaagagaaacaacagtggtccatagcacgcagatacctgaagagtaagcaatgcaacattatcaggcaagctgtaggccggatccattgcagagaattttgtaacgtgtgaattcacccaattacctccatcctgagtaaacagcaaggacatgctcagaactagcataaccttttggtcaactattttataaataagttccagtttatacctgctcttcaaaagcaataagaagaggggagtatatttcctggccaaatgtccgccgccacctagctccttaccttgtggatcaattttgagataatactttccttgaatctgtgaaataccataataagatgttttccacagtatttttgcacacaatcaatgtatttgaaaacattatagaacaaaaacatctctagtgacagttggcacaacatatatatcttctctttatactccaagaggactttgttatagataagaaaatatttcaagagggcagaaacgatatattcctttatagcactaacttattttatttaagtatgctctaaattttcttcaaaaacaagggatcccatattcttttgctgataggatctcagtagctgacatcttattttgacttatatccagaacagggattcaagaataagctctgtttacttacaactagtccttcacattgattatcaaaacaggttgtttcatttaatgcctctgcaacaccacgaccatcatcatgaagtagtctcctacaaagagtgacaaggatttaaaccattcagaggtacacaaaaagggaatagttaaaaaaagggcatgtcacataaaaacatttttgaaccggtgcaagttccactacagcaaaaattatagctactaaaaaaatcctcaaacacaattattagctatatagaaggacatgacatacattcatggaaaagttcaagacaatgactcatatcttctgcgagataccaaatgataaatatgcaccatcttagacatgtattttattttactggaatttgtaccacattatcaactgatatgcccccaaagaaaaatatgaaagaagcaacaaagtattgtactatgttgtttgagttgaagatatacctgtgtagcattagctctatctgtccatcctttatgctggcacctccaacagacctgtctacaagtatagataactctctgcttccatcttccacataaatgccaagattaacctgaaagtagatataaaatcatcaacaaatgcataaatcagccccaaaataaactatctgtgaagctacacagaaaactatgactggatcctttcaattttaacatcacacaataaataagaattgaaaacattgtaagttcatcaaacattaaggattgagtgaactttaagacagtctcactcgtacatgtcaaattttcattttccgatcattcataatccttagtgcatcgaagtattgtaaagagaaaaaaatttctattgtaaagatcactgaacttcttacgctagcactaaatgttattgttatcatatctcaatggaataaataaccaaacaaaacccaaattcctttaaaaagaagccagccatacgtgaataaagtcataaactaagaggataactcaaacctaactcctgactagtttcggatattgatttgatgataaaaagacatggaagaaaccaatttctcagtgcttctacacttgtgaatatatataaagaggctggagaagacaaaggctcacaggataatagtttcaagcgataggctggtgcacttcgatcttccactctgaccggtaatcccgtatctgcaaaacaccttatatattagcataaattgtgataatcatttacaattatgcgatgcattttctgttgcagtcctcttctgtgcattgtttagtccttgtccccttccaaaactagagataggagggcattcacataattaattcagggattttttttccagtactatgtttattttcattgtagatgtatagtgcggagtgtagatgtgctttaccagaaagaagagtgagaacacatcatacccttttgatgaagtcacgtccactggaatcagtgtaaaatgttttgtttgttgccatgtttgtaacgacttcagtggatagttcttttccatttccatcatccactggtattggtccaacctatccgtaagaacaattatttaagcacatgtccgaaatctcatccaaagagaaataaacaggatataaagaaatcatcatgcaaattgcaaaatgtgaagactttaaagaaaccatctttagcaatgaaggtacatcatattggcatagcacttactataaattcagtctccacatagtcctttcctttgtaaactctgttgatctgtgcaaagaattgaaaaacaaggcatcaggaaatgagcaacagcagcagcataatttcccattcattcacaaagattgagagagcagaataaactttaggtgtggaacagaaaggagttaagaaaaggtaatgattgatgatttagacaagcaattatcatagaaataacctgatatatccatggattaatctgctgatgcacttcgtccaatatggacccacggagaactgtcagaggaaccttgaagtgggcaacataacttcaagtaagacttacgtgcaattttaaaatctctcaacagatgctgcagtgtaaatgttattctcggaaaaaaaacaatggaaattcttaaggcaaattactgaattagatatcttcttcatacctgtccatcagtcttgataggaactgtgccattagggcgaaatatgtatgctccagaagcctagggtacaggaaagagcaaataaatgccaataatagtaaatgttgctgaataaattaattatataatttgtactgcacctgaggatcacttccatttccatcctgtcctatgtaatacttgtacttctgctcaaaatttgcttcaaccttggaatgtgttaatggtgttagagtacaagtgagtttagatcatatgcaataattaaagcaagaagcaatgaacacatggttttctagggcaaataacatactggttcttactccctccgttttataattagtatttttattgttatgagatgataaaatatgaatagtactttatgtgtgacttatgtattttaaatttttcaaaacaatttcaaataagacgaacggtcaaagttgtgcacggaaaatcatggctgcacttaaaatgggatggagggagtacttcttagctagctactagcaacaacaaatcttacgagtacactactttatacctttacaatggaagcaaaggcaagtcctgtaagagaagaaaaggttccagattggaggtagtgattaacctttggcacattacctgggtcttactattggagtacagagataatgctccagctgcattgtattgaagtttcaactgtccttgcccaatttgcatgttactattttcacttccttgagatgagtgcagagtggacatcaaagagactgatgctgcaatatatgcagtgaattaagaaaaatcgtcaaacttcatggcaactcttaactaagttttggtgaagaaagaaattaattcacctgatttcttcccgcttgatataaagtacgtattgaaaccaagaggtggtacagaaactggaaaagcaagccaaaacttgggttttgcagctggtaacatgcctaggtaagccttgacatgtttctcccgcatgtacaaagatgcattagctataggcagaagttgtgattcaacttctcttccctcagaatcatgaacaacaattgagtcactgatgacctgttgataaattggcatattaattaaccatctaaagcaaaagcagtttcatggtagtagcacaatgcatcagtgcatcacacatcttatgcacaagcagaaaattccgattgatatatgccgagcaaattaaaacaacaaaatatgttgcttttcagggaataacatttgcataccggtatgcgaaggacatcctcccgtttccacccaagagagttgtacacaagcacaacctgtaacataaaaggtgggaaaaaaataaagctatatgtttttttcttaaaaatatcaatcaactacaaacaggtagttcatcttgaaaagagttgtgtgttgtgttaagaacagaactcaccaaacttttcccttgagaaaggtccatctcggaaggggggcaatatgtaatatttaggagcggacactgaaaaggagatataatgataaaggaaatactgcatcatgtataattacaatgcatgttgagaaagcagaccccacgcattacaggggaagggagttggctctaaccagtgccagggtagacactcacacacacaaagatataaaccaacctgttcaaaattcgttgtttgggacggacaatgtgattttgagcctgactggctcaagcaagagagagaggatgaaaccagcttctcggcctataaaaaaatcgaactcattgaagcgatcaaaccccaaaagagaacatcatctatgaattaacagtactcttgggaactcacttgtgtatagccaattgataatctctttgcatagtcatttgcgacatgttgcttctccgttcctgtaacagcatcatggtgctgagcaagagctagagcatcagctaaactatctgttgtgagatcagagttgcttctccctttaaagaattccacctgcctagctgcctgaaaagtgaaaacaaataaaatattaagcatatgaacaccacaaagtaccaagtaaccatgaaaatatataatactgaaactgcacatctgaatgctagagtaatgaaagatgaaaatttaccaagtaatatccactcataacacgaacgtatcgttttaaggcaggtctgcttgtgaagtaacctgtccaatatgcatttgggttgtctgcatacctgatggaagaaatacagtcatttgcatgtgaaagcaacaaaaatgaagttaattatatcaattatgaaatataaggttagaacatacgggaaaaaatcattagtcttgagaggccatggcacattttcagcatgttttgcatcagtataaatcgaaggtgtggaatacagagcattgacacggccatcctgaggtaatggaacaacatgttgaaatcatcatcattacaacttcatggtgaaactaaattagttaaacaatagtcagcatttgtaatatccatgctgatcttaaccttattaacgtagtgaattaatttgtccatctgtctgaaccaactttctgcatattgatatttgaagtctgtgcccattgtaaacataacgtgatttgtccttgtaatatttgcctagagaaaagaaagaaaggagcatgaattaggatgaacaactcattgctgagtagaacaataacttcaagttaaaacgttgtcatttagctaatatctttgaatattaagagcagaatgatcgacatatcatggaatacggaacaccaaaactgcattctcaatttgtgacaaacacttaacactacaacatccagaaaggcagtctaaattgaataagatgtttgcactttgcagtagcatcaatcaacatgactaatggatttccatgcaatgcatatggctccatagagggtctacatcagcatgaaaaaagtgtgaacatacagtttaatgtacctgtgctatagctgcagcaacaaagtcatccacccgttgctccacattataatcaaaaagaaggggatcatcctgcatagaggcaaggaatgtataagttcatgtctggtgttgaatgatatgcattagtagagtactcattagtttacctggacgattggggaagtatcatcaacttcgaagtaaaactgaccaggaggtggttcataattttttgggaagatgccagcaaagatctgtaagaaaatgtgtgtttcatatgaaatatggaatccccagagtttaagaacatcaaattgaggcataacattaaccgtgaaaaaaagaggtcacttacgtcagctgatgagccgaaggtcttggagcccctccacacaacctcgagctcttttgttcccttccgtgtgtcacggtcttggtaatcaatccggaaaaaataaaaagcatcgaatcctacctgaaacataataaaatgctagctgagcaattacttttctggtaaatctaatttcacttaaacaattggattgtgtagattcagtagctacattgtgttgtcaacaaaagctctctgtggcatcactctttaggggatagcaaggtatacataatgacatttttgtatctcagcacataactacctatgatgggtgataactagttactatcgccgggctgataactagttactatgataacagcattttacatttaagtcgaattaaacactggaaggacggcatcaatgagttcagtggattacttctgtgcctaggaggtaagcctgaactgcggagtgcccaaacggatcaatctgccaaccaatccttggaatctgaccaaactcctccttgatgaacctgtgcccgagcgtagtctggtctatcatgtcaatgtagtgcacggtcgcttcatcatgcatgcacattcccccgtttctgcaacagcaaaagaagcatgtcattctctatacaacacagacatgactaccaatgcagcatacatagcgatattcgatttaaaccctacattaattccaatcgtccagtgctgatgagccccttcactatatccttaatcatgtcgctctgctgtctccaccatctctggaagaatgcctaaaaaccaaagaaaccattggtcaatttcagtcaatgtgtctacaagtggttgcacattgcttcctatccaaccaaaaaaggactcccgacattgcagaattgaccattttggatgtagatagaatagcttctataacttcaactcctacaattgtcagccagaaattgcttgtagaaacaccaatatggttacagatagtactacattgcttcctacccgccgcagttccaattccactcctccaagcggctcaaaattcaattgctgacaaggacaaacttccaaaggcgggatttaccccccaaaaaaatactccctccgtttcaaaatgtttgacaccgttgactttttaagacgtgtttgaccgttcgtcttattcaaaaacttttgtgaaatatgtaaaattatatgcctacataaaaatatatttaacaatgaatcaaatgataggaaaagaattaataattacttaaattttttgaataagacgaacggttaaacttatgctaaaaagtcaactgcgtcaaacatttcgaaacggagggagtatatgttacctgctcaacatagacgaacttgcggttctcatccttgagcagcgctggcacgagcgaatccagcacattctgcacgcacgccccctgcaaccaaaaacacccagaaaaaaaaatccaattcaaaacaagcaacgtgacgagaaacgagataatccgtttccaaaattcagcgcatcaatcatgcctaaactagctcccccaaacccgtagaaatttctccccccacaaaaaacggggaaaaaatcgcggaaattccgaggactgcgccgcgcagctcgcgctctcgatcgaaagcgcaagtagtagtagcaacctggatggagttgttggatccgacgtagtactggtcgacggtcttgagccacccgacgtcgtcgtgggtgtgcggcaccacgtgcacgttgagctttccccccaccacccccgccgacgtgttgtaggggatgtacacgcactccccgacggcagcggcggcggcgaggaggagcaagagcagcgccgcgaggcgggcggcggaggcgcccatgggcctcttcccgaagcttctagaaggggcgtggaaagtggaaaaaggaggtggtggatggaggtcgttgcggccggccgcggtgaggccggggggtggagtgagctaagaagaagaagcggagcggggtggtggggcccacctgtcggtgacacaagggctcgcggccgcggcgtgccgggcgggtagttgcgcgctgtgccacgtcagctacctagcttttatcgcggttattgagtgaattttcagtatggccattcgagtttcctcgatttgtggattggggtcttgttgcgtatgagactttttttagggtccgttcgatctagatgttccgatgagctaaccagtaaaccctacgtccctaccacgtactaattcatttgatcggtacatgattaattgactatttactaatatgggtttagaaattgatttatttatttttaaaaaagaaacttcaatataaatttttttaaaaaaaatacattgtatagcaattcgagaagtaatggagttgctcccccaaaatagctaaaaagccaaaattattttttttcacgtatagtgcaatttggatgaacacaatccacgcgcatcactaaatgcatatatatgcatgtttgctctttaagcatacttgaaatattatcaaaggcgtcaaacatccctcccctcttcacgcgaactcatgcgccattcttcgaattaaattagtcgaatcaaaaacaagccctacaacgtatgtccagcaatgcttttttatgtagcataaacatgctaacttgatatgtacatcatgagctaattttgccgaccatgcatgtgctacggctctagttttagtttgagagagtcgacgatatatcttatataattcagggcctgttcactttgatgtcatttttaacattgctaaattttgataaagttgctaaaaaaatggctatatttagtttgccgctaaattttggtaactatatcaaaaactatgccaaaattttagcaagttaccaaaattttgatattaccaaaatttggtaaggttttttttttacattaaagtgaacagaccctcaaattatggcgcttacacggttctaaatatgctcctaatgtcgttgagctgtagccttataatctaggctatcggtaagcttcagatctctccttttgacaggtgggaccccgatctctcctttgttatcatatttgtttatgttgttatcggtaacttgttgtaatggttatactatggtataatacaaagtagccatgataataaacaacacctcaatttgcataaaagacaacactctatgatcttaataggttgaagagaaatcaattggaagaagaagataaacctctctcatgtcactactactgaattggttttcctagacgttgcccccttttggttccatgcccccgaattgactggcgctaggttgtgaaccacatgggaaaaatgtgcggtcctcttaaatgaaccgcacgggaaaataagtcgatttttttcgtacgaacgtactaagagagccgcacgtcaaaatagtatttccctcctacccactttaaaatttcctctttttccgcgcacctcggtcctcactctatcttcttatccagtcaattctcttattcaactcccaaaatttctcctctcctttctcacgattctcctctctcctctcctcacttatgcctctcggcggcagcagtgccccacggcgacggcggcgcaacggtggaggcgcgggatccggcgggcggcggcagtccccgcatggatccggcgggcggcggccgtccccgcatggatccggcggccggccgccctcccccgcacggatccggcgcgagaacccgctgcctcccctcccctccccggcagcaacgggagcgcgcgggcggcggatctagcgggcaggcgggcgacgacgggcggcagcggctcctcccatccctctcccctcccctcccctccctggcggcaacgggagcacgcaggcggcggaaccaacgggcgagtgagcgacgacgggcgggccgcggccgtccctgcacggatccggcgcccggtcgccctccccccgccacggatccggcacgggaggctggcgggaggcgccaatgacgaggcgggagcggcgacgctgccgccgccgccgacgaggcgggagcgacggcgacgacccgatctagggttttcttttttttttgaatttttttcggttttctgtttttccgtgcggtggcataagcaaccgcagatttcgcgattttcccaggcgatttgttccagacaggccaaatctctgcacgcaaaaaaccgatttaccgcataggaaaacgcttagtgtagtaatgtgtaagcataacagacaagcccgtgatataattgaacttatatggcaatgttgttttcaatatcagtccatcagacaagtcaccaaaagtccttattttatttaattttcgtcatcaagcacaagcataaaaaaaatatagtatatactccaggtatcgcggatgaaacaattcatttttgccattgaaaggtcaggctatctatcacctgttactattatgggactgttcactttgataccattttcaaccttacaaaattttggtaaagttataaacaagtagctacatttagtttcctgctaaattttagtaactatataaaaaatcctgccaaaattttggtaatgtttttttcattaaagtgaacagccctacatatacacataatttcatcttaacagccgcattagtgctagtatcatttcctatcaggagcgtagcatgatttagtacgattggaaggtctcattcgcaaaaaggcgagatgcgaataaaaataaatagcccgtgccacggtggggcgcctcttccggataaggaggccagaacggggccccacctgtcggtccctatccagatcgatccgctgcaccctaccaaatatgaaacgccgaacaaccagcggacggcgactacactacgaaaattgttatgcatacggcctgcctcttcgacttatatacgactaaatttgatcaacatcaataattataaacgattataatgtatataaacatattgtctcgttcttttatccaacaagagttggatgaaaattaatattttcgtggcacacttttcaaactactaaacggtgcgttttgtgtgaaaactttctatataaaatttgctttaaaatcatattattctatttttcaagtttataaataattaaaactaatcaatcatatgttaataccacctagttttgcgtaaaaaaacttaatcttcatctttatctttatctttaggagaaaaagaacaccaccatagttgactaaatttgatcagcattaatagtgagtatgaatcgacatatatatatatatatatatatatatatatatatatatatatgaatagattcatatttagaattaagtgttttttttctaagacgtagcaagtatgaatatgaatatgaatctagatatatacaaatgtgaatatggatatatacaaatgttttagaatatacttgctacgtcttagaaaaaatatgaatctggattcatatttagacggcgtactcgcgttggcaaagctgatgatgagttgctgttccttctcggcgcgaataatcctctccctgtcttatccgatccatcttctttgtcgctgtcgcacctcgtggacttccttctcttgttttttcggggaccctctcggactaatcatacagttatgtattattcggtgctcttgaatcttgattagtgatggctaccattattcttttttctcctgcagtaagtttcattcgggaagtgatttgtattttttttttcattttgggattcgacagaaaatcctcaacagatacagtatctgtacaattatagtgtatagtgtagtttctatataactacatgtaagtagtatatatgtgacttgagtgtagtgtaaatagaaaaacacgtactactccgtccaaatatttggacatgtacagattcattgctagtattggtctctttttttttttttttgacagcggtctagtattggtctctttttttttttttttgacagcggtatagttcagtggagactggatatgtgcacttgaaacttagaggctgcgggttaattcgatccctgccctaacgtgtgtaatatattttaccctactcacgtagcacaaatctcaaagcgcatataattcgaaagttgcatagcaatcatattttatttttagagcttttcaaaagggtcatgctgcaaacgagttctccacttaagttaattgtagagcacagaaaacgataatgttatactcccttcctctcaaaatacaactacttattatgctattttttttctaaaaaaaagacatcaaggttaaagtgagaaatggttgtgatttgttgagttaaattaattaattaattaggaaaatgttgtagtagttatattttgagaaaaaaattctagaaatagctatattttgagagagtattatacctcgacgtaactcttcattttcaaagtttggtcaattattgcaccatatttagggcttattaatttgcagtgccatgttttggttggtagcaaagaggtgggtacgatgaacgtttggattgttactaattttggcgtggagttcttttttgtttgcttggcatttctaaattttgacaaaatagagaaccaattcaacagtaagttcgttgcaacaaggcaacttttttttttttcacggagtactctttctattgcatctttttatttgtttgttgcttacctgcttgtttcaatgctttatttcgataaagaaaaatacgatcggagaatgcaataattgctgtggtcacattaatgaaagtcgcagcataactagagaatcaggaaagtacgctttctattgcatactactccctccctgttgttacatattaattgacgttttagacaagattaaggtcaaatttttataactttgaccatcaataactttaaaaatatttagtttaaagcattgaacaacatatatagatttgtctttcaaagcattataataaaagcaatatatattatatatatatattataatagaaaaataaggtcaaaagatatattttatagaccgtgttattgtctaaaacgtcaattaaaatgaaaccggagggagtactattttatttgtttgttgcttggcttgtttcaatgctttatttcaataaagaaaaaaacgattgtagaatgcaattattgttgtggtcacattaatgaaaggcacagcataaataaaaagaatcagggaaaaaaatcaggggcattccgagaattgaattcgggacctctcgcaccctaagcgagaatcataccactagaccaaatgcccttttacgattacttttcaaaattacggtacttgaccaaggttatttggctcgacagacgataattacccatgacatgcattcgccgtcgagcacgccggcgaccaatccgccggcagaagacggcgccttctccggtgatctccagcagaccaacatttttctcaagatgacagcaattattgacccgagcagatgatcttttacaagtggagagcactggttgcagagacaactcacattgccatagttttattctcatttccattccattacatataagtattatttgttcagacttcagacattatgtccaaagccatatgaaataacggacgatgcaaagattcaggtacaatccaggatgcttcaagtctaataacacaaacacaaatcgttgccaagcaacccagaggtacagaagttgcagagatcaagcttgatttttcatggcaggaagcaaatcacaggatcctaaaacgactgaaacaccctaatacaaagctggcagaaacttacacggatcaaatactgacagaaagggaaaagaagagaaaaaaggcgaaaagcgcgacaagcatcgactcctaaggttgaaggtggcatcctagttgtcgacgacgagcttccgccgcttgaagttgaccatcacctcgtccttgatgccgacgaccatggctttccagttggtctccgggaagggggagaccagctcgaactcaaagttcctcagcaggtgagtccatatggccttgatctgtaggtaggcgaagggctcaccgaggcaaccgtgcctgccgccaccaaaggagatgtacgagaaggcgcccgctgccttgtcctcctccctgcctggtgcgtagcggtcggggtcgtatgagtcggggttcttgaagatgtgagggagcctgttggcgaaggctggagatgtcgcgacgatgtggcccttcgggatgtcgaactctttgccatccttcgttgtcactgagaagtcgttgtgtgactggcggagcagcatgattagcggtgggtgaagacggagcgcctccttgatgcacctgtagaggacatccatctctgccaagatgtcatgatcgatcttgtccccgtgccgcttcatgacctccttctgctcctcttcggctgctgcaaagtactgcttgaagcgaagcatgtaggccccagtccaggttgaggtgatagagctagtgtgctgtccagcaaatagtgctgcaataagtaggccggttatttcaccttctgtggttgagcgtccactcttgtacttcgaatcaatgaagcactgcagcatgtctttctcagcccgtccagaggccttgcgggacttgatgatggtggcgaagatttccttcaaccgttgccgtgcccggtcacggcggcggtgtgcaggaattgggaggtaggggaagatgacactgactggctgcatcccattgtccagatcatggaagagagaagaaacatcatcaaagagcttttctcgcacctccctcccgagcaagcaccgactagcagtcagaatgatgagatgctccagctcatacttcagatccaccgttccactttctccccacttagagaagtactcctgtaggcaaggttgcatttgcagttgagattaatcatccaagatgtatgcaatgatgtaatgattgatgaaaacaagacagaacacagtaagacagtaaaaaagccttagtaacaggatttatcttgacatgctatctaaacgctaacatgttactacaatcatgacactgagtgttcaacatcaagccaaatgtccagtgacttgcataaagatggtctgtataatctattcataaaaactatcgatataatattattatatgaaaagaaagcatgcaaaaagtttatataaaattatgcctagctttttctttatgaacaaaccatgttattgtgaacaaggatgaataagatggagtgccataaaattggaattgcaaaggaaatgagatgatgcacaatacacatgtgctgtggtatgcacctatttgtaaagcgaatataacagaggaacacgtcaattcagtttcttgttgaaacaacagttgctgccaattatgtcctgttttgctgcaccaaaaagtttggagtcttatggtgcatttcttgagtacatcttaagaaaaggtacagttgacccacaggtcttggttaagtcagatagatacaagaatgttggttgtgacagcctgacaggatgcaaacattttatcattgacctccagaacttaacgtcacataacaaggtttagtttgtttcctcagtcaactaaaaaacaggtctttgtaactcaagctatatatcagcgctgtgtttagttccaaagtttttcttcaaacttctaatttttccatcacatcaaaactttcgtacacacacaaacttccaacttttccgtcacatcgttccaatttcaaccaaacttccaattttgatgtgaactaaacacagcccaagcatgtccaacgtttatacactattgatcaaactcatacaagaaacaaattaacaagaaaaagctaagcataatttgatatcataagatctcaaatacaaccagcagcagttcaaatctctacaagacttcagaaacaaaacatgtcacagttgtcagtgtaaaatatggcctgttctgattaaaagattatggtgctggtgtggacattcattcataattaaaagatgtcattcaaaagtggagaaaaagaagcacatagaaacagtatagaaaaggaaagataacacgtagaaacaccatcaagccaaaattcagagtagaaccggaaaagactaacttttaaacgatgaaaattagtaataaacaggaaagatgtgcaagctttattctaaagaactaattcactaaaaaaagggtggcaaaaggcataaagcaaagcacaaacggataacagcatactcctagcacgaactccatgccactggaaaacactgttgacagtgatgcacatatactgatatatttgggtttgagaaaaaaagacaaaaggtgatgtatggtagccacgttctaacttccagaaaagccacgcacaacatattagacgtgttgatacacaccatgacaccaacatgttgagtaatcaaacaggattaacaacagctctgaattgacgtatacatataagaaaaagcaatcatgctgaatattagatcaccaagctttcctatcaaaattgacatagcacatctatatcgagattgtatccttttgtctaagggctaactacaagttcaatgcataatgatccgcatgactgatcttcgaaacaaattctaccacacattagcctattacaatcaagtttgatgatatatccaagaacaagcatctcatgctaagttactatgcgacaaccatcctaacaatatatgaacaattgcgtgaaacggaagcgattctcacctcagcctcgacaaccatctggtcgacatagctgcggagcttgttggcgcggagcgcctcggtgaagaacctgaactgctcctgcctgacggagtagtcgacgtcgaagacgacgccggggccgaaggtgggcacgttgaacttgtagacctcctgctggctcatctcggcctcgttccccttgaagaagtgcgccgacacctcggggccgatgaggaaggtgatcttgcggctgaggatggggacggtgaagacgctgccgaggcgggcgtactcctcccggatcatcgggatcggcccccgcatgaagcggagcagcccgcccaccagcggcgccgccgggatggtcggcgggaggcgcttcttgccgccgccggcggagctcagcagcagcttgatgaaggcgagggtggccaccagcagcgccgcgccggcgatgagccggtggtttgggtcggcgagatccatcatcttcgtcgtcgtctgctcgaccaattgccatcgattagatcagggataatacagattaatcaagatgacacatacgaaaaagaaaaaaaaacaagattccaaagcctcgttcgcatcgaagacactctaggaaagaaaaagaacacaaatgcagcatcaaaaacagtggaaaaaaatacaattgttcttccacactcatctttccacatgacaaacaaaagtcactttttgaaagaaaaaaaagaaaagaaaatctctagatcggagagaacagcgccggaaattctctggtttttggccatgtgccgcgcccgggacatatgatagagaacaaaaaaaagaaaagaaaaaggaaatcaagaaacgcagtaggatgatgagatccgatcttggatggagcataccttctccctgctgctgcgggtgtgggggggggggtggaggggagtgtggagtgaaagtatagactggagaggggtttatataaaggaaagcagcaaagattcctccgaggagaggtggtggtgggaatgaggaggggtttactgcgggcggagatgggaaaccggggcggcagagatttgcagaggagaggagaagggaggatgctcggccgggcaaggaggaggggattttgggggggccccacctggctgtgacgctagctggcgaccacgtgtgtttgcacgagcacacgacgtccacatgtgcaatggtgggtgtgggtgtgtcatgggcgggggatcgtgagtggagccgggagccgtagaggagggtcgctctctcgccggccgccgatggcgaggggggttttgccggcgggccacgccagctgcgggtgagcgaggcaggcacgggacttgaggatcattaataacactcagacaaaataacactgacaccgtgtttagttgcaaatttttttttcaaactttcaacttttccatcacatcaaaactttcctataaacatgaacttccaacttttctatcacatcaaaacttttctacaaacataaactttcaacttttccatcacatcgttccaagttcaaccaaacttccaattttagcgtgtactaaacacaccctcatgcaggtgcgcgagttagacaattagactcaccctctaaataatctagtcaatttaatagctaatatatataataatttttaataaatataatagttacctctcaaccacgtatactataatattaatatctgatctcacctatcatacacattgtatcttatagtctatggtcccattgatcttctctcttatttttttatcttcttgatacatgtttatagcttggcttatagtgtgctattgtacatgctctaaacagtactccctccgtcacaaaataatacttcatctattacaaaataaattaatcttagtacgagacatagcctaatactaaatctagacaggaacatgagtcaaatcctattataggttaatttattttacgagggagtacatttttatgctctttaaaatatcatataataatatttttgtttaacaaaattaaaaataatttaccgtgcgttaatgattttgttgttttgcgtctaacgggacgacagtgtcactatcgacaaacgtggttatagcacaagtcatgttcatcaattaatcatactacagtactactagtaccggtactagtacgtgtacgtgtttcagttattggtgcacggttgctgcaatagtacgttaacgtgaagatgtacgtctagttgtatagcctaatttcgtggttttagctataggacatcgtttgaagtgatttttggcagaatacactatgtaaatgtaataattttttaggagacaccacatccattattttaatgttttcgtactgacgacctagatggtgcccactttttaggtggcatgatcgaattgtgtttgtatgttttgtttaggataactggctctgtgcatggagagaatgtactccttgataagctcatccatattagaggtggagctactatgagcgaagtcgtacttgacgctagcggtagtggaggcgatgagggaggcaaaccttcctccctacgtaaacgaggcgcaggtcgcggctgtcctcgtggtcggcaagaggtgggcgagcacggtgcccttcatatcattcaacgccgagtatatgccgagtgcatcaatacggttcttgagtcggtgactctcacaaagaagtggatcctccgaggcaacatgtaggaggacacccctgtggcgttggcagtgtcaccgggtggtctatcagcacctctcgggacagcggcatgagggcatgataaggcctgtcaaggcgacccttcaagggtcggcagtgcttgcaaccaaagtcgttgacgtaggatatgtttacattgagaccgttgcagtggtggcggggaaatcatggccggagaggagaggaggatttaggatgtagaggggtaatttggtttcgccataaaaaaactgaagcccatatcgtgtcgtcatcacaaaaatattaaagtaatgggtgtggtgttatatttacatagtgtatttccatacaatgatacaagtcatttcatatagtattctacagctaaaactataaagtcgtgatgtcttatagaaaaatttgcccctataatataaaagaacgggggagtgaacttatgggttagacaagagacttttgtgattattcatttatttcctttattttttacaatttcggtgttggctattgtcttttttaactttgtccgttaatagtttttaaataaacaaaatgactagtgctgtctaaaacactaccaaagttgcaaaacaatattacaacaagtttaataacaaacccaggtacgggctataatccatatccgccaaattgagagaatatggatattagatttgaacaatacaatagtttacctataatgttgccttcactttactcttttctctctctcacttctccatttattttgtctcttgttctttctctgtatcctttcccaatttaatttgtctatttttaagcacattcttgatcttatataattaagaaccaactctttttcctttctctggtttctctcctcgacatgtccagaagtataatataatgaagtactccaggagtaactataagcttatactaatgtgctagctcttgcaattgcgtggaactgttgaaagaaatattgatatttgttatgttttatacaaaactgccattagatttttccttacatgagacaaaaccactactgcgaaaacaatgttcctagatgaatcttaccaattaatattgccactagctcaccaattaatattgtccgtgttcttcatttggatcctccttttgcattcataaaaacttaaccaccattaacgtgtggcaaaatacatgtttatgtgtatttattaaaaatatttcgagcattctgttaaaaaaggaataaactcaaacagtgcaaatattaaaaacataataaaagtatttgaaaaacaatacaacagataaagcaataaaaaatatatacaactatctatacaaataaggagtcttaaaaaatattatttttagagccctgttgcgagcacttgaaaggaactagtctcatcggttgccaaaaagttattataagcagtaacgacttattagcgactataaaataatttatttgtaaaacttttatagctaatgctgaaaaagaaactacattaaaaatatcttaaaatcaactttaaaattaaaaaaataaattttgaaattcaaattttagctttggctttgactttttataccaaccgatggggctctaaaataatgatactatgcaactcaaattctttgtaactagctgaaatcccgcgcgttgctgtgggagtttaacatgataataataagtaaaaataagatagctagacaatataagattacgcaagttaacgtggtttataataatttaaatttaaatagtatatagaatggtaattcaaatataaaagtaaggtgatatgactttgtgaaagaagaaaaatattgagatagtttggactgtagattaatcatctagaaactaaaaataattgaggtgatatggcttaatgcgagaggaaaaggagaaagataatttggaccatagattaatcatttaagcactaagaacaattgacgtgatatggcttaatgagataagagagaaataacactaactaagtgatgatgaactatataggtacatagcatattataaaaaataatagaaatacatattgaatattatgtgaattatgtgggatgatgatttaacatgcttgtatttcaaatgctctaaaatttaataaattataaattatagataatataacacgttttcatgatgtttaaatttaattattgttagtggatgatgatgtggcatctttgcatatcaagctttaggagttaggccgggtttagttcccaactttttcttcaaactttcaacttttctatcacatcaaattttttctacatacataaacttctaacttttttcttcaaactttcaattttgacgtggaactaaacacacccttagtgggtttatagtaagaaaggatgcgaccaaattctttacactgttatcagggcagtgaaagcaatgagatgtggaccactcttttcgaggcccatatgtcaatgtgatacagcggagttccatgtctatttgtaattgttgtggtataattttcacaacttgtttgcttttctgtttcagcacttatccagattctttccttagaaattgtgttttttttcccggatggagtacatgctttcaaagatcacatcctcatctcatcaaaaccaaattaaatcaatcaggccggaccacctccaactcaaagtggcagttgttcgatttgtcactttctgccatcatgcttttgcagttcacttccatagttccatgtgcacatcctttttaaatatgaaataaactaacctaattccgagccacgcccaactcaagtgacagtcacatgacttgattttgattcttattctcaactccaacataatccaaaactagccaaataagtaaacataatttgatatatagactatgcaaccagtggctactcaaaacaagttttacagaagagcagagcaggtaaaatataacgaagctgagaagctgtaagccacaataccgcaggggccaacggtataggcattgaaccggatcatatatttgttctgaactttggttcgaggtagctactgaatttgtagagcagatcagaagctgtacacagcaaaaaggagccaaagagacagaatagctttggtgacaagaacatgtgaggggattaaaatttgcaacttggcgatgtgagctatcttgatcagcattggagtagcatctcgcggcattttttgaggtgaagctgtatcaagaagtgtcactgcaaagatccaaagaagtacatcttatatatggcctcttggagttcttatggggtgtgctctaaacttcagctcctaactgtaactgtaacttccttgtttgtcgtgagcacgctttccaaaaacttttatatagatgcttctttaaaaaaatcaaaataatcaaattttaagtttgtactctctccatctaattttgatagtgatatttccaaatctgaatttttttaataggcatatttcaatccagcaacctatcatcttaatgactttctcggatttaatgcatgactctccattcttctacacatgattggctacatagacattgagaaatgtaaatattaatgaattgcttgattacgaggaatgactagtagcatatttaaatggatgataagtagaattatttatttttggtttgtgtgccaagatgaaatatgactatcaaaagtagatggaggtagtaataattaatacttaataaatcatgcattaatgacttgcctcgtacgttttacgtatgacgaaaagtccaaaaccaaaatgaaggttcgaacgcacccgggaaccgttgatgagccatggaaatcccaaaatactatgctgctgttatatatgagagagttagggagaagtgggaattggaattttcagtgccatcttatgaaagaatgttcatttagaagcatgagtatgctttatatagtcactgtgtatccatcaaagttgttaggttcaattcaattacctaaaacaaatctacaatttgtagggcctaacagtaattgccatgctaatcaaagaaagactgaataaatttgggattgggttataacgcttcagattaagaaaaaggctttacatcacaaacaccttgctaataaataggattatttatattggtgtgatcaaattataaggattcaacaatggaatggggttatgtttgacaacaagagagcaaattttgttagttggcaaaggctccttaaggaagacttttatttgcttctccttttgtctaaatgtaagagagataccttccttgttacttctatttcagtttaataaaattataatcgcagggacctcctccttgttctctcatactaagaaaaatataacgggtcaagataaggaagagtccatgtcatgtataactcagtagttattatttccaaatttcgaattaaatgaaattaatggaggtacttaaaaattgatactccaatatacacaagtacaagttggtactagttaatgctgaagtgcaaacttatcacttcatgaaaaaatatgtacataattgagactctaaaccaagtatacctttgtatttaagaattgagactctatgacatgtatagctatgtatttatttatttgttcatttcaaaaaagttaaattaagaaaatagaaataaaaataataaagtattaaagttgactctacatataacttcaatctattaactttgaatgttggtaaaaaaactaaattgattttgctttggagttaacttttgataaagtttgtatggcaagtacttcctccgtcctaaaatttagcgaactctagcgtttaaattttcatttaattctccttcgtctcaatgaatcataaccatttcttaattttctcacatatttttcatcacaatcatcctatttaattttacctgctttgtgcaaaatttcaaaagtttttatatttggaaatggagggagtatataagcatgattaatagcttgtttgaacgcacacgatggggtatgattcttccacgtagtactccctccggctcaaattataggacgccccctttttaatgaaaatcaaactcagtagtttttgactaataatcatactaactatatctgtgctacgtattatgcatgttatatcactagattcatattttgaagtactttcatgtgatgctaatttcatatttgttgggattatagaatggaataaaatactagtcaaagtatgttattaaagaccgtataaaaatatataggtcttataatttgggacagagggagtatgtacttttgtggtatttaagacttgtccttgtcagctttgaattttgctcattaatttcttgcatttatattcttggggactttcaatgcgaacggatctatgcacaactgtttgctcgagagaatcatattttttcggtactccctccgggttggttttatttgttgtttgaggtcagttagctgtggatgagaaaatctgtcgttggagcatttttctcacgtatgggatgagattgcccttgtgcattgatgttgttattgttcctagatcaactcctcgttactccttgaatacttcgttcctatctcaatggcagcatgcatgcatgtatgcaagtacacaatagatttcgaacaggataacatatgcgggttttg

SEQ ID NO: 34783 - DNA, 27474 bp, Oryza sativa
aaaaaaaagaatggtcacttacgattgctatagacaagcactgatcgtataaatttcttcgtcggccaccttccgcaacaatgttgggcctgagctggcctgttatttttttgtttatgtcttctctttcttttctatatggtatataagggtagaatggtcatttcatccataccgctgcatgcaaggatgacttggcatgatcacgtggcattttttgtgggtccaaggactatattaactcaaatgattaatttggaggacttatttagacgatttgaaaccttaaggattaaaatgagcccgaagcaaaacttcaggaaccatattagctattcaccctttcatttatgtgtcacttttaatatattaaatgggtgaaatggaagtatggaacccctgtttgtgggggaaccacaagctttttccatcttacaggggtaccccttcacctaccatactccatgtcatggaacgtattgttgtttgtgcttatgttatgttacaaaggctatgctacacgtagggttggtaactcagaagcttgagtttagctgtcatagtgtgacatcaccagctacatgcaagatatcgacatgttatagcgaggccacgatgtagctcttgagctaggctgatcttaatcggtgtttggtgggttgaaaatttacttgtctttttttaagttattcaaatctaaaatttggttttcttatttcgctgtttcttttttgttcttcagatccttgaaccatggtccatgttttttcattatctcagtgagagccaatagatgttttatttgaacgaattaaaatgtgtgggtaatagtaataggtattgttctgtaatagctaattgttttgtcttttcgtatttgaagaaaaattgaatcgaattagatttattatggaaaaactggtcttagtagtagtggagagtttgtgtgaaaatgactttcagctaccacttttttcatgaaatgatcaatttgtaatacaaaattttcatagtaattcaacataaattattttgaaatgagcagacaaccatatcgttcctgtacatccagaattggctcgattgctacttaaaaacatgtgcaattttttaagtcattgtagaatgtattgattttagaggattaagaaatacccaagctcacaatatggctagttagttctgaacgcgcaaagatgtagcctagaggggggggatgaataggctttcctgaaaattacaaacaaatcgcagcggtaaaattcaacaggctcggaacctccaggtgtagaacaccggaacttccgggttgtctgaacagaccggaacttccgaaaaacctaataaactaacagggacttgagctgattttgacgagatgaactacgtgataatagagcagtagcacaatcacagtagcatgcacagaaacatcacagaggagaaaaagacgattttttcccgaagttcagattttgcaatcctactcttcgttgaggtgctccaaggagccgggtctcgattaaccctttgcttcacttatgcaaagatcctagaagaagtccacggccttcaactcaacacccctagcttattttcaagaattgagtgaccaccaagatccaactcacaattccttctagagaagaccacaagtacaagttgctctacctaggacaacctctgaaaactcagcacaagaatctttactcacttacctcgtttccttgcggaggtgaggagtaccttcacaaactttcctgggacatccacaagatctttggaagctcagggtgacacctaaccgtctaggagaagatctccaagagtaataagcccaagtcacagcccacaagatatccaaagtgctcaatcaaacctaatcttcaaaccttctccaaatcactcatgcactctcatctattctctcaatctcacaagataggctctagatttgagtggaggaagcaaatggatcttgggagaggctagaaaaccctagggcatgaaagaactgaagtgaaatggccaaagggtgagctggggacgatctggatatatataatggctaggtgatgtcatctagccgttactcacatttttgaactggaaagggtccggaacttcctgaccaccggaagttccggtcaacacttaggaaaatttcgccacacaaggtccggaacttccggctagccatctctgtccggggtagggctatttccaaaaatagcccccaaaaatattttagcacttggatctcactaagagcacttgttgtatcccagaaccacaccttgaacccctcttaatagtacggtttttcctaaaactcgattgcaaatattacactatcctatgcacccttcgagctccaactccgcttgcatgtttgttgggggggggggggtctcgatcacttacaaacatcttgggactaaacacctgagtatcctcaataaaactcattagtcccttaaccctatttgtcattaatcaccaaaacccactagggggataaatgcaacttcaagttctaataaaaaacaatataggatggtcttaggaagataaaatggatcatctaacaaagtgtccaagaactgaaactagaatcgattgtcaagttcgcatgggtgttgtactagatcaagagaaggggaaatataaagtggctgatctagttttggaacacaatcacatccttcagttgttagaaacctcgcacttgatggtgtctcaaagaaaaattttagagttacaagattttgaaattgagatagccaacgatgcaggaattgggcccaaagcaacacataagttggctagtatccaagttggtggttcacttaatctcagttatactctccgtgaccataaaaattatttgcgtgtaagcgtcaacgagagatggcatatggtcaagcaagaagcatgctcatgcattttcaagacaaaattgctgagaacccgtcattccaatatgcattgcagatggattgggaggaacaaatagcaaacatattttgggttgatgctaaaatgatcaccacatattttggtgatattgtctgttttgacactaattttggaacaaacaaggaaagcaggcattttagtgtatttgatgggttcaatcagttcagggaaacaatggtttttggtgttgttctcatgtacaatgagacatagaccctcctaaaagcacataatggcaagcaacctaaaacaatctatactgatcaagatgctgcaatgggaaaataggtaaggaagtgtttttagaagcatggcatggtttgtgcacttttcatattatgcataatgttgtcaaacatctagctgaagccgacgatgaagaatctagtacttctcccaaacaaacaaccgaagacaatgagaaagaaccaagtattcttgcagattttagtgcatgtatatttgagtacgaagaagaggaaacatttgaacaagcatttaacaccataagagcaaaggcgagcaagcaaagttggttggatagtatatacaaggtgaaagaaaaataggctgaatgttacatgaaggatgtgttcacattaggtatgagaagaacaattgagtgagtctaaatagtgaattgcagaggcatttcaaatctgattttgatatcattcgatttcttaagcattttaaaagggtggtggaagataagtgaaaaaaaaaagctaaatgctggatttgaatcaaggaagaaaatacccagaatcaaaatgaggacacctatgctaatccaagctagcaagctatacacaccaattatatttgaagcttttcagggtgaatatgataggtccatggtagcatgcaccacggcattggacagcaacaattgctatcttgtggcagttggcagtcttgaagaaaatttagctttgagaaggagtacagagtttttgatgatcctttagggcaaactagtacatgcagctgtaggctattcaatagaactggaatattgtgtggccatgctttgaaagtccttgatctgataaatatcaaatctctcccatcacaatatgtactgaagcgatggacacgtggagcatgtagtgggacagtacaagacaaccatggacgaaatataatagagaacccaagattaaatgatttgcttcgctacaaagatatgacccgcaaatttctcaatttggcacttcgagctgccagccatccggagtcatccttgttagtaaacaacacacttgacatccttagcaagcaagttgaagaacaaatcaatgcatgtactgatacaactgttccagtcattgctcccacaagtgttactcctccaaatgatttggtgagtatagcatgccggaagaaaaaggaggtgcaaacaaaaagctcgaagcgaaaaaaaattggcttgataagatgcactccacaaagaagggaagtaagaagggaggtaagaaaaaggaaaatggttcaaaggtatgtgataacacaacatatatttgattctctttcaccgtgctcaatgggaacatgttcagttttatttcttttatttgaaggaacaagaaactgcaaagaagggaggtaagaaaaaggaaaaagaagcagcaggggcagaaacaacagcaatacaagacactgcagcagtgcaagatatttatcctagtacttctttgctcatggaagaaatatctcaaccatacatggccatcaataccttctctcggatattgacgataatatttcaaactaatacaccattttaatatactatacatggccatcaatacattctctcaattgttcatctgatccttttattttgcagggggcaatcacagatgatgttattgctgatttctagtagtatggatatttcctgtaatctgaatgtctttttgcaaatatgtatcaatgccttttggagaatagattgtttatgagaatagcttttggagaatagctattgtcaatctctgaacagaccattttatgcatctctgaacttgcaacaatcagcattactttttattcaattccaagaaaatttacaacacaatatcaatctatacaatttgcatgatttttgctgctttggatacaatcacaagttacacagtcttgttcccgtgctcctagcctactatttcttcaactttgtcggctgcaccacctgttggcaagaccttgaggcagagcagagcagaccacttgttccgtgagatacatgacgattatccctcctacgctcctctgatttgggacgcacagcaagctcttgctccctgataatcagaacatagatgtgtcactacaataaccacaacgaacagcaaacttcaatgaaccaaatgatgtgacataacatacattcattcatctgtaaatggacttcaggtcggagtttcaatttgatgatagaatttctgagtcacttactgatcaatgcctttgttagctatctatgtaaccccctaatgtaaaccggcttgcttcctctctttgaatgaaatcggcagtgctcctacaacaaggtaatgcacagacgccagcaacatacttcctccgtttctaaatatttgccgtcgttgactttttaaaatatgtttgaccgtttatattatttaaaaaaattaagtaattattaattcttttttatcatttgattcattgttaaatatatttatatgtatacatatagttttacatatttcacaaaagttttttgtagaattgaatcacaagaactaagccaaccagaggggggcgtgaatggttggtatacccaaaaacccaaacttttagcggaaataaaagttaccctcaaattcgatgtagatcggtctgaccgaagttgatccgccggtctaaccgcgctcgcgccgccggtctaaccggtgttgatcactcggtccaaccgcctgaaaatcgtctgccgcatgtgaagtcgccgccggtctgaccgcctcgctctagccggtctgaccgctggtgcgtcgccggtctgaccgccgatgagtcgccggttagaccaccgaaaacccggtgaaacacaaatcgaagaactctcaaagtagatgacaactttattacttctctctgtgtttacaaagtgcaccaacaacactcctcataaaaatctcgactaaactcgaaaccctaactaaactagcaactcaattgctctcaaaagcgataccgggaagccccacgctccccctctatttatacatgaggtaggtagcctaaagccacgaaccaaactcatactaggagtcctaaacaccttaggaaaccctctagtacaagacacaaactttacataaccaatcgtaccaaattttgactccttccaaattcaactccgcatgccatacgcacacaatacctccatcgtatgccatatggaatctccatcaaccacgtgcatcaactctagccttagtatcccgtatgatatctgaccatcacggacatcgtcttaccaccaagccgattcccggtccatcaccgcaaatactctcccgaggcatcaagtcacctacacatgaaataaacaaagaaaccatattccgagaccaagctatctccaacttgactcattagtagcaaacaacagtattacatacgtatagtatccatctagaagccataaccatgaaacaatcacggatatccaaagaaacaatccgaaaccaaaactgacgcagcatcggccggtcagaccgcgggctgcgccggtcagaccgcgggccgcgccggtctgaccacgcaatacacgccggtctgaccggccacactagcctggtctgaccggaccacaattcaacagtatcctcctgtagatcacctgtgaaatccaatcatctccaaaaccacttcgtgaataaattccaaatatcaaaatcaataatcacagatgccaattgttcatcacagaataagaatcaaaacacacattgatcttatatttttaaataagataaacggtcaaacatatgttaaaaagtcaacagtatcaaaatatttagaaacggagcgagtacaaaatatcttgatcaatcaaatatagctgccacattcagcacggcatgggcgctgggccgcacgcctccgatgtaatctgatgttgcgcccggccgtggttgctacggtgagcaaactgctgacctttcttggcacaaatttatcccgttggtcttcgacatcgatgagatgccgccctccaacctcctctattacgacgaccatagatacaggtcagttatggtcgctcatctccacaaaatcccaaatggaaatcgaaatttagggaaaaaattgcagtcattgggagtgtgttcgattcttcaattgagatactcacatgtgtatattgtggaattttttattttttaattttattaatagacctttctaaaaaaatatttttaaatccgaaccttttgaccacgccagcccgtctggcgtagccaaaaaactatatcactccagccggtgtggcaggcctttgccacgccaacggttggcgtggccaaacaacactgccaagccagccactcggccggcgcggccaaaaggttcaggttttgaaaatattctttggaaatgtgtaataataaaattataaactaaaaagatctaaaaaataaaaaaaatcttgattgtgggaagatcaggtcttcagaaaagaattattgatatcaaagcttgaggtgaaggaggaagtcactgaccaggctcttgatctgctgatttcaagttgaacctgtggcagcggccgcagtagctgttctagaaccgagcggcaccgactgtagactgtagtacaagcgagcggactgcggggacggctgtacaagtagtaagcagtatttggtacttctccgttctaaaatgttggacgccgttaacttttttaaaaatgtttgaccgttcgtcttattcaaaaaatttaagtaattgttaattctttttctatcatttaatttattgttaaatatacttttatgtatacatatagttttacaacggtcaaacatgtttaaaaaatttaacggtgtcaaacatttagggaaggagggagtattttggtttagttcaggtggttgcctaacttgccagtacttggtttttagcttcttgttcagtaaagaaaatattatatatactagagatataaatatagattctaaccacactgttgctgtaaaaaatgtttcgtaaaatatttttgatttttcaggttgcagtcggaatctagctgcaagaaatcagctcagatttcctagggctatcaagaagacactatactaccaagttgctcgacagtatttgtttgcaagatcaatcccaaatatatcttaggtgatttcttgccctctcagaatactgcaaaagaaaataaaatttaagattgttgtcttgtctttgtgcctttgactggagaagaggctgtgcctccatgatcaatattccttccttctacatttttaacaattgagttatattgaatggattgtccgtaccatcaagatccagagattgattaagagcgaggataatagtatagctcacttcatactattagtccatcttaaaatcaacatacatatataatatattagctataaggttgggtataatttccttctcctgtctctatctctcacttatacatttaatgtatttatcttagagattgtgttaagctagctcttgcatgagagccaacccccttaatttttttgttacatctcttctccacataagcttatagtgggcttatagctcagtattatacttgctctaaaacagttcaaaactggaattggtgaaatcaatgagagtctttatgatttgatggctgcatatcaatgagttttttgtaattcgccacctcagatcagattgaatctaggatgtcacccaaaattcagagtctgcttcacctagaaagtcacccctaattcgtagtgtaggttttttttgaataaaaatttgatgacattattagctaatgtctaattgaattgatacgtacaattcccatatagttctttgtcactgaattttctatttttttcctcaggaatgaatatgatcagggtagaacataattagtgctctttaactccaaaagaagccagaaaacaaagggaagctcaatttgtggtatgtcatacatgtactctttgtccattgcatcacaatgttaacatgatcaaatttgacaagaccaacccatgtttcaggctgttcttccaagtttaaggcagatatacctgcatttgcactgtttgaggaattgagaaaggaggctgaggctgtgcaaccagtgccagtcaactactaccttctagcatttcacttctggtcaaaggggtcaaatattcagaaagacatcagtgcttctgttgactacttcactccacttacaaagtagtagtatattgtccaatataccaaaatgggacagaggaagtagtgtgaaaatgggacggagggagtatgaaagtattgctctttacttcactttattattgtacttagactctcagcatggggaacacaagttagataacaggaaatcacaaggacggtttatacagtttagtgctatgatttttctgttaacgcagtgcttgcaaaatgtggctaataagcttgtgctaaaattggtttcctatatttcaaactgattatctagacaattttatcacaagcagggcatgcttcctctcctttttttaagcaacccaacattgctggttttatactaaagagagggtagcactgtacaacaaattataattaggaacctagagaaaaacagaaaaatgtaggcttcagcatagtgccacgccgcacctactgtatatcctatccttgaaaaagaagggtaaaagcctaaaatgtttgccaaattattctatgtagatttgaatgttatagttagatttattttacatgtggtggatctgtattgcccccataaccatgtcctccctatcaacaatcactgacaagatttcctcgttatgttggtggtttctatggtacctttctttacatcggacaacattatgacttgctatgcttttgaattctctcttctgaaccttgtttagttttaaaacaaggcagctctagaatgactatttgatactgaagataacctatacaacttggttttcagagaaggtaagtttcctcatgtcccttaaatcaggttgtttcatgcagctaaatgattctacaaaatagaatcttgcaactggaacctggctttgcatccctcgaagtttactctgtaactgatatgttttctttaactgacaacaaatgatactgatagctacccaacattccaagattttcaacttcatgctttttaatggattttccatggtgtgaattgaccttttgtaggatcattctttatacaatgaatttgtgtggatggagaaattttggagatctagagaatgatggctttcaggcttgccaacgaagagatcctgcccttcaattgtttatcatacacagttgaacttgaggtatcgctacaatgccaccatatttccagtagtgtctgttgattgcaaagcctatgggtagagagaaaccttgttcatttccttcttttgactgaactcacaaggttcctctctgtccatattatgattgtgtttatcacaggcatatacaaaggtagcagatattagaatgaagttaatggaacagccatcagatgctctccacggcacaatgcaatcacagctctgaatatagcagcaatgaaagtaaatggagagaaagggtaattgtatactagatgatctcattagggaggcttgtttcattttgacttgaaagatgatactgttggatgtaattttgatgaagaaaatggtttatctattttaccttggttcaaatgaataatataatagaagaacgtcactcacaatcacattgtatgatgtacttactgattattatgtttatatagaaaaaaaatatataaataacacgcttcttccaaacatagcacacccgtagcgatagcacgggtattttactagtaaggaaaaatgaatgacaattcaagccacaagaaagtgaaaagaaataataggcaactttcaaatagataaccgaataacctatgctatatatgtagttgcgttgcacaagcaaagtagttttgagtgacaatcacttgatttgctcaccaactgctagtattttagaaagaattgagcacatctttcaatcttccatcagacacgtctataagtataagcttaattaagtgctactccctctgtctcattttaagtgcagctataagttttcgtgcctttcttcctatcttaattacattgaatgacctccttcagttattccggcataagtttccgtgcctaactttaatcgtccgtcttatttaaaatattttttaaaaaaattaaaaacataagtcatgcataaagtaatattcatgttttatcatttcttaacaacaaaaatactaattataaaaaaatttaaataagacagatgattaaaattgggcacggaaactagttgcacttaaaataggacggagagagtacaaaattgtgcacttctgcaaaaccaaacacaaacagaattaccagtgggcaacaagcttccggatggaggcggcggcggtgagcgcgtccaccggggcgctgaacaccctcctccccaagctcgccgacctcctcctcctcgtcgccggcgagcaccacagcagcaggcgcgcggtcgaggacggcgtcgagcacctcgagagcgagctgaccagcatgcgcgccgccctcgagaaggtgtcggcggcggcggcgccgcccgaccagctcgacgggcaggtcaggctctgggcgagggacgtccgcgacatgtcctaccacatcgaggacgccatcgacacctacctgctccgcgaggccgccgccgccggacgacgaccaccaccaccaccgtgctgctccttcgtcgtcggcttgaccagctcggctcgccgccggagccgagccatcgccgccgagatcgagcgcatcaagaaggaggtggaggaggtgagcaggcgccgggaaaggtacaggatcgacgaccacgtcgtcgccgtcgtcgatgacgctccggtggaccgccggctgccggcgctgtacgcgaacttcgcaagcctcgtcggcgtcgacgcctcagtggaggaggtgatcaagctgttatccatggaaggatatcaaggtgcagtgatgatgaggcgaaagctcaagctgatcgccattgttgggccaggaggaatcggaaagacaaccctagctaatcttgtgtatcagaagctccatggccaattcgaatgccaagctttcgtctcggtttctcaaaagccaaacgtcaaggctgttcttagcagcatactctgtcaagtgagccaactcaaatatgaaaatttcagttcttggggtgagaaggaaatcatcgacaaaatcagggatgttctcaaggatatcaggtatgtaaaccatcactgaatttttgggtgtctttggaagttttagatatggaaaatgaattgcatccccggcatctgcatctataaaatgcactgagtcaaggtgtctttggagtggctaaaaaggtcaatttcgaatccctgggcttttgtggaaattggaaaaaaaaatgaacctgaatttctaaaccaaacattaattcaatctaatctactgaaatcattcaccttttaactttggttacaatttaattggaatgttttctgggtgacatgtcagcctctggaaaaattattgaatttttaaaatagtaaatgcttttcagaacatacttgaaaaattctagaattgcacttgaaatatttacattacatatattatgttccattttttagacactgtttttcatgggccaactatttttaaatttatgtactaatgttctaagttcagatgtggttacaaagtgggccacatcagtgacacttacccaaaactaatctgtgtttgggacaatgtggaaacgaatgattgtttctagcttaaggtttaatatactcctctttctatgtttatataggtttatcatatttgaacattttaggttacaactaaatcactacaagtatatgtatgtaacccatgcaaccatttatctaagtcactacaatgcaaagctctcctgcacgttcgaaaaataaatattaatccttcttcaactaacatactttgaaattataggtacttcattattattgatgatatatgggataaaccaacatggcaccttctaaaatgtgttctcatcgacaatgatcatggtagcaaaataatcaccactactcgcaacatggatgttgcaaagttgtgttgctattctgatgatgttgatggtaccatacaaatacaacagcctctttcagttgctgactctgaaaaactactatatcacaaagtattccataatgaaagatgccctcctcagcttaagggcatatctcagaaaattttgaaaagatgtggtggcttaccattagctataattactattgctagcttatttgcaaataggcagacacaaactgaggaccactggaactcggtatgcagttctttccatagcggacttgaaagtagtactgatgtgaaggacatgcgctggataatatctcttagttattgtgatatgccttctcctcttaaaacttgttttatgtatctcagtatatttccggaggattatatcatcgacagagatgacctgatatggagatggatagctgaaggttttatccagccaaaacaaggtacaattctatatgaaaaaggagagagatactttgatgaactcattaatagaaacttgatccaaccgatatgcattgatgtgcatggtaaggcacaagcttgtcgtgtgcatgataccatattggaatttatcgccggtttatcaattgaagaaaattttgttgcaattttaaatggtcagtgttcgacgtctgatctaccgaaaaggatctaccggttatccctacaaaacagcaaggatgatattacaatacctgatgcaaccgagagattttcccatgtgaggtcactttggcaaggtattgatttgaagatgcccctttcgggctttcgagttttgcgtgccttggatttaggagattgcagcagtcaaaatattgataatataggtaatttggttcacctgaggtatctaaggttgcgtggtacacattataataagcttccaaaagaaattggaaacctaagatttttgcaaacattagatttaagcagacaagaataaaagaattgccatcaactgttgtacatcttacacaacttatgcgtcttatggtggacacatggacaaagttgccaaatgggattgggaatatggaatgtctagaacaactgtcagagattgataccagcatgtatccaagtcttatgaaagagctaagcgatctgcccaatctacgggttctagaaattttgataagcacatgggagcagaccaaagaggaacaatttcttgattgtttaggctctatgaagaaacttcaaattgtccatatttttgctccagatatatcccttgatttcatgttgaataaagattggacccttcatgaactccaaaaacttacagttggtgttcgccgagaaagcgaagacatatttaagctcaccccattgtctgggtgggctgagtttagcccattctctatcctaccaaggtggatcgattcatcactcaccaatctctcatacttatcgatcattgtcaagatactacaacaaaaagatcttggagttcttggggactggcctgcactttgttctctatacttgagcgtgacaggcgctttaaaggaaagattgatgataataggtcatagtagaggtaatggtcaggcaatagcattccaatgtctggctaacttcaactttacaagtcctgcaatgatgctagtttttagacatggagccatgcagaggcttcaaatgctttccttttgttttcaactaaaggagacaaaagtttttcacagtgatttggacatgggcttggagaatctcacctccctcaagactgtacattttcagattgactgtcgttacgctaggctctgggaggtgcaggctgcagaggttgcactaagaagtgcaaccaacttgaatctcaactccccaacccttgacttgagcaaacattttgaaagattgatgtattgggatggaatggaagagatccctgagatgaaaatattcaaagaagaaaatgtatttttttttgcagcaatcccttaaatttatttccttctcattttactgtagaattattggtttatcggtttgttgttaggttgggattgtcaagattggaccatggggtggaaatagagggaggcgttatgatattgaggtggctcctcaccatctagaaagcatcagagttcacagcgatttggctgtacattcatttgaatttgaatatagcgaccgtaatggacagaaacatgttgcgggtccttggggaggatatggtggtagtaatgttcatatggtgagcatgaatatttaccaagaaaaatttcttttgttagttaattagtacatgtttcccaatcatatgtacttgaataagtgagactagtcttggtaaaacgcagattcaacttgaatcttcagaggttcttgtggaggtttctggaacatttggtcgatttgctggatttcaaaatatcataacctctcttacatttgttacaaatactcaaagctatggaccttttggacaaagagagggaacccctttccacataccagtgcagtgtggtggccgcattgttggattcttcgggcgtgcagggtggtgttttgatgcaattggtatctatgtgaaccctgatctccaaacaataaaagacaagggcaaagtactgaactaagctcggattgtttcatttcatttattttcttttagctatgattccttttcgtgactgttgtttgcacttaggttgtgcttgccaagattgggccatgtggtggaaagggaggggaggcttgtgacatcatggtgcctccccatcatttggaaagtgtgacaatttgcagtaacattgtgatacactcactcacattttcttacaatgaccataatggagatcatcacttggcaggtttgtggggcagccatggtgggagtaatcagacggtatgtgtgtattccaaacaaaattaattctcaaaatatatgtacattttatgtttttctcttaatcatgataatgattaatgaattgttggggaaaaataatgaacttccctattcattatttacttgggaaaaaaatcaagataatgaattgttgtaagaaataagattgaagaaaaaaaatatatggtgcaattgtctcatagagaaatttagagaacttatcatgatagaaagacttcgagtaaattccaaaaaaaaactacaaatactttgaccaaattataaaaaaaactacatatttaagatgatctatcacaaaactacagatttaataataaatttatcgcaaaactacaagtttaaggctaagtatatcaaaaatacagatttaataataaattatcacaatactgtagattttggggtttaaatccttaacactaatgttatgtttgagttataaatgtctaatttttgtgattaaattggcattacgtgcagtttactctatctaaaaagagcattgggacacctacacaaaaactcttatttgttctagttagcagacgcatgaaactaacatgagttgcatactgtgtaactaatattgtataatgtctaactagtttttagacaaaatggcattaatttagtgatcatatctcatccatgtatccaaaaattataggaattacatgaatattccgtctgagcacaagctggtgacatttttcgacatgaatccatgttataccgttctaaagcatgtcatgtttttctgagtcatcttattatagtaattatttttgctttcctgcagattcaatttggcccttcagagttcataactagagtttatggaacaattggttcatacaatacaccatctgatgttgtaacatctattacattggttactaatgctggctgctatggaccttttggtcaagaaaatgggatccctttcgactttccagtccagggtaatggcagcattgttggcttctttggacatgcgaacctttatgttgatgcaataggtgtctatgtgacaccttccatgggaacaaggaaagaagaagaaaatgtattgatttatcagcaatttgtttgtgctctttattgtgtagaactttcttacatattgcattattttccccttttgttctcttttctttcttggtctatgtttaggttgggcttaccaagattggaccattcggccgacgtggagggaacccttttgacatcaaggtcacaccacaccagttggaaagcataacaattagtagtaacattgtaatcaattcacttgcattttcatacataagccatgacaaacaacaacacattgtaggtccatggggcagtggtggtgagagcaattatacggtgagtgtgtactgtatataaaagctactcctcctagttgtaaatgagtgactagctaggatttatatcagtcatgaaagtggtaagtattaaaaagtgctacatatatatcagatatccctcttggttatgggagggacaactctaaatataatcaagcatgcacccttgctacatatttatcagatatccctcttggttatgggagggacaactctaaatataatcaagcatgcaccctttggttataggagggagcaatttaaagataatcaagcatgtatagggtgtcttttctccttcttccattaataatatctgttgacaattaataatctccttgtgcatacagttgatttggtaacattttttttatccttcctgtttgttgtagatccagcttggtccttcagaattttttgtcaaagtttcaggaacatttggtccatttggtgaattccccaatgtcataacctctcttacctttgtcaccaatactcatcatcagtatggaccttttggacaaggaggaggcactccattccatgctccaatgtcgggcaatggcagcattgttggcttttttggccgtgaagggttatgtattgaagcagttggtttttatttttgcgcattatgacaacagtttgttctatgttgcatgtcaaaggttttagtagatttgtttgtgtgtgtgtcctttttttttgtttcctatgcagtgaagattcactagttccatgccccacaccatgatcctcactagttgttccggcaagctccatctagacatgtcatgtttgggggaatttctagaaactgcggattctcccagaatctacagcttcctaaaaaatcctgattctcgcacatgttataaaaaaatctatagttatagaatctaaaaaatgaacacaaaaaactgggaaacccaaattttcgacaattctcaccaactatttagtcattagatgtttctcagaatctcaagattggttttggttgacatggcattgatgtgaaaatatggcctccgcttaaccaaatcatatttttttaaaaaaaattgtaaatgaattgaaaaaaagtattacacaaaaaattatatccaatataaaaatattcgggccataaaatagttttgtgaactcactaaatgatttctagtagaaaaacttgaattgttttactataagcaaatttatttaggttgtaaattctctagtatacaaccatgatttgctcattaataatttaagtaaaaagaattgaaacttttgacatctacaaaataattaggagttatctaaaacacattactttggtatggttacatgtgaaagaaatatctaaagtgtgatattgtgaagaagattctataaatgatatatagtatttttgcagtagatctttcaggatcttggcaagtggacaagacagaattccatggaggaaataatttgcgatgatctttccaagtggcaaagattgaatagtagaaatagagggtgccctcctcccaaatgctacaaactagctactcaggtatatagcggttaaaatgctattgtctataaacaattttgtggttgtcaatttagttgtcgatgaaaaactccatacaattgtatagatggcataaagttgcaacacagcacagacaagatagcaccttggtcaactctctaccatcaccactacacttgttgtcgacgagtgcttgtcagcaagatggagcaccctcaccacactaatatggagcaaatagagaccggggatggcatacaggctatcacaccctgattttcgctttaggatttataaattatttaataaaatatttctagaacttgtattaaagttcaactaatttacaagtgaagttaatgtgggaaataaaatttcccaaataatacctgggttaatttaatttttattaaattctccatgattacactctctaaaattttcttagattttttagagataaaaaactaatttaataatacaaacatcatttcagcaattaatttaaatgaaaaacttattaaaatcatccagcatccgccgaggtacaagagaggaaagagtgtcgacaacttcggcactcctccaaaacttcccctaattctctacctatattctcaacactactaaagttacgcctaaagtatgaaagtgagttgtatgccactttgttgcgtgttgtgaaatgagaactttcttccttttatagcctgcttatgacggttgattaggtcggcaactcccacaaccgccattaagaggcatgaatcatggatatccacgtggaatgtggagatgaggggctgatggcggttcccttgaatttttcttttatttaaaaatctcatcatttaaaaatttggagttaaaatttggatcttattttattttgtgccaattagatctcaaatcctctcttagacatccctttgaatttctgtcaaaccctaggtcaaaattcaaatttaaatatttccaaaaattccttaaaatatcaactccaaaatcctagagaaaatcagaaaagtcactgttcattgggcctccttttctttttcattccctctccccaactccctttcactctctcctccacccacacctttctttctcaccgagcaggccggcccatggccttcccgcaccggcccagcccaccttcttcatcttcttcctcgaggcaaccacacacacgcaaacaaacagttcgacaaaatgtctcgcccaacgttgcacggccctcgcatcgtgtctgtgctgtgttgtgccgttcttcaccctcctgtgcaccgtgcctcacgccagggccgcgtcatgccaaacccacattgagccaaggtcgcgccgcaccaaaaccgtgccgcgccaagccatggatcccggcaaaatctgaccacgtccctcgctccggattccctccgggagacatggtgccacgccatcccacgtcaccctccgttccatcacgccgtcctatcccgaactcccgcggacgcgcgtctcctcactcgtcgcaccaccgttttgtcatccatctcctcccgggaaactgcctccgcatctccctctctctctctctctctctctctctctttcgcgtcgcgttgccaccgccgcatgatgccgctcgcgtccccttgctctgaggatgctatcgagctaatcccgaccgtagccgccatcggccgcacgtcacccatgtcccgtcactaatcccactcatttcctgctacccttcattgatgaaatgttggaacgtctagcaaatgattcctttttctatttccttgatgggtatttcgggtatcatcaaattcctatccatctggaggaccaaagtaagactatgttcacatgtccgtatggcacctatgcataccgtaggatgtccttcggactatgtaactctcctgcatctttccaaagatgtatgatgtctattttctcggacatgatcgaagatatcatggaagtcttcatggatgacttctcggtttatggaaagactttcggtcattgtctgcagaatttagacaaagttttacaacgatgccaagaaaaggacctggtgaagggatagttcttgggcatcgagtgtccaaacgaggaatcgaagttgatcacgctaaaatcaatgttatagatcagcttcctccccctgtaaacatcaaaggaatccgcagcttcttgggtcatgccagtttttatagaaggttcatcaaggacttctctacaatcgccagacctctgaccaatttgctagccaaggatgcgccctttgagttcgatgacgcgtgcctaaaatcttttgaaattctcaaaaaggcactcgtctatgctccaatcattcaacctcctgattggactctgcccttcgagattatgtgtgatgcaagtgactttgctgttggtgcggtcttaggccaaaccaaggataaaaagcatcatgcaatctgttacgctagcaaaactctaaccggagctcagttgaatactgaaaaagagctgctcgtggttgtttttgctatcgataagttcaggtattacttagtgggagccaaggtgataatttatactgatcatgctgctttgaaatacctgctcactaagaaagatgctaaaccacgtctcttaagatggattttgctgctccaagaatttgacttagaaattaaagataaaaagggagtagaaaattccgtagcagatcatttgtccaggctgcagatcactgacatgcaggaacaaccaataaatgatttcttgagagatgacatgctgatgacggttcgcgactccaacctgtggtatgccaacatagtaaactacatggtatccaagtacattccaccaggggaaaatcaatgaaaactgaagtatgaaagtcgccgtcatatatgggatgagccatacctatatcgggtctgctccgatggcctactacgaagatgtgtgctgactgatgaaggacttaagatcatagaacgatgccacgcctcaccctatggtggccattacggtgcattccgcacctaggccaaaatctggcaaagtggtttcttctggccaacaatgtatgaagactcaaaagaattcgttagaagatgcactagctgccagaggcaaggaggaatcactgctcgcgatgcaaagccccttacatacaatttgcaagtcgagatattcgatgtttggggtatagactttacgggaccttttcctaagtctcgcaactgcgagtacattctggtggcagtcgactatgtctccaagtgggttgaggctatgtcgtgcagtgctgcggatgcgaggcatgccaagaagatgttcacagaaaccatcttaccaagatttggtacccccagaatggtcataagtgatggaggttctcatttcattgacaaaaccttccgagacctcctacgagagatgggagccaaacacaatatggccactccttaccatccacagaccagtggtcaagcagaaacatcgaacaaacaaatcaagaatattctgcaaaagacggtcaacaaaatgggaacaggatggaaggatagattgccgtacgcgctgtgggcataccgaacagcgtacaagacacccattggaatgtccccatatcagatagtctacgggaagtcatgtcgactacccgtagaacttgagcatagagcatactgggccatcaggaattggaacatggattttgagggagcgggagaatggagaaaaatgcagattgctgaacttgaagaatggaaagagaaggcctactacaacgcgaaaatatacaaagaaaggacgaagcgctggcatgaaaaaagaatcaaaatcaagaaattcaagccaggagacaaagtactgatattcaactccagggttaagcttttcggccacgaaaaactgcgcagcaaatgggaaggaccgttcgacgtcatcgacacctcttcgcacggggcaatcacactctgcgacgactcaggtaacatatttaaggtaaacggtcaacgcttaaaaattttccttgagccaaatgaaactttagaagaagtggatgttattgaattagttgattatgaatagggatgaaaacggagcggatagtttccgtccgctccggacaaaaacggatacggatacctttcggatcggataattctcggatatttcggatacggatacggatattttctcccggatacgaatacgaatatggtatcagggtttccgtcggatacggataataattcggatatccggtgaacagtgctattcggatatccgcaggacccatgagacataccccatttctttctaactctataactttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcgagataatccgtatttgtttccgtattctagctatccatattcgttttcgtatccggtaaaaaatatgaaaacgaatatggtatgagcattatccgtccgtatctgctccgttttcatccctaattatgaaccatgatgatctcatctattgcatgcttaaaaccctgtatagttgccatttctgcgctttgtttaggttttagtcatagctattaggaccggaccggaccggcggtccgaccgggaaaaaccggaaccagggcctcggccggtccggtccccttaaaagatcggctgtgcaactgaaccggggaaaaccgattgaaccgggtggtttttatgaaaaccgggctttaaaccggagtggtcagaccgggctagcttttggtgatgggctcaggcgagggccgctgagcaaagtccaccaaaaatcgctggaaaaggatgtgggagtggggatttgaccatgggttgcgcggttgagagctgcacgcactagccaccacaccatctcgttgcttctgttggtttaagacatttaatcctataatactttgaactgcggttggaccggcctaaccagtggtcgaaccgacaaaccattgaaccgagagctcgaccggttcattctccggtccggtcttaataactatggttttagtgggcctagaaaaaaaatggaggccagccggacccaccagggttcggccgaaccagggcggcgtccgaccgctcctatttttgaatgatagtctcccccgctcgttcccagtttgtttagatgcgcgtttggaggtagaatgttcggatctcaccagaacacttcttcttcctccttttctccacctttgcacattctcctctccaattcaacccaattcctcgaatttccactcatacccaccaatggctggcaaatcattgatcccattcatcggctcttcatccaattccatgtacaacctcaccggagagccaacaccggtgaatcgactcatcccggtggaaaactacacagtagaaggggtgaatgcactgtgggtgcagccccttgcaatagtgccgggctcccctgcaaatttggagcccgtcgacgagctccctggtttggccgaaccaggggttcggccgaacccttctcggccccgttcggcaacgcgatccctctcccctcgccatgtcacgaagacaacaatctggcgggattcgcctgcgcgacggcctacaacgggagagctcggtcttttgaaggcacgaatcctttttcaagatgacgagaaggctgcgccgcctcccgccgagcgctatgtgggcaccctgttcactaaggcaggggatgaggttctccacaaatatgtcacacccaccgctactccatccactccgaaggaggagcgattccgcattcaggggttgcgaactcccggcggtgggtatggcaaaggattgctctggcctttgacggcatcggagaaggagggggcagcagaatcccgtagccctccacctatgaaggtgaagcgtcatttgacgccccctccagttgtgagggctcccggccaattccaagaagatgaggtgaaattgccggagccctcgatccataagctcgctgcgcaagtgaagaaactccgcaaggagaacatagagcttagggatcgcaacacggagctaggggtagagtttgctgaaactagaaataattttgatacccttagtcgcggtttgcgcgctaaaatcaagtgtgcattcatagagatgtggaaggaaaataagtattatgctaattagatgtttcctttcccatgaataaaatagtagtaggtgtttggttttatctttccaatcatacaagcacttgctatgaataatgtggctcattggtgttaaccccaatgtttgccaaaatttgttttgtttcatgtttaataaagttcaggttttgaataagtgtgggggagatatcccagcttctgacgtgcatatactctgaaaactgttgaaatctctgaacacctggaagcactgaactctacagaaagttgcagagggatcatgcgccagagtggtaccaggttcggccgaaccagtgttggccccaatccctctcaactttcacaggtaagcaggtgagcacgtccgtcatctatatatctctaccatggtatagtactagagctgaaaattcagaaaacaactggttcgagcataagaaagataaaatttcccactaatgaaattcttcatatgattgatcttgtatattcattattctcagctgaacttgtgcttgtgaacaatcatccatgtttagggaaccctatgcatctaagtaaatgctatatgagagatgattaaagatgaaaggaactcttgtaactcttgttatgactcttgggaatttgttttcaaaatgaaattgttttaaaagcttaatcctccaattgacttcaccttatgcctaccaaggccatatgcaagtacatcaatgatcaaccttatcatgcatatgactgctggacattatattgagctttgtcaaatttgtgtgactcatgttagatatcttttatactctcatgattaagaggtcattatcatatctacttcccatttccacatataaaatttagctaagcttctacactagaagttggctttccacaaaaatatctattcaaaaaaattcctagtgtatactatgctttcttctcctaaaaaaaaactcttggaaaaaataaaatgagaaaaggagggaaaggcatggccaaagaaaaaaaaagaagaaaaagaagatggaaataaagcttgctctcaaaacattgagcaaagttgaaaagaaaatatagccatgccccttccatgatcatgccaagaaaacaaaatggagagaaagtataggaaaaaggagaatcatttctttattccaccattccacaaaaatattttattcattttccaccataaagaccctggatctaagagtatgattgatgatcttcttgagtccatatttttggctttgcaatatatatgatgcaggtatgtcacgatttatccctaccaagctccacatattagccttagaatagggatgaaatctggcacgttttaccttggtgaggatccaaaaagaaaaagtacatctttgagagacaagagagaaagtcaatatgaggaaaagagctggtttgcgaaaatttataaaaaacccatgagtctgacagagaagaaagaaggactggaatcgagatcatgccatttatcaattactcgagatggtaagatagctacttataaagttcacaggtacaggtatggttgtgaatgatttatatgcttgattcatatcttgaagaaattcattctacactaacatttactcagggacgagtaaagggctaagtgtggggggttttgttggcggctgttaaatgccgattctataccgccaacatctgcataaagttcggataataaaacatccaacatagtgataggtgctcaatctcacatattccacaagtgttggtgtatatttgtatgcagaagataagcccgatgttggaggaaatctagactaaagtgaggagaattatgtatccatacaaggatgggttgtgaacttcatcaaaatatcaaagactcagcccaaaactctgcgaaatggatagaggaggatcaggggaggacatgagccaaag

SEQ ID NO: 34784 - DNA, 4330 bp, Oryza sativa
actatcaccaccgttggatgtggggtttgacgtggacgtcccagatgcatccctgatggcggttggagggcatttcggacatttcccctttgccaaccgtcatacctacccctatataaggacctcatctcactcacttcaacacacacttccaagcttgacctgaattataagaggctctattgtactatattgtatactagaataggaagagagtagagtagaaggagtcggaagaattccggagttgtcggtaatcttctcctattttttttattctgttattactctgaatttaatataatgtttctcttgagtaatttagatttatcttgtgagaattatctcttggttagttcctaagtagcatacggaattattgttcactataatgaactaaaatatagtgattgctttggtgagttataaacactaaagtagatattaatagcttagacgtggtgtttaggtaattgttatccagtaattgctgcgtatcccacagtacgtttgaggtaggtgtagaggtggtgatagccctcgagatcacttaagtcctccctgtctgggtacgtagtagagcgacatctgagaacagcgggttgccagtgcctgaagtattgcattaggattaaagttaagctttccctagacactgtttctcactagtaaatcctctctatcctggcctatcttttgcttggtgtccttggatgaactggaggaagatttgaccacacacgttcccttggattcgatacccttggaatactccgtaggggaagtgctacatcagtatatccgtgcgcttgcggattttatctgtgactgtattaaataccaacatggagccgagccgctgacagcccgatcccacgcctccttccctccaacagcagccaacaggtgggccctccctgttgttgtccagtgttggaatattcccttcccgttaataaattgatttccaatattctatcaaatgctttaatctttgaaaatccatagaaattcaaccgtaactccgtttgaccccgttcaacttcccaattttttttctaaaaattgagatctaccagtggcactgttgtttctctgatttgagattgttttattgccttttgttggttagttttacttttcgtgtatagagcccgttacgaggaagctccggacgccgcttttgagggagaagatccattggatacgactaccgaggtagttttgcttagccatgcttacgttgtatagtcgtgtgggaaaattggattattccaattatatgcttaaaaatccggtacgttgtaccgatgtgttgtgaaataaaatgtgttgtgaaaatggtgatgatgcgaagtcatacctttgtcgtttggctatgtattgtcattaaggaccgttttctttgggaaatctatccaaacacattacagtgcgaccacatgggtgtttatgagatgcctctggctaagtaaatggttatcacatgggaatttggtgtgccaatggttgtggaatgccgaggatgaggagatgaagtttggatctttacagcccttttgggcatctttattgcctctattgtggcacacgatatataccagtagaagtagaagacatcctcggtatttcctgagtggatgaaggctgaccttgcctgatactcggctaagagacttagcccaactaggtggtgtcgacgagtgatactcgtggaccagatgagttgagtattggggtacgttggaacgagggtctacgtagtacgacatcaagcaaacagaagacaaggattatactggttcagaccccttgtcaggtaatagccctagtccagtttatatagaattgataatgatgggaacatattacaaagagagtagtcgaagcagacgatatcgacgagatcgtagtcgatggcttcgacgagatctcccggcgacttggctccgtgtactccgcttcgtaaactatggtgggtgtgttcgcgatggaattggatgcttttcacccctccccgggggtcccttttataccgtggatcatcttgacccccaagaaagatctaagtgtatttgatctggtacagcataacagaaactctatcccttccaagtaggactttggaaatcgcttgactcgtagagatattttccataatttgggacggatttcaaacgatatacatgggaacaatccgtgtacgtgaaggtataccttatcggtatattccataagtcgtaggatagaaggtatgccctatccgtaaccctgacaggtgacatgcaattttcatgggttagctttggaaaggccttatcacgaacttctgttgctgacgggtaaatggtgtcaattttgtgtcgtgtgggtaaagtgcacaacctctgcagagtctaataaactgttcaacaagctgtgcccatggtcaagggcgagtgcaaggtgtttctcatagcgtagttttgattgacaaaatatttgtggaaaatttttagtgggaagggtaacgtttccagagtctgcttatgtggcagatggctaacctttgtggttaggaacgggtctcttaagaaaatagatgcataacggagacacgaattttacgtggaaaacccttacgggaaaaaaccacgggcgccgaccgcaatgatcagtatagaggagttggatacaaacacagtggatacattggactatcgcaccctccccgtgcggcttacaagggatatatataggagaaatcaagaagtcctagtaggcaaagactcgaagtcctaatagtaaactaatcctataatgcagagtcctattagaaaactaatccgaatatactgtgagcccaaaattcggatcacatatttaacaatctccaccttgagacgaatttcccttgtagcataaaaatcttcaatctccaaacaacctcatgatgataatatcaatgtgcgccaaatagtcacttggactataatccataataacacccttgatccagaagagttagaccatacttcaaactcgccattgggaacaaatcctgaatctactggtataatttgtggaaccctagcagaaacacgaaacactctaagtgtataaaatgaagtgcataaaacgaagttgatctccgtataaacctcctggtaaatttggcttgtgaatatagcaattgaaagtgagttggattcaccaaaacataaccggaagcactgcaatttaattgatatatggtacgaagaacgtgcacaatctgaacaggagtgaattgctccaaatcgacgactttggcttttcctgtcctccaggtgcatgcaactagtagtggcttcagccctgtatatttttttttctttcccagcgaacaggcgaacaagcagtgggaggacgtggacaaacagatcgaatcgatctgtagttgcggctaacgtcgacgaggaacgaggaacaacacctcacgctgctgccggggtcttgacgctggaacgatctgtatgttcagccatgcatgctgcctttattcccttattttattttttttatttttaatgcccgagattgatctcgatgacaagccgctgcgctgcgcccccgccaactccgcatcaggatgatctcggcgacagaaaacaactcgacaagaggacaaacccaacggcgactgggaatagtagatcgatctccaatgctctgataccacttgcaacggatagatttcttctcatttggtaacttcatcaattcccatttttttcaagtgactccatctcattatgtatagcagttataaatctatctattgcaatcatcagaaacaatagcctcaggatacgtagaaggttctgtattaccttcaatttcttctgccacactaaaagcataagcaactatgttcgcttcttcaatatatcttcgaggaggtttagtatttcttttgagcttatcttttgcaatagaatgttttgtagactgctcaacaatagaagaatctgaatcttcaataacaggtgcatcttggttaatagcaacatcttcgttttcttgtgcacctggggtgtcgtcaggcaccaaggtgttgttagggccgagatggtgttttgatgtgttgatatagctaggttaactatgagaaatagtgttgttgtaataatattgctttaatctagttgttgtgaaagtgaaaagaaactaatagaggaaaacaagtaattattgttaataatcattgtgacaagttgttgcaaagtaacttgtgaaatgagacgaggagtgagcctcctcccaacagcaaaaacttgactcaccagaagttttgtaaaataaatatatt

SEQ ID NO: 34785 - DNA, 2410 bp, Oryza sativa
tatggttttctatgttgttgtatagatcatttatgggcatatccacgatgacaacttttgtaaggactactatccagtgatgtaataaagcagtcactttcattccacatttattcgatgtgtaccagatgatgcggacatcactaactcggatacacacaacaatcctccaacggtcattcaaggaccgatatcaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagagccatggaggatcatcgaggacgtccaagtcaaggtggaggcccaaaccaagtcgacgtcgggtgcaattcggagtccaggaccagtctgcactaaaacgggcgcccaggtcgcatacgtactcggattggggcgttctttatatgtatggatagctaagaagataacatttccaatggttttggtcccacatccaaattctttccgagtcaacgggaattgaccgaacaagttgatgtccagaatctgttccggtgttgtgtcaccgtatttgggcctttggcccgtgtatcgtgttggaacccattagggttgcgtcgagagggggttgcacgaccctaaactctatatatcagtatccgccaccatctttaggtttttgggttttgcttagattaatctgtcgagaacagtttcgccgctagatcggtttgtaagaccccaacttgtgagcttaatcattcatctgcaattttggttgtttctatctcgttcttgtttgtgttcttcgattggcaaacagggattagccttctcggcgaggtcatccgcatttcggcacgggtgataaccagaggagatgtggtgctgcgattgcggggctcaagagcgtacgcgttcaagaagccggatcgatttgtgtcgcgactccgcccaaatcgttgtttatcagaacctttcggaagatcgggaaccctagtgcacatcaagtggtatcagagctctagattcaccgtcagattcgctcagtttctttgccctagattagtttttgtttttcgcaattatcctagagtctacagaaaagccaaaaaaaatttagttgttagttaccttaacctagaccgtgtttagcctttgcgtgattctttttcagagtccgtagtgttgagtttgagtcctagtttaagttcatgttgctggtctagtgcgtgttttagtctaatcgtgtgtttgtcctttgtaaccctagccgctacctttcatcgtgtgttagggttcatcctttgagagccgttttcgacatcataaacacccatccagatcaccacgcatcaccagaacaccctacaactccgctgccaccatatcccaattccaccgcataatagactaggttatatcccccctggaaaacctagccggaagcagaaacttcaaacagccataacttttgcatacggactcagaatcaggcaaaatttaactttttggataagagaaaaaaatttgagctcacgacgcgctccgttgagcttatctgccaattcggttttgtagtttttgctgaaactcgccgaagcttgcctgcaagtccttctttgctgcttactagtgtcatttttttttcttgagccataattgttaccactactgtctaggacacgagtaggccagcaactaagggcaagtgacttgggatttttattcagcattactatctgtcattggattgtgtaccactcatatacatatatttggccttcctagctccacatattacttctggacagcacaggttcttgatccctgcaatcgctgactacgccttccaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacgaaggtgagaagagtccccaggattttgctgactgtgtcagccaagagcaactacgaactctccaagaaaatactcaaaaggacatcacggaggctgttgcaaagtctgtccaagatgccttcactaaaatcggcttcctgaaccacatggagaggttggacaagcggatatccacgctaactgatcgggtcgccgcgttggagacaccttccaatgaggaagtggtgagtggtgacgacgatgctcatcctgaagacacggtgtatgattccagtggttatattgacgcactggctacaaggcaagcacggttacgacgtcgcctacgcacaaaccgcacaggtatgggtggc

SEQ ID NO: 34786 - DNA, 965 bp, Oryza sativa
  unsure (1)..(965): unsure at all n locations
tcttttcgggcatcctcccagctagcgagcaagtgaccagctgcatcggaagcttctgcggcaccaaaaccatctccaccatgaccagcagagtcaggtaaaagttccttgcaggtacccgccaagagtgcctcatctgtcgcctcaacgggacgcattcagtgccaccattgccaagggtttgggcatgtgcagaaagattgccctagtcaacgggcctatgttgctacagaagatggctacatcaccacctctgacgtggaagaggaagagggggaagaagaagttgatgatgaggatggcgaagtctttggtcgtgatgacacaacggactacaggaccatcatcgtgcagcgggtgctcagcacgcaggtacaacagcatgacaggttgcaacgccataatttgtttcagattttcttcgtcatcaacaaccgttgtgcacgtgtgatcattgatggaggtagctgcaacaacttggtgagttctgatttggtcaagaagcttggcttggctacacgtacacatccacacccttaccatattcagtggttaaatgattccggaagagcaaaggtaacacaggtttgtagggtttcgttttccattggctcatatgcagattatgttgattgtgatgtggttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34787 - DNA, 5488 bp, Oryza sativa
tcgagcaaatccacggccatagctcatttcgtatttaataataataataataataataataataataataataataataataataataatgtttttgtgctaataacttggacgagctatcagcctatcacgctgtggctttgtaactgtgtcgcagatttacgaaagttttacacttaccgaaggcgactacagacctgtgggtttggcattggtctacttgagttgagctatgagtgccctcatgaaaaaaaaataaattacgtcactttgaattgggacactatcgaatcactagctctacaatggaggtcacgatgtagtattttggtagcttttaaaaaataaattatactatagtaagttaaaattaaatttaaaattttgactgcggaaggtaggaggaagagcaactgaagggttgtctacataaggggacataaggaagatggcaaaatttgttacatggcatttaaaatatatagttttgttgccagacaccccaaaaacatgaatttgcccaataacactttaaaaatgtggcattttaccctaggacacgtatgcattaaaatataatatacatctcattgatgagagagaaaacatgcaaaatgttagttttaccccctatcttctcccccattctcacagtcatcttccggcaataggacgacgagatccctgcgtagcacctgtgggcaataggacggaggacgagatgcccggtgggcgacgatgcacctgacacggctcaaggtgtggtaaatggtgagcaaggtggtgcggcaaagaggacgggtggaattatgacgtgcggagggtgaacaagcggacgctcagagagcacctgtcgtcaggtgatggcgagacgctcgcatcgtgtgaaggccaccggcgatggtcgagtgcatggtgtgcccatgcctggagaagatgggctacaacctcaacaaatcgtgccttgtcttctgctccaccagcgctgcccttcgccgtctctgctgcagatggcacggatgaccttgttccccgtagcggtatgtggcacagctcgaagctaccggccctgctgcatatggtggctagcagatcgggagcaacacggtaaaaaaaaaaaggtggcagccccctagggggcgacggcagcggaagcggtgagcgtcagtcctaggtcgcccgctctgataccatgttggatagcatagagacgagaggaatactgcataacgtggatctattgtattgagtcaggggaccggtatatataagagtacttagggaggagataaggaaggattacacatatggaaggagtccacacaaatcaatcatatcctaatatgactctaactaccatatactctaacactcacctctagcaacggctgtccgggacccacgcccgctcctccctcctccaccgacgacacaatcccaatctccaaacctctccccctgcccccccaatctccatggtgaagaagagagggcaacagtgccattttgttaaattctctctctggctcgaatgaaaataatagtttaatggtgttagtgtccagcagcaaattattcttgagcaaattgacgttcctatggtgtctaccaacaaagatcactatagtgcgtgtttgctgctatgaatgtactaaaatcttctatctactaattattattttatcttggtttctattgacgatatgtcctattgtcctgtagaaattgacatgcttcactttgcaatttttaccatcatactttctattagtcctgccccatgttatgtgcttttggttttgttgtctatccgatcatggccgagactcgagaggtgaattgttcaagatcgattcattaggattaattaggagtgtttttaaactgttggtggtttgttgtattgcacataggttgctcatgaatctttgtgtaactagcgggcattttgttaattggagaattagtgataattttgttgatggcgggtgaatccgtcgccaacgaccatggggacgatggcggtgggccttgggcaaggcggcggcgacggcggcggtggcggcaacggtctcccagccttgggcgtctggatccgtcaccggcgaccgcggggacaacggcgatgggcctcgggcaggccggcagcggtggtggcggctggattagggttccaagacggcttttgattttcacgtgtgggtgcttcacttgcacgaaaaaatcggattttcacagatacttcgttccagacaggcgaaagatccgcacgcgaaaaccgcttttgaccgcatggaaaaatcattattgtactagtgtgcgtacgaagcaaactgggattgaaaatgtgatgccatgaatgcaatttaaattgaaacgatttaggatgatactttttttaataagtattcaaagacgaaaccaatttgattcagtatgagtggtacttggtctttcatttgtaataatcaactatatatactaattcccaaaaattttagtctaaactttgtggagttgacacctccaagaccattcttatgggtaaaaaagataagatgtgttacgaagataaaggttttcatgtggctcatattctgtaataggctaaatacgagaaatatgcttgatagaaaatattatccttaagaagatgcgaccttttatgagtgatttgctttagtacagaaaaagaaactcccatacaactttttcttttcttgtccttgcagcagaaattgttgggagagaattggtacaaaaatgaatgataacctagaactctttcacatgttggtcttggcaagaattagattcataagaaaggaaaaatgtttattgcaggcatatctgaaaataaagaaataggaagatctttgagaatattactcatggaatggaagtctttctttgtccaagatgaatgactctcttagctccctgaattcttcttggttacaatggttataattttatttcttttattcttttcttgtttgtacataactttttttaatatatataacaaataggcaaggtctggtagttattttttttaataaaaaggaaagtgaaaaggaaaggtaagagaatggacaatagtgtgacgtcagcatttgagagaaaatgccacatacaaatttttgatgcggaggaaagaaaagtaggatataggaggatgtcgtcatatataataactagagaataccccgcgtgttctccgggattccgagtcttaatgcaagttgctgtggaattccactataaatagtctccctttgtcccatatttcttgtcttccagatttagggcttcacactgacaccataatttacaatggtaaatcgataattttgtggttgcatttagtttagtaccaaatattgataatgtttatggaaattggtgacatcacatttattccatcatatcaaaacttaaacaattttatcaacttaccaaaaattttgatttgactaaattttaaaaaggtttattttggtagtaataatcttaaacatgtcctcgctaaagattgggggagacgtggagtacataggagtatgttccagtctttaggtgtgattgctttaagattggtgacgccacgtgtcaagattgtagaacgggcgtggggttcaagtgcctctccccaacaggagtacctcgtcggcgacctgcggcggcggcgatgtcggcggcggcggcggaggccaccgagcggggcgagccctcgggcggaggcggagagatcgcgtacgtcagctacggcggggagcaccacctcccgctggtgatgtcgctggtggacgaggagctcagcgagccctactccatcttcacctaccgctacttcgtctacctctggccccagctcactttctcgtacgccctctcctcccctcacctcgcgcgcgtgtttcacaagagttcgtgaggatttgatgcgttcttggttgatttgatttgggggacaacccctcaaaaggcgttcgatcccaaggatggcaagtgcgtggggacggtggtgtgcaagatgggggagcacaggggggccttcagggggtacatcgccatgctcgtcgtgctcaagccctaccgcggcaggggaatcggtgagccctccttcgattctccaagaagagtttctctgtttgtttgattggttgattgactggtttgtttcaaaagggagcatattcttccctttgatagtatctgcacaagtctgtcctgaaaggaagcgtagaccactcatgaatctaaataagaacttaagaatcctgctgattgggaggaaagcaaagggtttttcagtttttgttccaattcgatctgaaatggctggcacctggtggagtggtgggcgatttagtacggatttacaatcttccatcgatttcgatatgatatccatatgtactaaataggtgtttttcccttgttatgcttgcacaaacttaattgagtatcacttttacatgtgtcaagaaattactagctataggtcttataagtctaatttgtttcatgatcctttcacactaccatttacttgttttttctctgtaatagttgctttgtgttgatatggtattatttttgtcttaacatcagcaagtgaaatatgtctgtgtagcagagtggaacgaaaactagcttactaagtgttactggttttctaaaaacgatgccatgttaagtatttagtaggatttctttgttctttgcctgcttgatttgcagaaaggaaaggcatttttttatttcttttatgggtacaatagccttctattgttcccttctcttaaactatataatcttctctcatcagtttcaattgagatttgtgctattattttgataaaatgttagttaactttgtttaggtggttttctagttttgtgtaggagtaggtattgtgttatgaaccaatattcccatgtttagttttccctgtgacagatgtctcgtgttgggtgcttcagcgattcagtctgtggcacatgagagcattttggtcgattagttctttatggttggagccatttagcacttcatctgatgttgtagtatgcagcctaaccttatcgttacatcaacttcttgcatgagatgatttcttcttagtgtcatacacttggaagcgtgctgactataattgatgtagcaataaataggtgtggtgcgacttgctaatgcatatatcctgtgtggggagtacatttttcataatacttttatcatgaaatgcacactgatatttacatatatcttggtacaatggcacagatagtctgtttatctgaaaaacatagcctatgttgtttctgtaatgacattcgcagcaaggatcttgacagctttaattgttgaatcctgcctcacatgaatgacctttctcgatgtatgaatacagtatatggtagctttgtcatctgttaagagtattgcgaaagctccagcttcagttcgaatagctttcct

SEQ ID NO: 34788 - DNA, 375 bp, Oryza sativa
actggcgccgccgccttcctcgatggtgttgtcgatggccggcagctcggcacggcacatccagagccacggtaccagtgcgtgcaggggagacgcaccacgggtgtccgctaccgcgatttcctccgtgcacaccgtcccagccacgcccaccgtcgagcacaccaccggtggctttgacaccacagcttacctcccgccgcacgaagggggagggtcctcgacggggaaggactgctcgttgcagctgccctgtgcccgccaggccggagcagctccctcgcagtcggtgtggcccgtaaattatccgcaagagttagtatagaacaagaatatggggaaaaaatctcaatgcatgatagtgtacaacataac

SEQ ID NO: 34789 - DNA, 748 bp, Oryza sativa
attattgctctatgggattggaaaatgctactagcctagtgatattctaacctggcagtgctattcaatcttcttagtggattaacataagatgaatgtttacatagtaggaaaatatgtgatttttaattgattatgataattattcttggctgatatctctctcttgaactttgtagcacgtggaagatcatttcctttattctatgaattacatgcattttggtgaaccaaaagtatggtatggtgttcctggtgctgatgcagtgaagctggaagaagctatgagaaagaacttaccaagattgtttgaagaacagcctgatctcctacatgagctggtaaccatttgaaattgcatgtttgttatgtaatagaattgaccctgtgattctaacaacatgaattcactgattgcaaaataaactttttggatatattgcgaactggaaacaacttagcatccatgtactgaaattcaaaggaaaacattattttctgttccattttagtactctatttattatcattgcctagtgcctactaccagtcacaaattcttgctgacactacacagtggttcatctgagaataattatcttcctgtattgtacaaataaatatgctgcatcttcattcattttcatcctaaattttcatggtgcaggttacgcaattatctccttctgttcttaaatcagaaggagttcctgtttatcgtgttgttcagaatccaggcgagtttgtt

SEQ ID NO: 34790 - DNA, 1492 bp, Oryza sativa
  unsure (1)..(1492): unsure at all n locations
agattgcttcagaaaaacatgataagaacaagatggttgtcaatcttgagtctccagcacaagctagtaatccaagcaggtcaaagtctgactgcagtggctcactgtccttgaatcattcatctgagttaccatcttcaagaattcaaacaggaaattctacgctagcttccattaccacagagaaactgtttggtgttgacattaaatccaatttagcacagtcttctgatggccaagttagtcaattggccaagccttcctcgagccaaactgatgaagtctctaagccagcaatagctaagtatacggttgagctgctagacagtggaacaatgatgattggtaaaaagtggtgcaatcagcaagctatattccccaaaggtatatacactgaacaatgcaatgattatttttgtcttctggtaatatgtacatcctccagaaatatcactaatagaaattcatctatgcaggatttaagagtcgagttacatttcatagtgtactagatccaacaaggacatgctgctacatctccgaagttcttgatgctgggcttcttggaccattgtttagggtacgcttttattataaacgcttcttgtttttctaaatttcaggatttgtctgctttccttcattgtgctcacataagctactgaattaatacaaggtgactgtcgaaggtcttcaggaagtttcgtttactcacacatcaccaatgcaatgttgggacagtgtaagagacagagtaaatgaagaaatagcaaacaaaataagttttggaaaatctggcctcctgattttctatcctgcanttctttgaatgaacttgaaatgtttgggttcttatcctcccctataattaaggtagatttttacgatatccccagtatttatttttgtgaaacctggtcacttcaagtaactagttgaatattacacaaaaattctttgttgttcaacaggaaatcgaggctctagatccctgtcaccaatgcttggactattggttgtcaagggtttcttctgttggaactgaactcccctcggaatctgtgatggcagcaatggttaatgactccgctaaccccccaataaagttgctcgggattgagattaaccggagggaatcagaacaatcaagtagcttcaataattcctgtgtgaggaggtcacacttggcaggttgctgaagaaggctagctaagctcccagaagaaccagagctaatggcgatgaaaagaagtattcagtagcagtctagtggatcagatagcagtggtatcatctggagtggcaattgccactctccaggatgagatgaacaataatgtagatacatagtgccatgaatagatcagaaatttcagataactcatcctagacagcttccctagggaaccattagaattgaaatagagccaccattggtttgcattcttctagaattgcatttcttgatattcatttcagcttgatcccaatg

SEQ ID NO: 34791 - DNA, 578 bp, Oryza sativa
ttgatgctcctgggttctcattcaaatccaaagggaaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaac

SEQ ID NO: 34792 - DNA, 1427 bp, Oryza sativa
gactggagtagtagatgagttcaacgaacaagtgcctcactgcccctagccatagggaacgtggccaaataatcggagagatgctccttaattttctcaacaatctttcaaacaacgggcacatcgatagttgtgaggataaacttcacatgcatcatgtccctacgaatccaaaattatgtttcgagctccggatgcaaaaccaaaattttggcaagggggcatttgttgacactgattttggctcgtatcttaaataagatgtattaaattataaactaatatataatctcaaacataatgtaaaaaaataaataaacaaaaataggaataaacagtcaaaacagtcaaatgaataaataaaataaaatggcgaccaaaaatatatggccgcaatataaaaataaaatccgctcggtcagagtgaaatgatttccggcgcaaatagaaatgcgtatgcgcgtgccatataaaaataaattagcatcttggaaacacgttcaaaaaattaaaaaacgtgaacaaatattttttacgtgcttttcatcggaccgacgaacgctgatacttagctttctggtcgtgtgcacatatgaaattcgtgctataataaaagagatcgtataaatatattgagactacgattattcgctaagtacacacctggcctaaaacatatggccgtggaataggatttttcccactcacccaaaatagtcatgtcctaaatattttcaggaaaggtgtacgcaccatataaaatagttttagactacggtcatccaataaattaaaaagaaaaccaaaatatatgttcatacaacaaatgagaaaattatactcctaatttttgcgacgtgaaataaaaatgcatgtcacgtgcagaccgctataatgatgcggatatataaacacgcacgcgccaaataagagagggccagatgtcagtgagaggatacacgcgctctctctcactcaataaccaggcaattaaaaggctaactggagtaataaagattagaatgataacaataaatgggaaagcatgtaacgaccaggggcatgaccggtctgctcatgttcaccccactacctgcacgcacgttgccacattcatccagtcaaaatgaagggacccacatgtaagccaaagaaaggtgtatgctgttgagtccatttcccacgatctgcccacggatgcgcgcgggactctgttctaaaccacgaaaagctggttaaccccctagcggcaaaggaagttccaggggagattagcgtagaggctaggtgctgttcgtaggctttgcagaagcgctgcttgttgctaggcaatactgctgccgttccgctttgctcctatgccatctcgtcagcctctgcttcctcgctccactgtgctggaagatcagaggtgtttaaggtgggaa

SEQ ID NO: 34793 - DNA, 5078 bp, Oryza sativa
attgtttgagtgccaagtatgacatatttcagatatggttccggttattgacagttaaaaaagttgaattcttatggtagaacaatactttttttagccatctatgtatggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtcccagccttgcagctgtagaagcactgcgtgcacgtgattgagaccaaaatgtaattgactctgtagatgtcgcatgcagtctcagcttatgagaatacactgcacttgcatttgctggggttttcaagtaattcctttgtcatgttcataaaatcatgcatattttggtttggaacaataagcacgtgggttccttgcctatcatgggggtgaacatatatacaatggtttgatttgatcgatcttttgttaatacctgtaagatggaattcctaattgaagcatcatactttttcattatggtatgtgccaagtttgtatacttaatcatagttctaaacatgcagggatggtttgaagctgtcaagcttaaaggagaatccgtgctggtcactgtccaaaaaacactgagatatctctactttgaattttttttttacctcgacaatcgataagttttcattatctgtgtaggatgcttcagatgctgccagcagtgctatggttagtgtgttggtatagattcagaaacggtgcacgaattatccgatgctccaatgacgaagtagatgaaaaagacagagttcaaatagctagcaaacttcttgtgtcaagtgtttcatttgatgttttcggttccctatttggtaccattgtcatgttgtgttattttattgcagggaaattacgctgtttgtggtgatgtgaagggtattgaaaaagttgaagtcccttaaggccagaacgatggttaagtgttcccatgcatctatatgtgttacctgacaatcataacttgatgtgttgtattttggaaatgcagtaaggttaatctactgaatactagctcctttgctagaaagaatatttgctcccatccagcagctctcccggtaccgaatctcggcccttcatcctgcccgatcgaacggttggaaacatacggtacctccaggtacatatttttttatgagatggtaccacctgtattgagagtggtggaaaggtatttttgtcttttcgtgtagataagttttctctagctgaacaccctagtttaattccccttgtgtgtggtagcggcggcggctgcgaggtagcgagggcccgtggccgtgactttggtggcgggcgtggggtgccgactacggtgatgaggtggtggtgctgtggcggcggtggccggtgcgttagcgaccttgattgtgaggtggtggcgtcgagttgttgcggccgcggtatattaaggtggtcgtcggagtcggtaaatgacttagctgaggatttatcaataatttcacagcgcgcacagagattggtgggaatgttctttcatcattgcttgtatggcattgccaggtcaatgaaggaaagggcttttcagataatccccatgagaaataaattagagggaattaaaagggattagttccaggtatatgaaatttcctttcgattttcttgtgaaaggaattgaccaaacaagatctaagagaaataataaattaataaaggtacttgaattgagaacattgatgcgtgagatctgtaagtatcctaatgtatcgaatgttagcaacaggggttttgtggcaaactgtcagtagcccatagttcaaagtttctttttggggtttcatgtttatttacaccctgtggttctttgactccaggggcggattcaacgtgggtgtagggggacccacaagacccatagatacccctcggaacacctcctttaattttttcaccatgactgataaactaaagatccctaaatgactggaggttaaaaaaactgtgtaattgaatccccaatattttgttcctggatcaacccctgtatgaccctccacgtgtgtgcatgtgcaacggggtacaaacaagacccataaatactgctatagtttacgcaaaaatccttaatgctgctcctacgctgagactgatataaattatatttgtattcagaaactattaagaagtggaggtcctccatattatcatttcacgaattatactcctggtcgcaaatactgttgttgtggataagatttaatcaaacttttgatgcttcgactgtcaatggtttatgaaatacttaatttgaaaaaaatatattttatgtatatttgttttaaaaatacagtaagtataacttatagtaccttataaacttaggctgctttcagaggtggagattcggagcttcatctccccgcacgtaaaacaaagtgattcattagcgcatgattaattaagtattagctaaataaacttgaaaacaaattaatatattttttaaaattaattttttatataattcttttaaaatctaccgtttagaatatggatagcgtatatgtgaaaaatgatggagtagaaattggtaagaggtgtgtatataaactaattcgaatataaaatttgtggtcaaaatcgcatctcaagctcagttaatgaaagtcaaacgtcgaagtctttggtgactgaatggatcactttaattggagaactattaaagaactgcattgtagcctgtaggtatcgaagcagttcgcagtttcagaaagaagcaccttttgttgcaatgtttagtattctcaatcggtttataaactggttaggtaagaagcatggatggctgaatcgtcggcgttagttagctcaatcgattggtcaagatagagaaagaacatcgacaatggatgtgctgacatttgaagaaacagcccggccaagaaaatggatacagatttacagtaacagataaagaaagtgttcgaaattttagcaaaaattgggttatctgaattgaacagctcagctgtctttctactaggagtatgcctcccaacaggctgaaggggcctcaacctttctcgctgtcttctttatagccaatacatgatcggattgaactgagtttattagaattatttgaggcccaaacaaatgaattgcatattaaaaagattttttttaaaaaaatatcgtttaggagattgaaaaacatacacacgataatcaccaaatccataaagagagaaaaaaaagtaggcatctccatctccaatatttatggccttaataacattaaggtaggtctcactatttcttggttattgccacaatgcttaaaacaagagtgtatactaagatggacctcacaagtgtaaagtttattacctttatcaaccatcttagttttacatattactttattgcttgtggttgagccataagtttggagttatcctttgcatttagaggttgtttggttacctcctaaactttgccaaacattgttacacctcatgttaggcaagtttgatcaagttagctcattgtttggttcatgaccacacttgtgataagattctctttcatttctcatggtcccatatgtcatcaactcaaaagtgtatggcacacttttcttttgctagctaaagtgtggtttacattttgttggtcataacttagctaaagtgtggtacaaaagtattataaatttgtaccggttaaaaactacaggagaaacgatctttaataccggttgtagcaaccgatccagtaaatcgagactaaatatctcgatctcaagatgcatactaagacaaaaaaaaagtgagatgtggaattcgaactcaagagctctcacctcagccctgctttctttttaaactaaccctggaggcatctttagtatcggttggtaacaccaaccgagaataaagatgtttctaggtacttcgactttaactagtactaaaacatctttggtactagttcttaatctagtcgagatatttatgttttgggacttaggataaaaaatcgtttctcatatattaaagaatgaaaatgttaatatagcatccaaacaaccatttagtgtattgtggcttacctccataatgtatatggtcaccataaggtctttttataatcactttttggctgctcatatagtatatgtaaggttgtcagtccagtttttggttttcttctttcggggaaccactatatttctgtatggccattttagctgatcgtatgctttcttttatactagaattaactaggataaaaatagtttgataccctgattgggatttgacactagagtagtactactattttttatataaaataaaaatcaagggtgcatcatacattcaccaattcacgtcacagacgaaagaatgcactggccctttttaccagcaaaccaaactcatcagtgcctaccgatcgtagcaagtgaaaacaatgaaggctactagtacaattatttcttttccaaacacttttttgccatcaacctctattgtcatatactacctccgtttttcaatagatgacgccggtgactttttatcacacgtttgaccattcgtcttattcaaaaattttacgtaattataatttattttgttatgagttgttttatcactcaaagtactttaagcatgatttatatctatacatttacataaaattttttaaataatacgaatggtcaaacatatgttcaaaagtcaacggcgtcatctattaaaaaatggagggagtatgtggaatatcaccgtatcatatcctctaacaaggtggggaaggggaggggagggaaggggagggggttcctaaaatccatatatacaattcgtgaaaaatagaaatgattccgtaccaccacaatttgaacttcataaatatcttaaattatgatctacatatgaaatgaatgtaatccccacataaagatctggatccctttcacacatttaggcagcgtgtcatctttaacc

SEQ ID NO: 34794 - DNA, 1265 bp, Oryza sativa
gcgatctgggccgtcggtccggtggaccggcagccttgagccgctgacccgggggccccacttgccggcgcccctctctccccttgagccgctgacatgcgggccccgcctgtcggcaccaccccccctttgatgacgtcagccctgggacatattgcgcaataaatgatttaaggactttttattatagtaataaacacagtgaatcttctaaaattcataactaattcatccgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttctgatgctccggtgtacttcgagatagtcgccgaggttcctccaactgcagagcaaggcaagttatgcctgtcacttgaacatgttgatcctatattgcaaatggtctattgtttttcttcaaatactgcattgttttataatgttactatgggatgtttacctattgttacagccatgctattttgataccatgctcctttgttagcttgcgttataacatgaatagactttggactaggaattgcttagccatgcttagttcaactagcacacattggggaaaaatcctattaatgtttagactgtaggttctaatggtaatgttggattagtgacaccgcttcagtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctggacttgtagtgtagcttttctttagccgacgcatccaggcaagggtgggcgtgatggagtttggatgggccctgctacggcctatgcagcttccggattcacctaagcacgagaggggactgcccgctgccttgtgaggagtgggagtgaaacctgaagtgtggtgtgcttggttagagggggttatgcgaagggtcctgttacggtctctttccggtatgtcgtggtggcatgtcggcgcacggaaacgtgtcgtggggctgtgtcttgtgggtacagttgtacacctctgatcagagtaaaactattcgaatagtcgtgcctgcggttatgggcggtcaaccagattcaccgtgattagtctcaccctagtttagtctaatgaaattggatactata

SEQ ID NO: 34795 - DNA, 1307 bp, Oryza sativa
agcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtgatctttttgaagagtacgttccacctcacagtgagttagagccatctctcttgatgtacccaaagagcttaatgctacatatggacattaggaagagtcttgaagttggtggagaagtttcgcttcaggattggtgtgatcattttcacaaccgcatggaggggttgccagattcctcgggcattgagtcctcacgcatttacatagccgcctttatagctttgtggctttgttgcttcgttgttgttgggttgggtccagtccttcgtcatgggggtattggtcatggcttcctggatggccctagggtggagaaattcgttggctccgcccgccctatgttctttgtactattctttgatattggctagtacaaatcttatcatgcccttccatgctgcaagtagaccatggcctatacactttttggtggatgggcatt

SEQ ID NO: 34796 - DNA, 2803 bp, Oryza sativa
acatcggtgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagttggtgtgatcattttcacaaccgcatggaggggttgccagattcctcgggcattgagtcctcacgcatttacatagccgcctttatagctttgtggctttgttgcttcgttgatgttgggttgggtccagtccttcgtcatgggggtattggtcatggcttcctggatggccctagggtggagaaattcgttggctccgcccgccctatgttctttgtactattctttgatattggctagtacaaatcttatcatcccctcccatgctgcaagtagaccatggcctatacactttttggttggatgggcatttatttgaagaagttgtatggcaacaaaaaacaacacccatatttcccttcctacagacacccttctgctgagaagccactcatggagcataccatgtttaggatcccctaattttatacactgttgacggacgttatagaccaatctcgaccgtcaatataactataataaaggagaactagctatgcttacaatgcatatttgttttagaataacatatctccacttgtacttatagtattatttgttacaggaatttagcaaataaaataaagagaaagtgaagaaacctcactcctaagcaagcttatggataaggagggtccacaaatcaggtgtaaccatcctggaaaccgcattaactgccacaaccaccaataggacccacctgtcacccaccctgccgaagctggagacctgctgggctagcccaggttcagccaaaccctggctacgtcggctcaggtcagccctccacgtggacgctccaaattgattcccaatgacggttccgggggaaaatggacaattcgcatagctacaaccatcataactgccctataacaggaggagttcattcactatctcaacacactcaagcaagctcaagatttctcttcatactttagtttagtatttttagtgctaagtggagtagaatagaatagttctcggagtcctcggagtcttcggaagagttccggtatggctctagcagcttttctactttcatctataagactttcgaaattaatgaaatattcttctttatatactttcagtactttgcttagtctgagtattgctcttgctttatgtttgcgtcggtataattgtgtgggtagcctaccagagaggtgcaatggcatgggtttagtgtccgatttatcggttgctctatatcatgtccagaggtgtagagtagtatttattaatgtaagcatggtgcttagattactaattatcactatctgggcatatatgctgcaggacagtagaggtggaccactgatgatgacagctcaatacaggtattcctccacgttagtatatattcctaagactaattcctagggagggtactctcatgtatttagccccggttggacggccatgacaggttgtcgtaaggaactcggtaacccaggatggtctctcgaaacaccaggagggcactgttagggggtattagccacatgattgtatacttctgggtgaaatgctacaatggtatatccgtgcgcttgcggattacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctgggggtgccttcttatcaaagacggtcaaaggggccgttgatctcatcgagaagatagtgtcgaacatgagctgcagtgaagaacatctccagacccatcagcatggcatgcatactgtcaaggagacaaaaatgctggccgcaaa

SEQ ID NO: 34797 - DNA, 11167 bp, Oryza sativa
  unsure (1)..(11167): unsure at all n locations
ttatcaaagacggtcaaaggggccgttgatctcatcgagaagatagtgtcgaacatgagctgcagtgaagaacatctccagacccatcagcatggcatgcatactgtcaaggagacaaaaatgctggccgcaaagctggacctcctgatgaagaagctagatgatcaggagaagaacaacccgtaggccgctgtcaaggcactagactcgcacatcacttgtgaggtctgcaggaacactggacactcggggaacgactgccccgacattcgtgaagaagccatgttcatggggaacaatggctatcatcccaaagaagaccaggggtggaaccagccctgcccgttctaccaaggaggcaacaacaacaacaataacggtaacttcaacaaccagccctccttaaaggtctatgtgggctccaccagaagactcatcgaggtagataagtcaaagtgtcacgtcaacgaaaccactctccaaacacagttgagagagtcaagttacaccggttttaataatttgggtttcaaagatatccggtattatggttcaaacgacatcaattgaggattggagctatatttgagggacacgaattggacttatttcctttttgttttccgtaagtggaccgagccttagaggctctgtagtaggccaggccgcgctaggagttctggcccaagcagaggagagagggtccagcgctagggttggcccccgctctcttcgccctttgcgccgcttctcctcttctcttctcttctcttctcttgggaacctccacttgtgctcgcctcctcgtcctgctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggcttccttggtacttgttgtagaacaatggaacccctagtggatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccaaaaaaaaccaacttctggggacaaatctagacaaatgcatgtccagatttatctccataagttgattctttttgggacggagggtgtaaatttgcggagaatcctcctggctattactcaaattcactccacttggatggctagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaagaatcctccgctggactgagagcattggctcttcttggagttggtgcttctggtcttttaagctttgctacaatagcttctgcagatgaagctgagcatggtttggagcagctgaatatccctggcccatgctggcattcttagctcttatgaccatgcatcgtgagtcatcctttttcaacttccttacaaaatagagtttagctcattgcaatatttcagagtctttgcatacggtatttggttattattaattgatccatgctcttggttaccccaatccttcaaacctacttcaccaatttagtttcccagtaggatagcgaaaagaatcacaatattcttttgctcccaagaaaatccttttaaccactactaccctattcttgctgtttactcattgtcttatatttgaacacttctatgatcagtattcggcgtggacatcaagtttatacacaagtgtgtgcctcttgccattccatgtcattaatttcgtaccgagatttggttggtgtggcctacactgaagaagaaacaaaggctatggctgctgagattgaggtggttgatggtcctaatgatgagggtgaaatgttcacacgtcctggtaagttaagtgaccggttcccacaaccatatccaaatgagcaagcagcccgttttgcaaatggtggggcatacccaccagatctcagtcttatcacgaaggtaatgatattttatgccattggcgttgcattgtttaatcttccaccttcaagttgtaatttactgtttgactccgtatgttcaggcaaggcacaatggccagaactatgtgtttgctcttcttactggttaccgtgatccacctgccggtgttcaggtaaatctcattctctgtcagttataccttaggcatttgcagttgctacttgctatgtgtatcgcccttaattcctttacaaacaataaagatgctcttgcatgtggattgaatcacttgtgtcacagggatacatattttacagacacatgatattgacatcaaatttgacactgttgtaactctgtaattgcaatactggttgaacttggaggtgctcagcttcaagttgtgttgtcccattgttgtttgagtgttttctctgttaatttacaattattcagcctctcatttgttgtcagttattgtttggaattcactacataatcactatttttgttcataattatgatgttgaactctattttgaaaaaaacctaacctgtcccacgaagtgttatttttctagctgtaatttttcaagctggttgtgttctgttatttgctttctgcagtgtgcaacattagtaaactctctggttgatttgtattctagatccgtgagggtttgcattacaatccctacttccctggtggtgccatagctatgcccaagatgcttatagatggagctgttgaatatgaagatggtactcctgccactgaagcccaggtaagtttctaatgcgttgttgggctcttacagttgtgacatgttgggttagcattaagggcctaagcatgattgttgtcatcctctaccacagatgggcaaggatgtcgtttcgttcttgtcatgggcagctgaacctgagatggaagagaggaaactggtaatcagctcaacttttgtccatttatatattactttcaattcgcaatatttcctaataccaacctactctaatttgatgtagatgggagtgaaatggatcttcctactgtcacttgcacttctccaagccgcatactaccgtcgcatgaggtggtccgtcctgaagtcacgcaagctggtccttgatgttgtcaactgagggaccactgtttcttactttcattaaaatgttttgagcatttaagcggaagcatttcaaataatgagtatgatgtacattctgccactggggtttcccatgcctagaattttctgttttcttcctctgctgcaaaagcattttcttcatgggagcacttgcaatttttgtcaatgttacctgaatggtaccagcaagcttctaacagaactgctaaagttcataaatctttatgttttgaactgtgcacaattcatttgtttcgagcacgctgatgatttgggtttgcgtttttatgtgacggatgcctgttgaactgtcctgttttgtgtttttgtcaagttctgtgtcgaatctatgcgttcattcgcgctcaagctacatcggtattgtcatgcgcatatcatatgtcaagcggtaccaatttggtattttttttccggtagcttcatgtactatgctgtcagaattttgcgaacggtctaatgtaacagaagatacatctaaacgaaatttaacatttgtcacaactcacttttgcaatggctaggagtagagtttacatcgacctgaactcgtaggctctgtttggcaaatgggatgaggagtgtgggaaatggatgttatttccatttttcatatttctactgtttgggtgtggatgggagtgggatatagaatcctgcttgatttgagggtggattgactactaggaaaaattattgaattaccctcaccatttgaacttatagctaatagctgtgctgtttgtttactcatttagcatagtttgaaggggtattttagtcattcttctagaaacttccttttccaatccatccaaccaaatatgggataaaattttccttcgtataaactaccaccacatcctaccaggatattatatccatttcccaatgggtataacccattagccaaacggagccgtactcctaatgagtcactaggcatttagctcgtaagcttatatgccagctcgtgaattgtccgtttagctcaaacagttgtccgtttagctcaaacgagtcgaaccttaacgagccgatgacttgtagtttgtgcttgctttactttggaccatccaaaaacaacaatttgttttgcataaaagaaagcttaataatatcaatttatttttccaaaaaaagttaacatgaatcaatgatgtctcatctaaagttttttttttgtttgagttggagttcgtttaatttgttcttcgtgttggatttatttactagagcttgtagaaatttttttcatggatttatcttgagtttatggagatgttttttttgtcgaatttcttttaattccagtagttcactacatccacaaaatccataaacctaattcaaatacaagggtgtatcaggagtacaggttgctaactcattcatctcgcttagaagacgaggttgtttattagtgcataatccattaagtttttagctaaaatgacttgaaaaatagatcttatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaattgggccagaggaagtaccattttactgtaggtctttgtcgaatataatggtgcgtgtgtagtggagtggtgtttccatgtaatccggggaaaaaattccctaaaccctgtcaggccaaatctttccaacccattctattcatctggctgaacccactcttctctgtcttcctccactcatcttatgtatacttcgaggatgagcagagcacctaaaataaataaagaaatatttgccgctactaaactaaactagtatcgccaaaaatactgaaatacaaagtcacaatattaaagaaatatatggtgaggaaaaaaacactttatgcgtgaaacaaatcaaggccatatcttgccatatctggccttatccaatatgtggtttgagtatcagctcttgataaatagtctcaaatgaacatgcaaaggagctcaccgttcagcaagtaaatgtagctaggcaactcaaactaaatcaaagccattctaggtacatcaagatcttaaacacaaagggaagatgaatggcatgcgtcgtttacaggatgcacatctgattttgaatacaaggatctaacacacaggcaaagcatgcttcacacaatttagacaaaccacatgcttctgctatgttgagcttttcctagcttagcaaacaacagggaaaaaggaacggtaacttcattgcttcatgtttgcggtgggggtgtgctgtcacagcctgctggcttctttcctacagctttggcttggctgccttttgcacctctatcatcctcatcagcctcatcgtcaatcagcgatccggagcgcatcagctccttcaccttgaggaattcatcatagtgagcacgacgatgttccttgaaactcagtcttgacttttcagcttctggatctacatgaacaccaacatataactaactctccgatgataccaggaaacatcccacaggaactatcatactccataagatttcaggttccctatggtgaataacagattattgccaattcgtaatgatggtatgtatcccttgcttatgtcgtcaaaagaaagtactccgtatacaacatgattttaagatgaattgacgaaatttaccaacgaggaagcaagaactaaacatttgtctaattatataaaacagatatattaagaagagctgtgtcatctgtcatcagatgcatctaggtcaaaattgaatttgctttggaagttaatagataaattggagctagcttaacatgtggaaataaatgaatattgataatcacttctgttcttttctgaccatcaaactcaaaaaatgtgttttaatcatcatcattttgagctggtacaaagtataaccttcaagatttattttgaactggttctcagaatctctattaaatgcctcctctccagatatgtacgttgctttagtagagcaatgctaagggtttggtcggtgtatgtgctttactattacaaaatgttaacatactataacttccagtaagatttgcgctacttatccaatgacaagacttttcagacatattcatgtaatttcctgataatcaattaattaatttttccatcaaaaacaagatgtcttcaaatgcatttaactgaaacagggaaaatataagagcaaattactacatgcagggtagatatatgaaaatgggaacagggtaagaggcacaaccatcatcttgttccatggcatctgcatcatcatctgaggatgcccaaccatcatcctttggatcagttttgcttgaagaagccacaccatttaaagcagttaaaatagcttcagcattaacagtctcatccagacacttgtcaaaaggacgcgttggtgacaatgaccctataaagaaagcaatggcaagacatattcaacaacgacacagtaactaatatggtcaagtaaaggtataatgagatcagaacaggaaaacatgtaccatcatcatctaccatagggtgatatggtgtcttaggctcagttatcttctgcctaacaggtttatttgattcaatctcatacaggttgtcttcattccacttcacacgacgagagctaaagaaaaacagtaaaatcaaattaagtaaactctaaactcacgcttgtgcagtagttttttttcaactagctcttaacagtccagcatttccacaccaaaaaagaaaaaaagatggtgtatgaatctaaaactccataaagttctttaatctaaaaatcaaacagtttttcgaaacaaaattcatgtacaaatcagcagctatggtgtatctgtctaagcacttagggccttattgtaagttattccaccatggtaccatcatcaaaaggagccgtgtcacctttttcttaacacaaaactttgacaagctctgtttgccctttcatcccttcagttttaacgtatcaggttctgaaatccaagcagcataaatcaacaaactactatttctgggcctaaaagattgagacatcatacttcaacaatcatacagctctaaattctcaactttttagtatttatagtaatatttgattttactaaacaatcatacaatcatacagctctaaattctcaacattgagtcccatctaaacaatatttgaccctgaagtaatccggaatggaaccactgatttcatcatcattgaaactgctgaatctttacaccacctcatattaataactgcctggctggaaccttaacttttgtaaggtaaaaaggaaaaaaaaaggaaaaacaactgtaaacaaagaggtgctgcttaaattgattctttgtcaagggcccagggttcgtggcctttcttgactagctttgtctgtggtttcttcttagcttgaaaagatgagggggcggtctttcccccgccggccgagttttgtttttttaatttacatatcatagcaactggaaaataacaaataatcctcagaatttaccaaacatacttcttggtaacgtgttatgggcgtgggcctaaggtatgcaaaccagcagaaatatgtccaaaggtaggaagcaagaattgacctcatgattaagcttcaacacctcccagtgatggaaaataaatgaagtttgagaaatcctcactcacgaaagctgccaaagtcatataatgttaaatggcttcatcatgttttcatgcaagaaaattgatgatgcatgatgccagaaagaaaaataataacatatagttggagatatgcaaatacggtaaaaacattagaacattaaggcccaaatgtaatgtgagattttttcttgtttgtgtangaattgaactgatatctgtgaaattcctgtgttttaaattaaaacagagcccaactgtcagtggcataagtgtaagataggaaagcacgtgcaaattcccagttccaacatatcgacacgacttaatatcatctcaagttgatgatcccgaatgactcataatactaacaaagttaatcaaacaattttctgcacatgacaaatgagataatgaactggtagaatgtaacttttttagagagtgcatcatgtgcatggaggtgaatggtcttgcagtgactgaagatcaataaagatatttgagcaggacaatctataaatgcataactaacccagcttggagagagcaccacaatattttgaacatagtatgctgtccagacaagctattggcttaaagaaaaaagtaacctagtgattcatttagcagcagcgattgattaactggtgaaaatgggtactgctcctaccagctcagagtgatggttccatagtagtcagaaggggtaggataccccttgccttcacacgcacaacacacacacacattaaaattagcatgtgttaagacagacacacacaaattgtgacatgctgatngttgcacaacgttacatacactatagaaataaaatttggcatcatccaacacaaattactcttctggatgtgtgtagatttcataatactgagaagaaaaaccaacaccatatatatatatatatatatatatatatatatatatatatatatatatatatatatatatatatagaccattttctggttttcatttgtctgttatgataagagaaaggttttgcagcccacaaacaatttggcctgcatcaatggatgtgggggcacactgggtaccatccccaattcttgttacaagggaaccattagtaataactatcttaggttaactgacttttcatggggtcttaatcaacaacacagctccactgctgaatcgtgtcagccatgacctagtgatcactgattttccttggtagcgatggccactagacacacttgcat

SEQ ID NO: 34798 - DNA, 1490 bp, Oryza sativa
cggcgcgggggcccaagcggctctgcagatcgcgggagagggagagaggagaggagagagcagaggggattggtcagaaacaggggaagaggtgggggtgaatgttgtttttgtcattgctaatttatccatttttttaaaaaaaattcatgacatgaaaaggtcaaacttgtaaagggtgatgaaaggcaaagacgattttgttcacctcctttaaaatacttctttttataaagaacaaacatgatcacaatacgcatccacttatttctatgaaatcatacacgcatacctcatctctattatcatataaaataactgggttggtaaattttcgtatcgaccaagttatcgtgtgtgtctcgttatcgacagatacattatctactactaaaaaaataattagccgtgaatacttgctcctttctcattagtcacaagagttgaggcgtacaatatagtctttgacattgaataaatattttgatcattaatttcttcctaatataggtacaaaacaagaagcattaacaattaaaagtatttttaaatattaatataatgatattatgtcatacatgaaaatagatagggttaattagatacatgccattaaaaatttgctggtttcgaaatatactattactatttacgtatttgtaacaatgctactgctatttgtaatctcaattgcgtatttgtaacgatgccactgctacttatttgtaatttcaattgcgtatttgtaacgatgccactgctacttatttataatctcagtggtgttaatacccacaaagatacgtattttgcatgtattagacgaaaatgcactcatcttttacctctctctcttccctcgtcttctacctctctcttcccgctgctttcttgctccaccgccgctccgttctctccgctctctccgccgccgtcctcgccgttgtgagccacaacttgctctatcgctgccgccatcgccctcgctgctcgagcccatccgattccagcagtcgctgccctagtcgcctcagccgccgccgtcgcaaccgcaacactgcactccgtgtgcccgtcgccgtcgcaggcgtcccccagtagcagcagcagcagcaggcggcggccgcggcgagggtgcggagccccgaggtggagatagcgctgcagtcgcaggcgtccccctaacggcagtgtgaggtggagggagatgcagatgtcgcgtgcaaaataacgctggagagggaggagacaatgactgcaacactcgtatgtttatcgctggttgtgcttgctgctgccgacactaagcatcactggtctctgagctgtggaagaaagaaggggagaaaaaggaagaaggaaacaagggcaatttggtccacattttttcgtaaatgcatctaagaggtaggtagtggcatatcttgaatatgtgtaaattatatggcatggattcaaatatgtaaatgctcgtggcatattttaaaacc

SEQ ID NO: 34799 - DNA, 3991 bp, Oryza sativa
aacaaggtgaaaggtcgcgtgatttgctattaagtgcaaaatttcaatcagtttcaggcggtcacaagtgcttatcatgttacaaggtcctttgaaactcccagcctgaatgactgagacaggttatcaacaggaaatctacgagtatttgattcgaattcgagcatatcaaattcgcacaatgagaaaccaggtgatccattctccagtctaattgctaaattgacataccatgcagcgccggattcgctcagatctcactgatgtactctaaaagagattcgacctcttgcctcagggcagcaactttctgctgctgggcagcaatcctgttctccacatcttgccctcgcaacttcttttcaaagctgtcaaccacagtggaatgccttgtcatgagcttatcctgcaactctctctccttggcaaccaattcctctacctgcattaaagaaaaaaaggccaactgtaaccactatggcgcatatacttaattagagaatgtgggcaaagaactcaaattcaaattaaatggtgaataaagatgcactagtaagtatctctctcttctaggtggtctatgcacaagacgttgagcaaacctttggccatatctggtaagactgagaggatgactgcagggatgtcaacaatggcttcaactcttttgctaattccttaaactgtgcatcagctgtcttacgagccactttgcatgatttaacatctcctgacctagataactcgtgtaatgaggtctccagtttatcatgagctgctagacattggttgaagatagcctggatttgctggatgatgctctgtacctgtacaaaaagtatgaaatagattgtagaggttagtctgcagaaagtaagaggtctccacaagtttaaagcattcttcaattccagaaacactacaattaatgttgatccagcttaactgcttaaaccaatgatacgcaattattatcttcttaactttgaagtttggattgaagatttaggacttttcaagtaacatttttttccctgtcaattatgaagctcgcttttaacacagcatggactgctctttacctccagattcatttagagcttgttttgcagattctattccaccgtggttaagacccttcacttgtaacttgtccatttttggaccaaagctctcaaaagccaatctttaacagaaaggacagcgttctcacatgattctgatagctaacttgtcacttatccaactaaaagttctcacatgattctgatagtaaacttgtcacttatacaactaaaattactagtaaacaagccctccccaaaatttaaggccaccattcaaccctgcacattttgagacctttcctagctatttgctcaggccctaatatgtttgtcatctgatatttactagttcaagtttttatcattgcattttttttctcccataaaaataacaccgctacatagtactccgtatgagctagcaaaccaattcgaattatgattcataagtttatttcactgtaattagtgctcatcctaaacatagcagcagtatagtaacaaactgtagttcactagaagaaaggttatggcaagatagatttaaacatttctcgtaaatcatcaaaatccaatcctcaaaggggagatttgactaaaacgaccatacctcatcccactgcacctttgccagataagaaggagaattcttagagattgacatgtcagtgcgcatgtaaacaatacaggccatgaagaggagaaagaagccagttatcaacatcatcggttctctgagtagagagatgttgttgaacctgtagtaaacctgcatattgtagggcattaacaccataagtttgctatggttcacataaaacaccatgagatagacaactcacagaaagtattcatggtgcagtaagccttttgcatagcagattttacatactcttcagtcaggttaataatttagcaacgctcaacttttcatggaggggtaaaattagttgcacaacaaattaagtctgaagacaaacctggaaatatagattatgctctggaataacatcaagcttctccaagacaaccactggccttccagaaatatcaaggtgtgaatacttcacctgcaccacaaatcattgtcattacaacaaaagaacaggatcagctagttgttcaaaatatatgtgtgtgtgtgtgtgtgtgtatcatccaacaagaagtcacctcttgctcttgctttgttggaaatggaactgaaatatcaatatcctttgaaccttcaggcagaacaacctgttcaaaaagaaaggtttttatgcagggagggaaattaatatgtaacatcacgttcatggaaatatgtgcaaatgtatttcttattgattatctaaccatgacatgtcatctacatttttttagaaacataaaataaaaataactaagtgaaggacaatacaccagaagatagccaagacaacaaaagggtatgttagttgcaggttcccaccaataaatgaagatctaatttcaatatcaaagaaataggcaacacaaggaattatgtttggtgtctaaaattctatatcagtgcaattaaaaacaaaacatggaacacaagggtaaaaaatgaaagattttaccgtgcgtgccagatgggtacaggagaacataccttcccaataagcttttctatgagaatctcctccactggagaaccaaatgtgatattgaggaatctctttccatcagaattgaaaacaaagtcttgaagaggtaaaccataaccaatggtaaaggtcgtttgccaaccaccaaacaaaggaaaccttggctcaacttcaagttgagtctgcaataggataaatattcagcatatgcactcacttttgcaattttgctgggaatattatagccttgaaactgagataataaaaagcaagtgtaccttcttggaatcactccataaatgtgatgttgaaatgttaccaatctcatctctgtagtatatagaatgtgcccttggaggcagtctagcaataagatgcctaaaagatgagacccctcttatgtacggtctagattggtaatcaatcctgcaaatttgaacacatcagttatctctggacaaattttttctatccagctaaaggtgagctatttaaagcacaagttagaagggagaagaacctggaaaattcacccttgagtttggcaccaccatgagcaatgttgtaatgttctgtaatctgtacattcccccagtgagatatctctatctcccttataacttcctttgcaactgcaaaagggttattgttctcatagtgcacaaccataggggagtaggaaaacggtggaagatcttcatatggtccatattttagttctgactctgcaagttttgtgtttgggtactttgtgtaggactcaactcttccaccaggcaatctgatactaagtgtctgtaccttaacagggtaaggtgacagatactgagcactgtcctgatagacaacaagctgcgattcagcttgtgtgatttcttcggggaatggctggacagagtgcgtaaatacggtcaggacatctaagtgaagagtcttccccttctccaaaggtttggataaagatgccgaaaagaatgtaagttctgggggcactccagaaggctgaacaacttcaatcggaaggaccatacttggacctttcaccttttcctcagtaccaaatgctcttatagctgctaagttctttgcttggacattgggaaacgccagtagaaattgagaaacagcctccggtccactattctcaacctaaaaaaaacagagattacaacaaaagcaaaacctcagcatatcacatgtgcatagacaaaaccccatatattactctatctactagtgaggactggcatcagacaaagtgtaattcaaaaagagttactcggagattttagaattggtggtggcact

SEQ ID NO: 34800 - DNA, 1211 bp, Oryza sativa
tctccccccaactagccaaccaaaattcgagagaacacagcaccaacaaccgcgtgtaccttgagcgaagtgaggacacgaacgatgtgcgaagtcaggtcaacctgcaaaaaagaaaaggaagggcaaagaggcctcagatccgggggcagaaggcgcggcgtgctcgtcgggagatctggagggcgcgcagagagacaaagaagcgaggcgggagctcaccttccgatccgccctggtgacgacgagatcggcccgtgcggtgggggtggaggcggcggcgacgaggaggaggaggagggcggcgactcggcggagcggcggtggcgtcgccatgttggggggcggagggcagatcggtgggtctctcgcggcgagatcgagtgaagaagcgctttaaacccttcctctcctcggctcctcgtctcatcgtggaggagaggagaccgggcggctagacctgctcgtgggccgcccgacccggcagcccaatcgggccgggcaggctcggtcctgcgttttgcagcgcggtaagtctacattgagtccctcaaattagctgcaataccagatatattgaccccccaactgtcgaaaccggagcaaaatgactctctcggtggttctgagggtggatttcgatgacatggatcattgacatagtctaatcagctgagccagcgtgtgggacctacatgtcctcctctctctctctctcctccttcacacacctctccggtgggtaggcgatggtgcgggcaccaacgatatcctgcgtagtcaaatatggcgggctcctcctccaccaccacatctccccatcgtagcagggccatgccgccgtggttgagctcctcctcttccctcgagaggaggcgcaagcaacgacgaggtgccgtagcatgtcgctgtccctgtccttcgcgcgggccgctgcgagccccgagcccacctccattcacaaggttagcccatgtcgtggtggcaatggccagggaaaagcatcaacgtcgctgggctgacggctgaacacatctatcgcgaggaagagcaacgaggcgagcagcaacaccagcgtgatgtcctctcacggtagaatgccggaagagcgagtagccacacagtgcttcggcttgcttggcagcaacgacattgggggaggagaagagagttatgtgtcggtggacgcgatccctgtcatgtgccgggct

SEQ ID NO: 34801 - DNA, 2893 bp, Oryza sativa
ccgaatcattgggttcagccgaacccaccgtggctccgttcgatgcagggtttggatgggcggtcaggattgctcccctatggcggttggagggtattactgacctttccaaccgtcataaccgtcattctcaagctatataaagccctctcatcctccatttcaagacacacctgaagcaagaagttcatttcatctctcaagtttagcatagtttctagagtataatggaatagaaatagaataaaatcttcagtcctcagagtcttcggaagaattcgtgtatggctctagtagcttttccttttttcttttttttatgacttgtactttatttagaatactcttctttatactactttggtattgtattactttccgagtatatgaataccaactttactatatgttcgagttatatttattatgatgctagcttatctgggagatgcaatggtgtgggtataataatcgtatttatgataactctatgtcatgacgatgatattagatagtatttggtaatttaagcgtagtgtttagattactagatatcattatttggggttatatgctgtggaagcgaggtgggccgctgatggtgacagctcagtatgggtattcctccacgaatgtatatagtcctaagatactttcctggggagggtactccaccgtatttagtcccggttgtatagtcatgacggattgtcgtaaggaactcgacaatcaggggtggcttctcgaagcaccagcagggcatcggatggagggtattagctaagtaatactataactaggatgtatatataatatgtatgtaaattagaagtataggaataggatctttctatattctttccacttagcttagataatcacgagtaagaggatgaatgcttctacttagtgttattgtaccctatgaattatattaacccctgcttagactttggttataaattattcgtacagtaatatataaattattagtactgttctctctattataatcttcccacgggattaaacaaatacgatacctttggaatactctcaggtgaaatgctacaatggtatattcatgcgcttgcggatgaactctgtaaccataatataccagaagtatttttgcgccattactgggaattaaatttctagtaatgtcgttaagaaataccaacaagcatttctggcaccattgccagggaagatttataaaagagattaccattactaatactttatatttacctctatataatcattgtactttgcaggctaaccatggttgttttcacttttattgtggaaacagggtagtacatgactggtttcaacttgccggaaaactctaaggaaaatccagaggctttctttcggagcgtaagccacgagtcgtcgctctgcagtaaactcttccgacatagaaaccagccataccagcgctaccaactttcaagactatggctgacaagaccctccgcgaatttgctgctccctctgctaacaacgtggccactgggccgcaaatcaacatgggagacgtggatttcgatctgaagtccagccttatcacaatggcgcaggctagcccgttttgcgggaagcctaatgaggatgccaatgctcatctgcaacagttcctggagatctgcaacacgttcacaatgaagggtgtcagtcctgacgccgtcaggctgcaattgtttccgttttccctccttgggaaagcgaaacaatggttttatgccaaccgtgccacgatcaacacctgggataaatgctctacgtcattcctgtcaaaattcttcccgatgggcaaaaccaacgcccttctggaaggatctcaagtttccagcagacgagggatgagtccattcctgaggcgtgggaacgacttcaggaatatatggccgcttgtcctcatcatgggatggacgactggctgatcttgtagaacttttagtatcatgacgagctgcgtgctcgagacatccgaccatgttttattggtcataattatccaactaaaatgcgacttaatggtgggttgtgggtgcatggttttgctagtcccacccatggcagttaaggaccggttcacaggatgcactggaagacttaccgcgcttaccacaagcgggaatgggtaactgtctgacttgaagtatagctttcctctctgacgcatccaggcaagggtgagcgtgatggagttcggatgggccctgcgacagtctatgcgcctttttgatttgcctaggcacgagaggggactgcccgctgcctgttgaggagtgggggtgaaacctgaggtgtggtgtgcttggtcagagagggttatatgaagggtcttgtcacaatcactcgacatggtgacgtgtccggacaggcgcggtgacatgccggtggattgtgtcttttgggtacagttgtgcacctctggccagagtaaaactattcgaatagccatgcccgcggttatgggcgatcgaccagattcatcgtgattagtcacacacttattaaatcgactcaatgcactgtagttcaggtgggttggttgggcctattcaacgtggtgtagcgttgatcagtggagatttaatattaccttaattaatcaactattttactgttttgctcaataaatgttttacaattgcctttatgcaaatagcctcaagccatccttgtatccccttgcacgcctgcatcattggtgtggcttgctgagtacggtggttgtactcagccttgctattattcccccttttcagaagtgtagtgcttctgagctaaagacggagttagaggaccaaggctcagaccccagttgagttttgcctgtggagtggagctgaagccctgctaggattgcctttttccg

SEQ ID NO: 34802 - DNA, 2382 bp, Oryza sativa
aaaatgctataagttgtttagccttctctcaagatagttcgtttctcatctctggatctatagaagggatggtttatacttggtcaatggtcaggtactctctacaagctagaagtcggtgaagcattttttttaggaaaaaaatacaaattactccctgaaatatcgtggtcgactgaattaccccctgaactcgaaaaccagatatcgctcaccttgaacttttaataccggacaaaacaccccctccccccgagcactgttgcaagcggtttaggattcaaatagcacacgtggcagtccagacatcagttttttttaaaaaaaaattgctagggcccactcgttggaatccccgcccacatctctcttctccatccccttctgaagtgggtggtggctagggagagggcgtgacgcggcgctcttctccctcctcttctgtagcgcgtggcatggggggagatgggcgacacaacatggcgacgcgaccggcagcggcaagtaggcggaagcgaaggcggcgcgtgccggcagcggcaagtaggcggaggcgagggcggtgcggaggacgcagtggcggtcagagtactgctaaaatctctcctttctctttcttccctctggtgcggcggtgagattgggtagggcgcgtcgcgacggggctagaggggtagagccgccaacgagggcgtcgggaaggagaggtgattggagcggaggcggcgatgacagagcggtggagcacgcggtggaggaggagcaaccgggcgctgggacgacggggatgggctgcaaactcgtcgccatagcctgccgtctccaatgtcctcgtgggcgcccaccgcccgcattgccttccccaccgcacgtgtcgcgccttccccgatgaggactttgtcagggttatggatatcacatacccaatagtaatcgactaagctcggcagggcccaccacataccatgttttatatggaatcatacctcgtatatagaaggagttccggataaggaaggacaaaaagagttctatatgtaaactacaaggactactcggatcgtatctatgtttatctccctagttctacttggacaagggggcatctatgggtataaatacaagcccccctaggaggagaggagacagaagccaaacgccacaaaaccacaagaccaacatatacacacgctaacacacgccgccagatctcgacatcagagattagccagacataccccatccggtgcctacggaggccggtaagagggatctagcatcatctctgatctcaacgggttcatattcgaggaggaagactgccctgttgtcgactacgagttggttatctagccgccaagttgacgacaactagataggttatcccaaatattgtacttgtgtgattcagatgaataagagcaacactggcttcggtcaacaggatgtagggctattacctatcagatgaggggcccgaacctgtataaaaatccatgtctccatctcttttacctcaatctcgcatatacctggtaccaacgatccccataccatccaaataccctagtcgcgatcttaaacatcgacagactcatcgctcgccgcctgcctgagttgagagagagagagagaggcctcaccgccgtctccagggaagggagcagcaacagcgctggcgcttttgcctcagcgccggccaatgacgtcgacggcgatggcgacgatgaaccactcgtctactcttctccctactgctcacccgcgaccctgagctgcctcacccgtgaccccgagttgccttagcctcgccaccgaccgcgctgcccccgcctctatggtcgtcagcctttgcagccgccccgccgcgtcacccctctcccccgccatggctgccttctcgcgtaagtccggcgcgagccactactcccctaaccacaggaggacgaggcctggtgagcctgatgggccggccaccgccggcacgccacatcctcggcctctgcctcgaggagactcgcaaccgctggcgcgccgctagtcctcgatcacgctaccttcgtttccgcggtcgccggcctttgcagccaaccaactgcgtcgggccagccaccgtcggcgcatgcgctgctcgttctcagcggcgagtgagcgacatcagagagagatagagaggtgagaggggatagagaggagagagactatgatatgtgagccccaccattttttaaaggcaaattttgctacaggacactgcttatgtgtggttttaaccttaggacactgcccaaactcacttttgggggaaaacactctataaacatagtaatttgccagtggacaccgccccaattaaaataataatatctggtagaagaggag

SEQ ID NO: 34803 - DNA, 2646 bp, Oryza sativa
cctcatgtgcaatgaatagtgctatccctaattaaaccctattttagcctatctcctatacaattttaatcctacaaactctaattttacttagttaaatgttaactaaatttaagtactaaatcctcatgaaaatttatccaaattattaccacccatatttatttatttatcgcacaaatgaattctttttagattaatttgggttattgaccctaaggtgaacttatatatttttgaagactttggggtaatattgaatttaatataacgacttgtcatgattaatacattagcagattggtcgagtttagttgtatagcaatatattttgcacggatgggttcaatctatttattctataaatagtaaattgagactcggcacaatattaatctaattgtttaattaaaaactcacataattttataaagcttaatttaattatatgaccattattttatatgagtgactttatcaagtgttcaaatattaatgtatatatattcccatgaaattctcatttgttaataggatcattatagtagtaatcatcatttcatgtggatttataatacttcatgtgagattggatccaaatacattagatttaatcttacaatcccattagttaaacatgacatcgagctatcaacatggttcgaatatttaatatttgatctatgatttataatagaaattaatattttatttggcttgctttcttgcgcactaatgtatatatttattgttcaggtgtacgccattaatttgattctccattgttacaatttatatttggcaagcaatgacaaccataacacccagcatgatgcaaaagtttttaaaaagttcgaaattttagtgatttttattattaggaattttcagaatgttacaaacacataatgcaactatgttagctaatttgctagagaagagaattgagatcattggaaaggagaaggttgttcaagttgtcactgataatggtgctaatacatgcaacagataagcttctaatggagagaattctcacattgtataggactccttgtgctgcacattgtttggatcttatgttgaaggacatagggaaactgaaggaatttaaaaaccccattgcccgtgctaagcgtgtcaccactttcatttatagacatgggaggcttcttagtgcaatgagggagaagacaagtggaaagaatcttttaagaccagctgtcactcgatttgccacaacttatcttactttgaagagcaattatagccaaagagatgaattgagaagcctatttgtgagtgaacaatggactgggatcaaattagcaaaaacaaaggcaataatataagtgactggcattgttctctctaagaaattttggtcctctattgaagattgtatcagagcttcaaccccattacttattgtgctaagagttgttgatggcgatgagaagcccgctatgctagaggtttcaagactaatgacgcatgccaaagagaagatccaattgagcttttttatccagttgtgagctcaattggagaacatttggatttgcgagtcagtttatctgtagttttgctttaaatttctttactatatcagcaagttatttatccttttttttcttcccttgttatttgcatccctgcagatccatacaaagaaaatgaaccagttagtacacaagagattgaatgatgttgtttttgttgcctataactggaagatggaaactaggtttcagcttaaggcgtgagaaagcaggaaaaggccagatccttaagtcattgaggagtttgattggaacaatgagtgggataattccttacatgaaccagttgaaggttttcgtggatgtgacattacataggatgatgttgatgaagttgttggtgcatcacgatctctttgagctcgctgttggtatttgatacggtcacagataaatccgcaagcgcacgaataccgctgtagcacttcacctcagagtattccaagggtatcgaatcacagaaaacatgtgcatatatctaggaacataattctatccaaggacaacaactaatggtaggctaaggctaaagaggattcctatggattaatttactagacttgagttaaaggtaaaaccctatcgattgcttctggcactagccctccgctggtctgccaagctgaatccagcctacggctctatgatgtacctgaacatggagggatacaaaggatggacaaggctatcaccaccttccgcctacctcactttctatggagcacacaacaaaaaaaggtaaccgctaacctaaacaccacacctaagttattgattactactctagccccacgcaggaacttccttctttatctagaatcctagtactagagcacttaataattcaactaagcgacgaacccgcaacgatgggaatatatgtcattcaagcaactaaattaaataccataaggagatctcaaatacttacttaagaagcatccgttaagatacaaacgagagaagaaggccgataactccatcacttctccgaaactccagtggaagaagaactccgatatttggggcactccttccggagctttacctcactctttacctaattccacacactaaagagatg

SEQ ID NO: 34804 - DNA, 4059 bp, Oryza sativa
aaccaatagggggtcgccacgtgcaaggaggtggctgggggcgccaaccttggatcagccgaaccaggcacaccgccattggccaccgacattctccggtgtatgacagtggacccctttggcagttgacggtggattagctcaaattcagttagttttgactgacatgtgggctctccgatccttgtgcttgcgtatggttggtcggaggtacatttagtctcatggcgagtgcattttctttcaaaaatcacctgcataccaatatttacaaagactagtggaaatggttagtaataaacccctaccactaagtttgatattatattttgtattcttttatgcaggagttgacggtgaaagtttgcacttatctaccgacaacaatcgcatgttctaaggagagttcacaaccttgttgttccaataacctttcaaaggcacccaaggaatacaacaatgtttgaagaagatgaggaagatatgcaatctgaccaagaagaagataaggaggaagatccacctaatgatgcaaatgtgagcaattgtgatgaagctcacgcaggtattgaagatggctaagagaatttggatgccaatggcaatttcgatgagtttgatgatgaatactaagagacaaggagttggacttatagtatatttgtttagagtgtggagtgtggagtgtggagttatggaccactattatctttatacgccattaggtatatgatagctcccactattttgctttgttattatgtttacttgcctgctaggttagcctgcttgatagtttattatgtttagagtaaattgcaccttgagccgctcttttttaccattgttgcaaattggactaaggacaaacaaactttttcactttagaccactttatctttaccagttgcttcagcttgggctagttcttcaacctctagcgctcctccctcttctccatatctcagagccatcaccgaactacaccaccccatcaagaaggtgatgaacctggtgaccgctagtaaatggtctgaccctctccatcacgaagatgaccagcaagccggtcctttacccaacaatgtggagatcaatgtggccgaggcgaataaatggatggttagtccgtcagtgcataccgattgtataatttggtttgtttgttgtgtggactgtgacatgtcagagacgtacttcatgccatgcgttggcaagtggaggcaagaggccgagcgccgctgaccacggtgagagccatcacgcaagttgttgtggcaaattggataacaccacccatgatgatgatgatttccctgtagtagccatgctttagcgaagcaacaacctatggtagcccctccacccctctccactagtagcacgtccactgttggcatccgctcgaagcagactacgcacttgaccatgacctcgagccctgtcagggcttacaccatgctcggcctcgagagtcattggtggctcagtgtcatgctcagccttgagcccagtcagcagccagctcagctctcggccttagccccaacagctccggcattgcacttaagttgagctcggccggcagctccatgctacagtcttgagcccacccggtggtcttttttcttgcccacaaaggaagagagagagagagagagagcgagagagagagagagtacacaaagagaggagagagggagctacaggtacaagaacagccccaaactgaaacctttgtaaatttacccagtccaatagggaaatgtagatctaccaatagtccaagctgatagagttgtaaaatatagtggtccaatatgcaatttactcgtgctcaaatgcttactttgttgtctttgaatttatggctttatattatcatcttgctcatcaataatgtgccttgctgctttcaggtcatcaacaaggtatgctactcaagtaaatggaagcaatttattaactattgtttacaattatgcatctattattatcttcataacacaaaaaatggtgatgcttctaagggggtggatgctgccatgtaggtattggatgctacatgggcttaagagttgccaagaacaaggtatatatgtgtgtcgtactgctcttaaaatgcagctttgatgtgcctaagacgtcatctcgccttaagccttacctgtaaggtagtccggggtcaccttaccaccttaaaaaccatgatataaagtttgtctccaatcaccatacaaagccgtgtagtaaagtcaaattttggcctcaacaaaatagtctctagaccttctaacacgtatacagacatatgaatgatcttaaatataaaggttgtcaactatagattgtaaatattcttaagttctacaacaatacttatggatataaagtttatttttatctgactttatatgaaaaattatctaacttttttattaaaaaaactataattaccagttcaacactcaataggcaggatgatccagaccttgtgatgaggtggttttaacaaaagccatttgtgtagtattgcatattcgttaattccatgcacaaatccgtaggcctacaacacatgttgtttaaaataatattctctctcttcttggtctcatctccctcttcacctgcctagctcaaaagtaatgtatccttattgtcaattatatggcccataatatactccctccgtcccaaaatataagggattttggacggattggatatttcctagcctatccagattcgtaatactaggaaatattcatccattcaaaatcctttatattttgggacgaagggagtacgtactaggtaaacattactatcggtggtcccatgcccagaaaccccacattagaagttatgaaaaattctttaataaattacaatattgacagtatgcacctgcatttgcaagaaaaataacaagaaaaaacggaaatttgtaacatgtggcaaaatacacaatcagtgaaattctaccttttagcacataaccgtgagtactactgatacatgttattgggtgcacttttgcactagggtctgctactaccagatctaatttaggccttgtttagtttccaaattttttttctcaaaaacgttatatcgaatctttggacgcatgcatgaagtattaaatatagataaacaaaaaaatttacttgcacagtttgcatggaaatcgtgagacgaatcttttgagcctaattagtccatgattagccataagtgctacagtaacccacatgtactaatgatggattaattaggcttaataaattcatctcgtggtttccaggcgagttatgaaattagttttttcattcgtgtccgaaaactccttccgacatccggtcaaacgtccgatgtgacacaaaaatttttttttcgcgaactaaacaaggccttaaatgagatcctttgcttgtactgcatatgcagtatgtgttactgacatatggtcctagagcaagtgggatccatctatcaatgacaccttatgcatatgtcgggcatttttgaatcataggaatggaaaaaacgaaagaatagaaaaaacacagaattctaataggaatacaagtgcaaacaaacagaggattgtaaaacgtagaaaaaatataagaatgactgtttgattagaccgctggaaaaacgtagaaattggatgaaagagatataattggatgagagaggaattggaaattttccaataggattataatcctccaaaattcctatattttcctacaaattaaaggtgctcgtagtataacaaaaggatgtgtgtccgtctactttggttcttaaaagctcagtctgctagcacttttgtcaccataccttagaatgttatggttggcataacaatagattgatctatgacccacttgtgagcaaacacatagcctaaccttctataagtattaattcattttgatccactaataacaaaatttatcaccacatgttcaagatagaaacaagaagtgatagtaacagccgagtaaggccaaattgagccactttcctacactatcgttaaat

SEQ ID NO: 34805 - DNA, 3704 bp, Oryza sativa
taccctgcgccccctctctttctctccacccacacttgcccttgaacaatcaaatctatctagccagagctccgggttgattgatttgattgttgcaatattacggctgctagatctaattgccagatctgggtgctctgagcgcaggtgatggtgatgatggcgattggcctatgaacaagcaacaaaacaaccatggtcttgggtgacaaggatgagtggcaaagcgagaggcattgtagtgtcagatttggttgctccaaacttgaggctactagatctagtcagttcttgtaagatatggggttgacaacgacaaatagggtccaatgaagacgggacccgcaagcacctcaaggggccaccgtgcgcacaaggtgtcgtgcaaggaactagaaggtaactcagagtatgaactggagctggcctaggtgctattttttttccttcaattttattaccgtaaaacatcactatttctttctcaccactggttccaaactagaagtgatgcccatttcgatccaccagtatgtaggtgtttactagtgaccccctagactctaaaggcattcttagggggtgatttagtacatcctatgggtgaagataataggagtttgtccatagatttttcttctttggccacactgtggaggtgtggtgcaggccgctacaaaactagcaactttttttgacttgacaaaagtatgatagaatctttggaccacatgttcatggaatcctagagagttaaaacaaacatagtttgtgtgcttcataaaaaaaaacacaaaaccaaaatgatggaagatgccttacctaatacagaagaaagttttggaccaaaatttattaagtctagactttctatctttcctcgtccaataggctatatctatccatactactactacctcaaatatggcagtggaattttctactaatcaaatacataaaccaatggtacttttctacagtagaatactatctgtagagaccatagtgaccaacaacaaattatcagaaccaaactataccaagctgacgctagacttcacgtaggttttgccccttactttttcctatgagtactcatgtaatcctaacccctagtccgcaatctggaaagggcaaatcactaaaccaatcaagaataattggagcataataatatccggaccatctggaaaatcatgtcaatttctccaattgtgacaaggcaaggaattgccattgtcacttgtttgtgaaagtcacccgtgctgcaagtgagctaacacagataacccagtaaagccctgaaggggggaaaaatcaaaggcatctaaagcactgaactgaatggatggatagtcattatcgacagtcacatgttacacacaacagtttaactttaaccacaccacggtaacgggggttgactgactatagcaaactcttgctatagtgcaacatttcagtataacgcgatcatactgaaacattttccgtcagtatcatctaggaaactgcaaaggtgttacaaaagttgccggctttgccatctggacaaaacttgttcaagcttctgattcaatttctgtgaatgatccaacaattcttggttcttctgtaattgcgcaaattttctgtagcaaaaaatggcccttctggcctcaacagaggttgccttatctcaactagcatagtccacccacctgccaaaaaagaacagaaatattatttcacagtttcaagtcctaacaaaatagtgataccacttcaacacaataacaagctcatggtacatttatcaattgttatgactggttaaaaaatgatcatattaataaccgcaactaaactcatgttaattagttgagtatccatgagggcatgtcctcacatggattctcatatctttgtaagaacatctagcaggctacaaattccgtaaaaagtagcaaaataccaaatcatagatcatagcatgtatcgcattccaaattatctactcaaaattaaatcaacaaaaatacaactatccgattgataacatgtaaaagtaagaagattgatgtaggcagtgtcacataaacaaaatgatatgggaactcctagcgtagtctagatgcaggacccatacaaaactaaactcaaaatggtaataataaactaaagaaatgaaaaggggtgtgctgaattaaaagggtaccttcagccaggtgaggaacctagagagtatgatcagtagactattgtgcagcttttctccccctgcgtttaggcctgtattaccagttaaaatcacatgtcagatcagtgacaaactgtgtcgacaaagacaatttctactattcatggagttgacaaaaacaaagtgaacttagttagcttgtgtgatctgatataagagtaaagagagaaagttattgaaagcaatattaggtattaaaacattgccaattgaggaaagcgataacaagttactgatatgctatttcagaagttggaagtagaatatgctaatacgttagttttaatcaatgagcaacaagtatcattgcattcatcacaaggacaagatgaaacttcagcatgtcaacatacatggcaatttttttgtaacctatataatcttgattcttgaaacatttgtatagcacctttagatcaacagtgaaaacatcagaactgatagtttggattctgttattaaaaagataactgattgcattattatgatagtaataaataaactaattccttaatagttaagccagtgatggtcatccaatcttggcagtaattctctgcatactcgtctaaacttctgatgtcaaattttgattatttttttaaaatatttcctgaaattacaacataaaactagtggggaacaaagatgttacatctcaatatctcacttcattatcaattatcatactaaaccctgtattatacaaaagtttcagtcaagtagaaaataaggaaccactagcttgatatgcaaaataaactcttaactaatgcggtgcatcacttcagctaggaaaatatgtggacaatgcaagctataattaattaatgtggtgcatcacttcagctaggaaaatgtgtggacagtgcaagttatagtagtgaggtacacaaaaacacagatatattcatccatatccagtaatatggccatggaacattgaaaatgcaagtatgatatataaaataaactttatttaatgcagtacatcacttcagttagtcagatgtctggacaaagtgcttcaccgaccattttatgctactaaagtttcttgatcataactaagcatattggaatgattcagttgagatatttgagctttgtggaatcacaatacactacattttcaggaaataatatccccagtgcatattacttaggatgctccttcaaaggatatacccatcaagtacatcacaatgtacaggtggttcaatcattggaaaattttattaaaaacacgaattttgtttgcagataaaatatcaaatagtgtttctaccaaaatattttggtgacttatccagcataccaatcagcatgcattcctgatttataatagataaaaataaatccaaataaattgagcttttttatccagcataccaatcagcatgcattccaattgagcttttttatccagttgtgagctcaattggagaacatttggatttgcgag

SEQ ID NO: 34806 - DNA, 5691 bp, Oryza sativa
agtgcatattacttaggatgctccttcaaaggatatacccatcaagtacatcacaatgtacaggtggttcaatcattggaaaattttattaaaaacacgaattttgtttgcagataaaatatcaaatagtgtttctaccaaaatattttggtgacttatccagcataccaatcagcatgcattcctgatttataatagataaaaataaatccaaataaattgatatggagaaatccttaccttgtggataaatagttttcaactattttcttttcatcttcattaagcataaaccacttgtctttgttccccattaaatcatcagcatcaacctctgatacagacagatgttaatcgtctccaattttataatgcagaactgaaattagtggaaggatgttgaataacgctttccaacaaaccttggagcatcattgttgtgttattacaatagtcatccagcttccaatagattacctttttgtctaccatgaaaggattagtcctaaggaaacctccatgcttcttttctgatgttgccatagttcatagttgagaacaaaattaataacaatgatcagcttattttccttcgcattacaggaaataaacagtgcaggagatcatgcaaaatgttctaaagtaatctgtttaaaaggctatgacgaagcatgtttagcaatataattcataccatttgtgtctgcattctttacttctttcacatccttttgttgagaaatgccattcttatcttcctcaatagcaacagctgctccttcagttttcaaaagcactgcttcatctgtgttctttatagtttcttcttttggctcctcctaacaaacaggagatattttgtcaattgttctagaaccatgtgacaaggtgggaaaggcaagccaagatcaaaaccttctcttttgcagaatgagctttttctctggaggggttttttgtttcagataatatgcagctcctcaacttcctgaacaatgttaagagtaatttaaaaaatcagaaataacaacatcacaatagcgaagggaagtattaacaaatgtgtaggcaatacttactcagtagaaagactttcatcacacaaaaagttcagaacactgagcttacaagaagggctcagatttttatatcccgataccccctgacttagggagtcaaggggaagtccctctgggacaaagattgactcgcttatgcattttccagtatcaacaatccatgcatcattatctcttgaatatgtgataggcctgagaagaaaacaacataattataattttatcaactgcatttagaaaaaaaaaaggctcggtttgggatctacttacttgattcctcggccttcttggatgatggataacaaagttatgtggaagtcagcgatgactgaggacaccactcgaagtccacgacctccagctatgtcccgaaggattctttctggttgacccttgcgtacttggaaaatctgtggggaaaaatcagtatgttattccatttgcaatacaaaatataatctcaatgtaccatgtgagcatgtagagcagattagtatattaactaaggaaacaagatattgttttaaaatatctgattcaattaaaaagcctgtaatgctagcagcaaactgtgactattttctcaaattgttaagtacaccagaaaataaatgcatgctttatatatgtaaaacaaaatagcagaaaaaagaatagttcaaaaccaacgcccacagcaatctcaataaattaattactgcgttatccttgtattattattattgaaacaaggagtttacatagaagcaaaaagagagcatatgcacgatatatgcacgagatcagaccgtaaaacgatacacttggggttgtaaattattgagtacatcctagatataagcatgacgcgcccatggttagtttgtgctcagatacaggtactcttacatgacagactgttcgctcaactctgctcgcattgcatcgcagcgatcacttgcggcaatgactaaatacttcagattataacgcaaagcgatcctaagcccgaattcaaaaggaaaactctaaaaaacactaagaagttactccctccgtttcataatgtaagactttctaggtttgtccacattcatatagatgttaatgaatctaaacacacatatatgtctagattcattaacatctatatgaatgtagacaatgctagaaagtcttacattatgaaacggaggaagtatgatgcaacaattgtaatggaacaggactcacggtagttgcaaaaattttacactaattgttccatgacacttgttagaaataaacataaaagattaagataactatcacatcgcctaataaaacaactgttacaatgttttgctggttaccaaaattatgccttaaggacttggatgtttggtctataacagaagaaataaattataaactcgcacagaaaagaataagcttcgctatcacttactccctcgttccaaaatataagcatttccgttcaggtaaatagtcagaaatgcttatattttggaacagatggaatagatagttgttttgctcagaagtttgaactttgctcaaactatgtgtaaaacaatggagctttatacataccttttgcaagagatattgtataggatgaaacataactttggtagtttccttaaaaaaaaaactttaaaacatagctttggtagttcagttgaacacgcagcctatcacaaataaaaaaattcgacagaacataataacatttaatttgggttatatgaaagctactacatggcttaaattacaaaccaagaaatataattggaaggtttcgaccagtttatcaatgttaacatgtatatcatatggacaagaagtgccatgcaataaaaaagaaacctcataattacaaataggaactcgaatattgtacacattaaagggcaattaacagatagcctgtatctaggtgttagcatgttgcacgcagagaaatcgcatccatttaatgcgtacaatgaactcaacaggtagtcatatatttccttttgcccatttgctgtcacccggtcaccccaccatctccctctccaaattctaatccgaatacctattccctttatgatttgtatcccatcatggcattgcatgccttacctacataaacacatagatatgattccaaacttgtaggaagctctaatatcaacacttcggtgcttaccagtaaaagcattttttacattgtcatacttcataccaaaacataacatgcatcagacatgtaaatagaaaaaaaaaactcgatctattattctcttgcaaatgctagtaagatattactctgacaaggcatgtgcaatcatactattaaatatccttgatctttctttcgtaactacctcagcaaatgtgcggcagaattcgaagaactgaagtgcaagaccaacatcttcaggctcccactttgcaccggcaacactagtgactggagtgcccttgggcagaacaacttgttccttgggagcatcagggctttcatcgttcgtcagagccacaccattacccaccttcctgcttctcttctgcttcttcactggagcagcattgaaatcaatgcatacattctcatccccttcagccaaaggttcatcagcagcagcatctggctgtatggccctctttgggctcttctgcttgttcataaaaaaaggatcagcaaaacatatcaaacatagtgaacaatcgtaccatgcaacagcgaattgtaatgtgacaaaggatcgtgccaatcctgaacaccacacaccttcacaggtgtagatctcactttctgggtgctcctctgcgcggcagccaccgcttctttcccctttttcagtaaatgatggaccgaagcacaacctgaagccttagcagcatgggcaagtattccggtgggcggcagccccttcttcttcctgccaaacaaatcaaagtccatccatcacttctgacaacaaaacgcgagccacagataatcagcatgaccggtagagcatcaggtttggtcagctcacatgcagaagctgcaattgcagatatccttgcacttggggcaagtccaggtgccgtcattggccaccttctcggcttcctggccgtacctgcgccacgaatcactcagaaatcacatggtcagccagccttgctctgcctcctgaagctaagaaagaagacgagaagaaattcccccctcacctgttaaagagacacttgcggcagtactggatcgtgcactgcttgttgttcttcttgatcttgtggcatgacgcggcgaagtccatcgtcttctgacggcactgcgagggagcaagaaacagagcaaccgctccacccaagggtgagcaagaattccccgcaaaagcaagggggggcgagcaagaattcctcagatccaacccgacccaaccaccggggaggaagaacagggacgcaccactcctcataggacaccggctagacacggtgtcgaacacatggtagtcaggcaggtaggtgggagtaggaggaggggttacctggtggcaggtctttccgttctccggatcatagatccgtccgccgacgacgcggaccccgttggattcgacgggcttcccgtttgcctccgccgccatcgccgcttggttcgccgccacctcatgctgctggggcaccaccaccacgacgtcgcctcctcctcgtccgttcacctccactccagctgcttccatggtcgccggacgccggcgggcgacggcgagcgcgctggaacgaggggaagagaagtagggatccagagggggggagaggagcaggaaactgaatccggggacgtggaagaatccgagagcattggtatgaatgatgatgaaatgggatttgtgctcgttggcctcgtgaggaaggtgattaatgtgggcgagatattgaaattttttgggcagcgaggcgtaaggggggatcatgacggcatcgtgcccacgaggttggggaaattttttttcaaaaacttccgtccaagacacctctctcctctctctctctctctctctctctccgtgcttcactccaaattgagtttttcggtttcaggtgtgcagaggtgaagcaatgcgcggtgcagcgcggcccactgacgcgcgtggaagaggagtaggaggaggtgtgtaagcttttacgcctgtgagctgttgttgctgctgttatttcctactttgatagagggtagagcggccaaaggtccagctaaagtgtatgggtgggtgtgcggggtgcaagaggcatatgagtgggtcccagcgtttgcatttcctcatcatgactcatgacgtgtgagggggcgtgcatcagtggacctatcaactgtctacttgtttatcttttaaaatagggacaattgcttattttatcccattttgaagtctaactaccaatttaaccctacttttttagtttgcttatttgaccatgtttttcaaaaacgaaccttccgcttgaccctgtttccactacaccgttaagatttgatttaaaaaaacaaagaaatataaataaaattcgtaatgccaaaatacccttgaggaaaccatatccatccctaaccctatccacatgtgtatctctctctctcctgccagcg

SEQ ID NO: 34807 - DNA, 882 bp, Oryza sativa
tttcaatacttagcttacttccttatagcagtggacagcaatatattttgcattcaactgtactagcgaattactagtaacgaggaattatgatcaatatatgaatcatatatgggttttatggatgaatgcatgccctataagacagataataatcttttactcttggcttcatagatttggtggctgacaaacatgggcttcaatggatgggctgaaccacctccctcttctttttggccttctactgccacctatttcctccgttctaaagaaaactcaatctctaaggggatacgacccctcttagaataacgaatctagactacccgttgtctagattcgttgtattgatgacaagatatgctatatcttttttgttaaacaatgtgtgcactaattagaattgatgagtgttttgtgcaccgtgtaaatacgttcctagacttcctacatgatgcccgacacacagaggaggacggaagcgactggttttcatgggccacggacacggggtaatttgggctatagcaacaaaaaggctcacaagcaagtacttcctccgtcccaaaaaaaatagacaactagggcctgtttagttcgcgcaaagaaaatttttagatatcacatcgaatgtttgaccggatgtcggaaggagttttcggacaggaatgaaagtactaatttcataactcgcctgaaaactgcgagacgaatcttttgagcctaattaatccatcattagcacatgtgggttactgtagcacatgtaggttactgtagcacttatggctaatcatagactaattaggctcaaaagattcgtctcgcgatttcccctctaactgtgcaattagtttttttaaaataatctataattaa

SEQ ID NO: 34808 - DNA, 258 bp, Oryza sativa
atataaagcgcgtgctcatcaccactttgccattttggcccttttgtgcattttcaaaatcatcttcgcttcttcagtggataatgagacgaaattgccctccatccttccccttccatggtggcagccttggcagcgccatcggatgagcccaccaccgctgccgacgacggcgggatggccaacagcgccgccggatgagtccacgcccgctgccaacgagggtatctgggtgcgtggagcgacaaaaccaccggc

SEQ ID NO: 34809 - DNA, 1551 bp, Oryza sativa
gtggaggagcgaaattgatttcgaaaatgtacaaaagggccaaaattttgcaaagtggcggtaagcacgcacttcatattagcattttagcaaaaacacgttttcggaatggcattagagtgaaaccgtgttttggaagtggctaaatgtccattttctcgggatggacaggtgcagcggcgcgcaggggtcgatgcatccaaaaaaaagggagggctcgaggggcaccgtcggcggcagcggcactgccatcttctacctcctctcctcttctcctagtagttgtcggcgccgtctccatggggagcttgagctcaacgaaatccagaagaaagagagagggcaggaggagggacggagggagggctaggggcatcgtcgtcgctgccatcttcttcctcctcttctcctagtcgttgccgacatcgtctccctcatcggccaccgcttccctccttcacgagctgtgacgcaccagatccgacggccacaagcttcgacacgctagatccgggagtcttcagcttcgacggcaccggatccgcagccatgaactctgctggcggcggcaaacagcgggactcaaagggagagtggcgagcgtcatgtaggcgagcggcgacggcagttgcgagatggcgatgcatttctctcttccttttttttttcatttttttcttttctttttctatccggttgaccggataatcccgacgattaatttataatagtgtaatttaatgtttggcacaattttttgggacttcgggggctagtttggcgaattttttcgtcattgaaatttgtgcatctccaagaagtcagtagcactgcatgtaatatgttgttatcctctccaatacgaagaaactatactcaatattccgaaaacttcatcttggacttagttaaaactcaatttaatacccatggaggtaaactcaccctccaatccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaa

SEQ ID NO: 34810 - DNA, 4342 bp, Oryza sativa
cagagagagaaggaaaaagagagaaaaaggaaagaaaaggaaccctgggtcccacctgtcggtcactagggttatggattagatttcggattaaaaataaatcatttatgaacagtagctttttacaatttctcgggttaattcaaatttgaatctttacactagcataacttattcattttagctccgatttgagtgaatcttgaacctaaattcatctaaattcataagctttccaatggtatatagttcactatttaataaaatatatttataattattaaataattaataccacgatgatgcataatagtcaacttaaaaatgtgctaataaataaaattgatattgtactataaagtagatgtcaaataattgtccttaacatgctttctcactgtaaaacctatgtaaactaattagcagcattgtttcaaattaattaaagcataggaaatactagtgtcaattattaatatatgtcaatatataattatactcatgacgtccgaattgtataaataatgtttagcctcatactttgtgactaaaagttgaacacacgtagatgagtctttaacttgtttatgagagataataacagagctagtgtgactaaaatcacccgcacgaaattaattaacggcatttcctgtacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattatagctatacgggatagtattaatttgcttgatgcatatattaaattagagggactatatgataaacaggaatattagataaatactagttataaatcttgatctcatataattatagttcaattgtaaattaggattattcattgtaaaattatgtgatgggataatttgtaaccataatatgattaacctaaacaactctaacatacaaagcacggataattattaaccttttctaatttattgtgacaagtaaaatatgttgataatcaaagtaaagcttccatcaataaaataataatacaaatgattcactgtaattatttgattgatcctaaatccatctgacaacataatctctaggatatgaccattttatttagatagatgcatgtgtaaccataatccttccatagccattagctagactaaaccaccatgacaacagaaagactaagaaactttagctcttaccttgattagaatccattagcaagcgcgaataatatgagcaaccctaggttcgacctcaacaaatatattttgtttgtgcatatttgattgttgcttgaatattggtttttctcgcgtattatagaaattgtgtatcggtcagtcgtgaggcaacgtctgcaacttccaggaggtgaaggttgatcaagattgtatcaagaataaggactattctgagcaggcaagtcatcactattccttgaacatgttgatcccaattgcgaaattgttttgtttacaaataaaattgcatgcaatgatgaacatcctacttgtgattatgccatgccttgattattgtttacccttaagatccttgtaaccatgattacgtataagtccctagtcaattatgacaattgcttagaaatgctattctagaatcatgcatactcatatttatcaaatgctatatgcttgggcaattacctttgggaagataattgagatacggcatgtggagacatgagcaccacattgccatgatattgatgacatgatttgtgaaaggagaaatgaaactaaacaactgtttttgactggggcggacggaggatttgggtggtatctggaaaaggctagtaccgtccccggtcaattaaggaccgagtcatgaagttaagcatgaaacgaaccccgtacaaccgcacttctcgtatgggtatagacctagcggagtagatagctgagcggaggcagtatccatgcatagtggtttcttgatgtgtgaggcaggggctctacggtggggcagccattggtaggaccacgaggcgggtgtctacagtggtgtcgccatcggtaggactgccatgtgagaatctaaacataattataacttaatgcatgtgtgagtcttcccttcccgggtgcgctagaactcctctcactgctagaaaccgtgtatgcctagagtgcatgaggatgtaaagttcatggagcggatactgccaatgcgaggttatcgaaaagctttgtcgtgacgcgtctcatgtgttgggatgaggctcatgtgttgggcagtcgcagagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcatgatgatttttatgctgttggagccacttcctgagaggagggaaggtggacgtcctcagaaaaccatgaggattcaatggcgggaagctatcattgggatcacaatggatggtggacagaaccgtcgttgtttaatgtgaacactggaactaaaatttgatcagtctatgctaggtcttaggcttgtaaaaatatttgcaaaacgcagctttacgcaaaagaacctgaagccattccttgaataccctttatcatatgcattgctgttgtggtggtttgctgagtacggttggtactcacccttgctatttatatatcttttaggagagcgctgaagagaagcccttgttagtacgcttgcgtatccaacaagatgatcggagtgcggtcttgttctaggtctcgttccccagtcgactggctgtggcatgttaaccgggcccttatattattttgtcttccgcttgtgctctctgatagttgttagcctacctggccctaatggtagtattaactctcttagcctgaattcattcgtgatatgttgtgatccaactatgaatgtgtgtaccaactactgatccagggattggtacggataaacacagaagatttccgatttccaaaatcgggggtctacagtgtttcacttgatgcatcaaaagactccaagaagtaagcccacagcatgcaagttaattaggtggcgcccctcctatctatccatcgatctgacataaaggtggagccatactacttccatgctagctctgtagctcatgatcaacctttattttacctttattttacttgtgtcttggacatagtcctaaatcaaggtctcccttaacatgtgcttactcataggcttgtaacccgaaccatattatgcggtggcctcacaagcaatctcaaactgccttgaggttgcaacattgaatggtatgccatactcatagaaccacaataccccttgcatatccacataatgcttatcttcctttctctttgtactctccatggtgctttggaaccaatcaaagcgcgtccatctacaatcttttcaactgtttttctaaccgtagcaataattgtcttggtctcctttggcttggctttttttttttactattggagctctgaaatcgtaggttgctcttcttctttttgctgttatcccactagaaggtacaactggcatagaaaaggatgttgttacattttgatctagcagaacctccacatttccccctttcttcatctcccaagaatattgtccgttttttttttgttcttgtgcaaccgattttgcatttgtttcatgagttctttatcaattttgatacaaactaaaacatctccatagccacctgctagatgctgcttcagccttgtagcccctccatttgtcacctccccacaaagattacatgtcactaagtttgtgtttctaattactatcaaatagccgcacttccaagctggatcctttgcatggtggcctccgttttggatcagttataggatcatacccagcctcaggggcagcagcaatagttgttatcgtggttgctgcataaaagattgcactttgataaaatatacaaattgatgagcaacagttgagggatgggctccagtgtcactctgaaggatttctggagcctgtctccataggaaagatccctcccttttgcgctagatggggccccacccctccatttcgaagaagcggaggcctctagccagtttccactggcgcgcataaccccgtgctccagttggggggcatgatcaagactactccgaggcttcagctcatgagccat

SEQ ID NO: 34811 - DNA, 2908 bp, Oryza sativa
ccgacaactttggtttttgatccttgagaagattggaatggcagctgcagcacctcagtcctcttcaactcgtttctctaactagtggtttaaggccattcaaaaagtccctaagaaggaaaagaagggcttgaattccttgtttatcctagtggcttgggaaatttggaagggtcataacgaccgtgtttttaatggggtacacctaatattttggtggttgttcaagcaggaaagtaccctttggagtattgctggggccaaagctccacgagctttttgtaggtcgctacctcttgatggctaattcctcttaggcctagttctttttctcaacttcaaactttgacttcctcgttttccgttagcacgtttttcaaactgttaaatgttgtgtttttggcaaaaagtttctacgtaaaagttatttaaaaaaatcgaataaatccattttttaattttataataattaatacttaattaattatgtgctaatgagttttctcatttcatgtgcaccggaaatgtccctctaatcggagagaacgaacggggccttagaggttgttttagtggtgtgtcatgttgggacgcccttttcttttttggtgtcgcttgagggatactttgggtctctctctagtaaatatttcttttcttcttcatgaaatgaagcacaattctcatgcgttttcaataactaattgatgatatattattatgtggcattggagttgataattcaagttacaatacgattataacttgcatagaacttccctttaagaaactctacgggactccatccaagttatctttcccacccattgagttgaagctcttcacaattttcattgctactccaaaattggtgagtacacatcatttattatttccataattatatacaccatttattattttcataataatcgtcaagattaatttggagtagccaaagcctcgccaactggagtctacacatctttgtttgtgatattttatattattgtaaaacatgatccatgttatttatcccttcattatttgtttgcagaataaattacatctaatcgacatgttattcttttaaaatgttattaaggcatagttttctcaagcctatgctcgtatataaaaattgggtgaagatcataagcaagaccaaatacatcacaaaaggcaaagagaaattacttttacgtattgcagttttttactaatcccttctagacctgcgagttttgctcaattctctatatacctctgagttctggtttttttcccttagatgcctgatctatctaataagtatgaaaaggcctgttttgaccccttttttagtcaagaaaattaacttctagctattttggttgggcacttttatttttattgttgataataaatcattttacaaattactattgcttcggtgcttcccttcaaatctgtttgtaattcattgggtcaatgccaaagcggttaatgggacaagaaaatgattttaaatttaaaatccagtgagaaaataccaaaattacaaaatttatgtatttttggcaatttcatcctcttgattctttttttcaaaattagaaaatagttactaggtgtggttttgatctaggtagggtgtcttctttctttgggtttctagtgaggggcaataatgatagatcatggttggatccaggacattcaaggtgctatttctggtggagtcctagcggattttctcaatctatgagatatgctttctaagattgttttatagctcggcatgaaggatattcatagatggagattctcaactttaggcatagtggaaaaaaacggaccgggctggtggttcaacaggaaaaaactagaaccaaaggtctccaattttcggttgagcctaaagaccggacatgcattcaacccgaatagaaacgactgaaccgaccgggtttagatctccatggttcggttgagcttaaagaccggacatgcattcgacccggataaaaaacaactgaacggactaggtttagactataccgggcactaaaccactttggtacaaccgggtaaaaggagataaatgggccaaattaaggcccagtccattgccttcaggcccacgcggctgtttttttttacaaaaatcataggaaggcttgtggtatagggactcgaaactgggtttgtgcattgagagcgcttggctctagccatcctacccttgttcccttgtattttagagcaaatacacaccgtatatatttgctattgaaccacggttcaaccggcagtccaccggtcagaccgtcggacaggtgcaccaaggggtcatccaggtcactcaccagtccagttttttgcactatgaatttaagacaatattcagctaaggatgcttatgattcctccttccaaggtgccactaaattttcaggccatgggaacgtatttggaaaacatgggcatctggaaagtgtcacttttttcatgtgacttgtcgtgcataatcactgctagacaccagattgtcttgcctgacaaggtctgccacatccagacctttgcgctcattgcgaccaagatgatgaaactattgatcactttctcacaaattgtgtcttcatgaaacagttttggtactccctcctgtagaggtttgtcctaaattctttggtcccccttgaatgacgatcaaaataagtggtggagcataatcattgagggtgcaatatggcctgaattctatagtcattcttggttcttggacgctttggatgcatcgaaaccattgtgttttttatgggactgctcctaaattggccgatgctcttttgcttgccaaggaggaagcacaactgtggttttttgccggcctcaggggctatcattattgactactcaagag

SEQ ID NO: 34812 - DNA, 532 bp, Oryza sativa
ggaatgctgacaagtgcaattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcttgttgcagctctagagggtgatccaactgcggtctaccagtggggacagaatgatttaggtttagtctgcccatctggttctactcagtacaaaaagatggacttgggtgaaaacacggaatttccggattc

SEQ ID NO: 34813 - DNA, 1065 bp, Oryza sativa
gatatcattatttggggttatatattgcggatgagaggtgggcctctgatggtgacagctcagtacgggtattcctccacgcctatatataatcctaagttaatttcctgggaggggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcagg

SEQ ID NO: 34814 - DNA, 6877 bp, Oryza sativa
ggtcccgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggctttctctgggtcccgctgcctcctgcgatggctggaacggaggggatggtggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcgtgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgct

SEQ ID NO: 34815 - DNA, 2402 bp, Oryza sativa
ctgccgactggtttgttcgcctccatggctgcgcgtcttcgtcatcattaactggcgtcatcatcgccggtttgccttcgccgccgtccatagtgttttcctttaatagctggcctattttgccaccgttcatggacatcttcgttttcatcatcatactacttcttccgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcacgagttggacaaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgctattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatg

SEQ ID NO: 34816 - DNA, 4321 bp, Oryza sativa
atagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctatgtcgtgcacgagaggaggaaggtgaattaccatatctgattttggaagtagtcaagattgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcaaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaaatcaagaaaaaaagtgaaaaaaaaggcagaaaggtgcaaaaaaaaaagccgcacaaaaaaaaaacagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagctgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgcgctcaacatcgacatcttcgtcgagacatgaggagggatcaacatgaccattatgaggtaagtgatgatgttctaggtaagatcaaatctgcactgccttatttcgagggagactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgtttccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcagaaagtgcataatcatgaaaaggaggagagagacatgaaagagccgccagtcccattgatcacactcaaagtcgaggcacgtccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccgcaacttgtgaatgaacatgctattcctactgttaattcatactgccctgattttaagcatgttgttcacattgctaatgaagtagaggagcgtgaattgagatcttctttaaatactatgggctatgttcagtttgatgatttttgtgagctcgataatttcaaggagaaattatttgctaagtctgatttgccatatccaaccaatgttctatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgccttgttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaagatgttgcatcacctataatgggcctatgggcttgtaacttcatttgggaccccggcccaggtggggcccatgtggggtgtgccccaagctggtggagcatgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatcgtctccggcaccgcgagatggccaccgcagaagctaaggctgaagacccggggcagaggaagggagtgcggcgcccacaactgcgtcaaatggataggtcggagaggaagtgggaagagagaaaagatatagtgaaagaaggacgctgactcgtgggtcccacatgatgacttagcaaggtggactaggtcaacatgccacgtcagcgaaaaccaccctcaaaaccaccgagggagtaattttgcactggttttactagtttagggttaagatatctggtattgcggttgagggatacgaatcggattgtagggtctatttggcacaactctagctccagctccacctctcgtggaattggagcatagccaaatagtttcagctccatctaaaatgggagtggagcttggtgagcgctctcacaaaataaagtagaaaggtggagttgagtttagactgttccacaactctactccagacccaaccctcggaattaaatttaggagttggagctctaccaa

SEQ ID NO: 34817 - DNA, 807 bp, Oryza sativa
tgctagtggtgtgtgctaatgatgtagggttggtgtacgatatcaacacatgcgagaagattatgtacatacacgactgcgttgctcctccatgtggcctcgcttttgttgatggatttctcctcgctgcatctcggacagacaaggatcaaccaatctttggaagtgctatatatttctgggctccaagtaaggtaagatttcttttgtgccatgtgatgtcttttcttcgtctttgccctttcaggtaatggattttgtgtagatcataggttggattgtgtggatcatggcagcaaattagtctagagaatgaattaattgcagaagtctagggctagaactggtccttgtgttatgattggttccaaattaaattatatgtttcattaaaaaataagatggattattttatcaaaatactctaaattttgttagatttttcgctatcatgtttgtaggagtagatctaattcgatcagtattgacaaattcaggtttttcaattttagtcagaaatcatatgccagattatggtagaagggattcaagatgtaaaagtgtgattgtgattagggtgagtcataattcagatgaaaaatgtgatccaagttacaagctaaagtgataatacattaagtccatttttcctatttcatctaaaactcggcatgtattgctcatttctagatgtaatagttttttccctcaatcaaccgaggacatagaatcaactaactacaacttctcattacccttacacaacaagtacatacggtgtatgtttctatatggtaaatgactaaa

SEQ ID NO: 34818 - DNA, 601 bp, Oryza sativa
ggtgggtgtgcggggtgcgagaggtatatgagtgggtcccaccgtttgctcttcctcgtcatgactcatgaggtgtgagggggtgtgcgtcagtgggcctaccaactatctacttatttaaagtaggtagatagaaatttatttttgacttatctttagtgaagaattattgtttttatatatcgggaccatttgaaaaaatatatatatataatatgtgaagatattgcatcaattatacagcaaagatattaatacaaagataaagtagatgagtatatctaattgttaaataacataggtttcaacgagaggggttggactacccccttattaatactctaggtccactcgattcaggggaaggtgtttactactacctccgtcacaaaataagtgcagccgtgaaaatccgtgtccaacgtttgaccatccgtcttatttgaaaaatttataaattttttttaaaaaattagtcacacataaagtactattcatgttttatcatctaataacaataaaaatagtaatcataagtttttttcaaataagacgaacggtcaaacgttggagatgaatagtacaaaactgcacttttttt

SEQ ID NO: 34819 - DNA, 673 bp, Oryza sativa
gaaagggcggtttcgctgacgtggcgtctacgtgacaatgttgaccaggtctttatgccacgtggcgttgacatggcgcttatgtgacattagattaaaaggttatatgtgacccatttggcgatttatgcaaaatattttgtgagggccacatgtgaagcccctctctctcccttatttctctctttctcttcaccttcatccgatggcggcaggcgagggcttgagtggcggcgacggtagtggtgggcgatggtcacggtggccggcgggcgggcaaatgctggagtggcgaatgaagcttccgaggaactcttcatcgggaaactgttttaagcattcgggtgaatgtccacctgtttcttgcatgtcatctaaatggttatggaaagttttaaaaaaaattgacatgataggataatatgaatatattacttcacaaacatgcaagttcaaatttaacttctacaagttgtaacaaaaataacaaatttgactgtaaatatacgtatactaaaagtttaatttgttattttcgttacaacttgtaaaatttgaatttgaacttgcatgtttgtgaagtgatatattacatataaatctatcttgtaatttttttgaaattttttcataattatttaattgacatgcaagaaacgggtgggcatccacc

SEQ ID NO: 34820 - DNA, 685 bp, Oryza sativa
aacaaagttctataaagtcttgatatctaatctatacctaacattgataaaatatttgattttaagtgttgtgaatccataaaataattagcacaacataaaactaattggctgattccaacttgtcaacagcgctccaattactgcattagcattttgttctaaaggagtaaggttggtttctgcatcaaaggattgcactatccttgtttgggacacaagagcatggcaagttattaataaaatagaaaacaaaataggtaagtctacatgaagtccattttagttcacttttgttctttctgaaagggtcacttttgttctttctgaaagggtcacttttgttctttccgaaaggttcttattttaacattttttttgccttgtcatttcgtcactaggtgggcatataacaaatttgctagtctttccaaagcgagcgatctcaactgttcatcaagaaagaaatttccgtcccatcaagttccctaaattagagaagatatgcaaaccaacaaatgaaacaatggcatttttggtgccatctcaattcttcaaagatgtcaattctagcatagtatctttcaatagttccaaccttctggctgagcaactcttggatttagaggtaagacttatatgtattattattatttctgaaaagaaaattatatattattatatt

SEQ ID NO: 34821 - DNA, 721 bp, Oryza sativa
tcggcctggatggtgctggtgagatcggagtgccagaggttgcggtagctctggcggagctgcatcttgtcgaggttggcctgcgacgacgccatcgcttcttcttctcctctccgccgccggcggcttgcacgaggggatggatcggccgtggactctgcgggagatgtggggggggggggggggggatcgcacttgcaccaagccactatccttctctctctctctttttggggcgcgggggaggaggggaaaagaggggaggaaaacgacggtgtttcggtggggtttcggccgttggatcgggtccgatttgtgcggcctcgttaactgatggccatggcccgccggtcaacgaggcggagtcgtccaaagtttttccccaattttcttttcttttttttcccttggttgtagagtgttttggacgtgatcgaccgaggtaatggacggcacgaacgacgacggcttgcacagacggcgggtgaccggccccggcgacaacgatgcgagtccatttggttcgtcgccactcgccaagccagcaaggtgcaggcgtgcagctagagcggatctgcggagacggggtggggtttacggaacacgacgagcgacccaacgatccaaaagtgacaaaacgtggaatgtaagactgggcctcatagtctatcagctgggctagatggtagtgggccttgatgggttccatgctgttggtatg

SEQ ID NO: 34822 - DNA, 321 bp, Oryza sativa
ttaacaaaaccaacaacaatcccgcaaaaatgaaaccacacagcagtgagcgagtaaattctccgatccccttgctagccacatactccatgcccagagaaactgcaaaatccccatcaataccaccatttgttttgttcatcctcattatctctacagcattaagaataccgctcacttcgtctgatcggctattcttcgagccaccaatggccaatttcagggccccttcatcctcaacatccacaacaaagtcgatgtaatatggataggctaagaatccagtggcaccagagatatcgaaatcctttactgctagct

SEQ ID NO: 34823 - DNA, 597 bp, Oryza sativa
aggcggcatcgtcgtcgccgccgggcaggtcgaagtcgaagtcgaagtcggtgcccggagccgtccaccgcatggagaagaggtcggcggggtccatgtcgatgaagtacctggagcttccgccgacatcgtcgtcgacgaggcgcttgaacgacggcgcctgcgccgcgtgcttgagccaccggtaggagaagctgtcgccgaggtgctgcagcgagccgacctccatgagctcccagcgagtggcgtgcgcgcgcgagacagaagacgagacgaggaggctgtgtggtttggagtgcagtgcagcgtgctgagcaggcaagggactacacggcatggcacggcgcagatatagggggtcgtctcctctccttggccttggaccgttcggtgcaatgtccatgttgcccctgcagtgtctcttttctctcattgcaaaactctgttctttttctcttgaaatttttaatagaatgttgtttttttttcctgacgggctgctaattacttcctccgtttcacaatgtaagtcattcgagcatttcacacattcatattaatgttaatgaatctagatagatatatatgtctagattc

SEQ ID NO: 34824 - DNA, 590 bp, Oryza sativa
tgaaacagagggagtagttgctaaccagtcaattttgtggccgtcagatgttgtggagcacgaattaggagcgcatcttctccttattggcagcagtgacgtcatcgaagccaagaggtatgacattttagttttttagaaagcgattttgttagacatcactttgacatttttgtgggcaatatcactgaattcataacatcgcaatttttctctgagatttgtgtgttgtcttcatctctaatgaactttagctagtctccgattggttaggtttcagggtcaggatggcagaagagggtgggaggtgttcctaggatgaccgaggcagtagtgacccaacggtgggttagcggacatgacaatgcaaggaggagatggtggttctgcctcagtcacgggcaagaatgacggtaggaaaagccttatcatttgagtgattaggaaacaataaaaggtgacatcagatccgataataggagccatcgaaggaggacagtagcgttggcgtgagggtaactatagatggaggagtataagggggcaaagtggttcatcaagcctcatagagtagttaggaggcaatggga

SEQ ID NO: 34825 - DNA, 581 bp, Oryza sativa
gtctctcggcatcaaggctcccctgataagctagttactcagcaaggggtgttccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccgagtcttttgtaaaactccagttttacccaagttgttactcagattttaagtttgaaggcgaccgtcgatactcgcacagagtgcacgagtatcaaggcgcaactgggtggttacaaggggacatggcatagcaattaacaatggaaggatcaaatgtgacaatttaggtaagtccgccaatctgcttcgcagacgggacaacagattaagtgtgatcctatcaatgcataatattttgcaagcaacatacttaaatttcaaatataggctcaagatgttcaaaggtggcttgccttgctcgagatctggagcttgatcctcgaaatcctcgcactgcgggtcttcgggctccgaaactacatgc

SEQ ID NO: 34826 - DNA, 142 bp, Oryza sativa
cgaagaggatattgagcgcactgccaccgtcgatgagggttctgcgaagcttgacattacggaccactgggtctagtaccagggggtaccgccccgggtggaccactcggtcaggatgatccgagcggtcaaacttaattgc

SEQ ID NO: 34827 - DNA, 34676 bp, Oryza sativa
aagcttgcatgcgctaacgaggagcacacatgagctgctttaactgatgtcaacagaaaagaccaaagagatgcaggttgactttggggggcatcaaccaaacatgatgatggctccacatgcttatctataacgatgccactttacagatgccctccatgactgcatgcacgaaagtcattgtcacttgtttttcatttgaaagtaagacttgttgataacatgaggcttctccaagatcgcactgcctgaaaaggaaattacataacgatgaaatgtcatgatcagaaaatacaaaatatcttgtgtagatgcatcctaatatctttcagtgttgttctgaaagattaacttgaagttttgctaacaccacattgaatatactcttgcctgccaacatagtttgtatatatgacagtactgaagcctgaacgtgccaatttggctatttcatccaaaatggtaggtaatgaactaatggaacctgaaaaactgaaaagacttcagtgatagaaatagttgatcagaaagtcagtataatgcactaaggagtctacatcttttcctagataataattcaactaggaaaacagtggaaccactaccttttctaggggatagggggttttttgcaaacagcgaatcaatgatacaagataactcttggtttgtcaaatggaacttcagcaccaggaagttcagcgcaaagtccccataaatcaaatttaggcaccaaatgattttgtaacaccatacgcttattcattattatattgtttttcagtaccttggaatgaggatatacatattacaaatcaattcacaagtcaacatcaatgaaaagacaaaatcaagtcagggaacaacaagatttcctttccaaaaaaatgctaagagattacacgatcctttttacattctcaaaacctataaaagactcaacatatgatttaaattaacatgtatgatcattcgtgtagaacattaagaaaaaggaaaaaaaaacatagctaatgatctaaccagtctcatccaaaaggccctgccctcatgtcagcaactggctttggcatcacaggacccatgcacgaaaagagcgatgctttctttggcttactaccaaataggaaagttcgaagaggtactccagctttcattgacagagatctgaagctatgttgtgttcggtttcttcttcctatagacagttcaatattctctctcagcttcaaaagagccctcccaacctccacttggaggctcctcacatggtccatcccagtttgtagctctttggtaaccttgctgttctcttgcttcatactgctcacctctccttggaactttgcagcctggaaaggagtgaaatgagcttcatcagtttggcccaatgctgtgatctttgatatctcctcttctatgctgcacagcaatgagaatctactctctagttccccttgtagcagcacattcttttccaaccatacctgcagatcagtgctcaagccacgcaacttcttttcaagcacagctgactcttgttttctagctgactgacaagaaggcacagcatctgagccttcctgcgctttggcatctgtaagtttatccatctcagcttttgctttatcaaatgatttctggaacttctgcatataatgatatgatgtactgaatctcaaccagaagtccaggttttcctccagtattctgctaatttctgctctgaatttatcttccaatgatgggtcatgtggttcttcatgttcacgtatcttcatgtattcttctgtctcagcaatatttttgttttcaagactaggagaggcatttgcttcagatgattcttcagactccacaaaacgctgaggtagagaattgttgagcttggtttgtaaagagctcaacattcgtctgagagagcgaatctcatcatcttttgttgcactggaactctttaactcattcatctctgacattgcctcgagatgatattctcgatttctcttctcaatttctaaaagctgtttctgcgtatctttgtagttacgaaggatggatgcataatcttttaagagaattttatccttatcctctagcccattcaaatctagttgttgccaccctaaagtttcatctggctcttccttatgtgccttgctagagtcatctaatgcatccaataatccttcatcttttgatttgcatgcaattccggaatcatcttgtgatgaatttactatttcatcagtggaatgtgcatccaacttctttacaaaatcattaagactgtcatctacttcagttagttgctggtgaatatttccattctcactgtgcacagactttccaatccgctgaattgtctgcagaacctcctcaacttgcttcaatctttcagacaacttgctagaatcctcaatcaaagctgccttctcgtcctctaagctatccaggcgcttctgtagttcgtctgcctcatttttcattctattgatttgagcattttgtgaagaagctgcaatttctaggctgatgaccttatccacaatttcatcaacctgtccggctagatgcaccgcggacgcctctgaggacgactcaaacttttgtttgaccttttgtgataattcctgcagctcgagcttgcagtctttcataattagatcactatcctctatagatgaaggtatagagctgaactctatgtcttggtgattaggtaggtccttctgatcatcaggatacccacactcgctcttgaaaatcgttatcttcttctttgcatctatgactctttgaatctccatggttgtctcttcatatgatctcttttgctcacaatgcaagctagccaatttatcctcgcaagaaataagggcttgtgcagccattaaagctcgagcttcattgtcttcaataactgcgctggtgctaaaagtctcctgcaagctccatacctcctcttgcatctctgccgcctgtctttcaatgctcaaatacttgttcagcgaagattcatatgagctcttgaagaattccttttcagtctgcaagacaaggattttcttctgtagcctctcaatctcttcttgtgccttgtctttactcatcttagagctgatctttttatgtgtttgcgtcctctttggagctgcgctggttcctctgttgatattaatccctgtgataccttttgggaaaccatcaccattgtcatcttgcagagagagctggacttgctccggaaatgcagttgctatggtgtggttggacttgtgaagctcccctgatacccggtcatatctatcagcaagcgcctggtaagatctatatgtctcctctacatggtttataagatcgggcctgctcttgaagtataggtctgccttccttgcaaatgtatcagcctctatatctatgagtttgatcatggccttcacccttatctccatctctgcagagataaccatacaaaccttttgaaacattgatgagaacccaaaaacaaacgctcttactagaaatctacaataattccttcagaatcatttcatgttaaagaagattatgctaagtagtagtaaataccaacaggacaccgctatcacctcatccgtcgtatccacaatagattggaacggcaatagaaaaatgtagctacgaattctgctgtgctcgtgcgttgttcggacttcggagagcaatggcgataccttggacgttgttgtcgagccatttggactgggtggtgcggatgtggctcgcccaccaccacgagtaggcgttgctcgccgcgcgccgcagcatcgcgggcagcctgcctactcctcctccgtcctcctaccccccacctctcctcctcctcctcctcctcctcctcctgttcttcctatgcgtcctagccttcctctacggctaatgctaccgctactggcggcgtggcgctggctagggtgagggcggggccgggaaggccccggggggccggtggtggtggggaaaggcatggcgagattaggggaggggaggggatccgtccgcgagcggtcgcgctgcggcgggtggctgcccgcggcgcgcggccgaaccgccctgcgctgcggccggccgcccgcgaggcgcggggacgccggtggactgcagtcacggcacaactttttttttttaatttctcttttttgagaggaaaagtcacggccgaaactagtgggcttgagggttcaagttcaacccatcagtgaagttcggaactgcgtggggccgggcctttgacaaggctgacggactctccgatgaacatacgtcggcccaggtgaccatccgatattatcttccttttctttttttttggcaattatcctttctttacaaaatggaagtataacttttgatctcgccgcaacctaagagcaagatcagtaatacagttaagtgccgacggtaaaacggaccatgtcagcctacagcaatatgttgcacactaatcatacacaacttccggtgctggttttcttttttttttaaagtaatttatacgtctacagtacatgaacttgataggtgggtgcgatctagtaaaaaacgtgaaaaataagcatataggtgcacaacttggctagtgcgttcagtaaaaaaaaaaacttggctaccgtgtgtattttggttgaaagatcaatattccacacaatacttttatgccatataaacaaagcagccactcatgtcatctcgataaggatctacattgttttttaatttgttagttataataataaaataatcagtcattttgaaactgaaagatatatgattatcaaaagtaagtgtatgcagataacataatttctaaacgattcgattaatcgacatatccattacctcaggttatgaacatggcaaagacacaaaattgaatccatgagccaatgatctactccctatgtttcaggttataagacgttttgactttggttgaagtcaaactgattcaagttgaccaaatttgtagaaaaagataataatattttcaactaaacacaaaattattatgaaaatatattcaattattgatttaatgaaactaatttggtattataaatattactatatttatgtataaagttagttaaatttgaagtaagtcaaaacgtcttataacgtaaaatggagggagtagctgttaagcttataatactaggattaataaaagatatgtgtaaatgtttttgactaaaatgcacatgattatcaagtttatgtaccagtctactcattttttaagttcttgcactaaatcgcacgcacctaccaatttcttgtatcgtgggtgtaatttactcttattttttcaatcttactttactagcacgatccctcacgagattggatgatattgggttggccccacaaaacgtgttatattatcaccaaaagcaatctgctatcaagtagcacgtgaaaaactacactggactcgggcggtaaaataagcgcccacttagttctctctcttccacatatgaattaaatgatgtgacatatattggagcctacccagtcagcttatagtactttactgcttgctctaaggccgagttgtctagtgaggttcccaagtcccaacatccactcactcagtttcctgcatacacgcttcctaaactgacagattacatgtttttggaaaaaaagaaatataaaaaagttgctttaaaagcacattatttttttaagtgtgtttagataatgatatttaattgatcatacgtcaatttatcgctttgtttttttttttgcatgaggggtttagttccaaaccccaaccaaagaacacattataagtgtgcatactgttaataaaaactaagtatgcacacaactataaaaaaaactagtatgctcacaattatattcatggacaccataatttaatcccgatgatttcatcaccacactagtattgcttaactgtaaaatcgtgttaccattgtccaactaaattttaaatagttatagtatagtttagaaaaagataatggcatctataaatactccgagaataatttattttcgtatttacaaaccttttattgtatcatataattcgatcatgctaatataacttgaaagtgcacctaaactcctagtgaattttggtactaacatgtttattgaggaaaaatggagatattagccccgagttgtattactggtgcaaggatacccctccataaacaaaagcaagcgacaaaagtgcttgaagatatttttgctttatattttttcttttgagtgagtgtgtgtgagagagagagagagagagagagagagagtcacttggcaccatatgaccatactcacaagggaaaacgaggcttggagcaaagtgatgatcactggagactgaggtttggagcaaagtgatcaccggagactctgataggtgtaaaccggatactcatgtaaacttattagttgtgtgcaacaaaaaaccatagaggagactctggcaccttttttctctagctgacagagtgagccaaccagggactctagtcttcctttcttggagcaatccaagtaatccaacaaactagagactcagatgtttaaatttgtgtgtaacggctaattttggatgggtgtgagcatttcactatcctccatgctccccaccccccttcctcacacgctctgaataagtggatgtcagatcctttagacctaatctcctagggtttccaccccttcttcttctaggttgttgagccaattttattgtgtgagagacaggggattggatctaaaaatatagtgaactagtattgaattgaacacctatgaatcaatgacctaccttcgacattgtgattcttactcttttaggttctcctcctagccagctaggcgtcacctgcgagtacccgattgttatgatagccctagaaggttttgtgaaggtttatcatcacctctggaacgaaagaagtatttgagtggatactaatcatggtgctcttggtaaatcaagcatcattggatgcagtagctcgtcgtccaagcttgaatcttggtggtcgcttggaaacgaagttttgtctcggtggtagcttagaaactaaaacttcttcatggttgatagcttggtgaggattgggtcaattgagatacaggttccttgaagtccctcgaaggggagtatggtcgctctgtcaattgttgttctgttgtggtatcttatcttgtgttttctatattcatctcgctatctttccttcccgctgtaaatcaaaatgttcatttttatattagtttattgtgttttatatattcacctggagtatatggtgtgaaataccggagttcaaatatagagtacacttcgagaaagagtgtaagcatatagattcatttggattggattattttatacaatgtatacataaatcaattcagttgttgcaaaaacactatagattcaattgttccaaacgggacatacagattttgactcttgtaaatgtcaaagaaacaactctaaaatctactagtagaaaagaaaggcactatcaaaacgttcatttttcagctttgccaacatttatatttcgttttttttgaacttttgataaatgcactatcggtgctatttagctcaaatttagtattcatttgagcttagaaaaaagaacataaaaagcagtacaatcattgaaggaatgttcatgtcatttcatctgaaaattttactggcatactccctccgtctaaaaaaaaagacaaaccctggtttccgtgtccaacgtttgaccgtccgtattatttgaaaaaactatgaaaaaaattaaaaagataagtcacgcataaagtattaatcatgttttatcatctaacaataatgaaaatattaattataaaaaaattttatataagacggacagtcaaatgttggcacggaaacccatgatttttttttttacggagggagtacatatggagtacacaaaacacagtcccgctaaaaccatcgcaataattcaaagcccccaccagtcagagagccaccacggcagacggcaccgtcccgctaatcttttcccaaacccattcgatttgggcgccgaaaatacgaaatttcagatcccgcccgccatctcatcgatccgcgcttttgtccacgtcaccaatccgtggcaactccctcgcaccccgatcccacccgtccattttctccctcatccaacggcccaaacccactccacatcgccccgccctgccctttaaatatcctttggccctttcgcctaccgcactcactgctcacaaccaccgaatccttccccaaaatccccaatcccccatctctttctcctccagcgagcgagcgcggcggccatgtcggggcgcggcaagggcggcaaggggctcggcaagggcggcgcgaagaggcatcgcaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgaggtccgccgctgcatccgcctggccgtggggacaagtcttggctcgcggtcaagaaatccgggaggatatctccaattgatctgggtctcagttagtagtagtagcagtagtttgtgttggcatcgttcttgtgcctggggcaagtttgctttcgtgttctgaacttgtgctgtgtaaatccgtatggtgttttagctattaacaaagttgggtcattcgctgcaaacctcatgcttctagttattgttgttcatatgagctagtataaaactgctagttttgtcttgtgcaaatctcacattaggaatttctattcgctccaactgtttattgctgtttgtttttggcgaatccttaagaatcctgcagcatttaggtggaatgtcaacctcaaggtcagattgttttcatatggttgatccctatcttagctttgcacttcttaattctccaatctccactactccacccttttctatggtagaggtgctcactgctccctttcgttcaatgattggcatgacggcgtgctcttctgctgaattgttgccaactgagcaatttgccgatttggttgggagttgggactgcaaattttgttgggagttggacttcgtatacgcaatgcttagctatgtactccagcagtatcgagctattgttgcatcgcacgcgtttctggatcgaaatcgttgtttctattgcatgaatacgtgattaggaagagatctgtcacccaaaatacttttagagaagggttaaatattttttgtagttctgatttgatattatataaagaaaacaactgtcaaacacttaaatttgcggctatatcaatactattccaaatatagaatgcatgcagttaaaccttgaaacttcaaatggtttattgatacataccatattaggatttgacatgagaaaatgttattggtaattggtaaataagatttgtctagaaaagcactttcatatgattatacttctcctaatttttataaatatatagtcccaaaaaatagccatgaaacatatatgtattggaatgataagtagaaaaaacagaggtggtaaataacatataaataaaatgcatgggcattcaacaatgtcaccaagatattccatccatagtaatttatctgatactaatcctagtactcatttcatagctaaggctgtgtttagttcctgaaattggagagaagtttggtgaaaattggtagtttggaaaaaaaagttaggagttttatgtgtgtaggaaagttttggatgtgatgtgatgtaaagttgaaagtttgatgtgaactaaacagaacctaaatggaagaagtgcagaaaaaatattcatgcgagttctgcatttgcatcccctaaggtcactcacaatgcatcaccaaattttgaggagtcaaaactgctacatagactaaaaacttcgtaagcaactaccttcaaggcattagcagtgcgccaccgaaaaatgccggacctcactagccacataggcgaggaacaatataagctacatgtctcatagtgcaggccactcgtggtgggtcccactagtattaccttttttggtaaaatttgctataggacatcaaaaaaaatttgtaattagctagaggatactgtaaaaacgtgtatttgctatagtgcatcgcaaaaaactggtaattggctgttggacacccgcagcactattttattatttttggaggaaaaggagagagaaacagctgtgtaaatacggttataccctttgaatttgtttctttttctttattcttttctttctcattctctctcttctctctattctttcttcttgcttctctctcgatcccctttctcaccacgcgagtgcacgcctgagcaggagacagctgacgtggggcggtgcgaggcgacggccgggcgcagcagcgcaggcgccggcggccagctgtgtgcggcggcgcggccaaggccacgatggcgtggcgctacggcgtggcggaagctggtggcttgccgttgtcggcgtggtcaccacccttgccccagatgagcgcgtggtctcacatgacgcgaaggaggatagctcggcggcgaggcgcaagccaccggtgctggcctccgggtccgccgggatgacgacacacgcgaggctgcatagcccggacgccgcggtgagctcgaccaccgagctgcgccggttgaacctgcccatgaggagccacgagaggacggacacgggcatggtcgccagtgacaggacgagcatcttccttcgtcccagatgagtgtcggcgagcgtcgtgagtagaaagcctccgacgaggttgtcagcgaagaacgacgacgccgggagggagacgagcgccgggcagccgccactcttgagcgcctactccgacacaaccgacgtcctggctgagtggtcccactcatgtcgcggcgctccgccacgagcgcgacggcgccactcatcgccaagccgagcatgcagatgagcgccggcgcgcgtggctgcatgtaaacccccctcccgtcggcgaacgtggccggcaccgtcgccgtggccgcggattgccgctccgccacccggcttgtctgggaagaaggagagggagtggggactttcatgtggggcccacgtgggagtcatttgagccaagggcaaacttgtctttaatcattgtttccctagttttcctccaaaaataataaaataatgctgcggatgtccagcagacaattaccattttttttcgatgccttgccgcaaatacacatttttacggtgtgctccaactaattacacgttttttaagatgtgctacagcaaatttgccaacttttttaccttttcatctctctctctagtttccccaccggtactttgcgtcacgagagaagcaggcgctgctcctctaccatttcatctctctctctctttactttcccaccgcgcgagcggagctgcggcggcagtgccgagctagcggagcggcggcggtgtcgaccggcggcgtcgagcggcgcgacggacgacggcggcggcctcgagcggcgctgtggacgacagcggcggccccaagcggcggatctctctcctctcgccccgggcggcgtcgaaggcggcgggcggggtggcccgagcggcgacggtgccgggcggccgggcgacccggccggcgccactcctcccccgaccagcactcttctcctccccggccgacgtctcttctctcccggcgctgcccaggcacggggaggcgggcgccggacgtggagtggagcgccgacgccggacttggagcggggtggccggcgtcggacgtggagcaggcggcggcgccggacgtggagtgtggcgccatcgccggacttggagcgaggcggccggcgccggacatggagcgggacgaggagatcggaggcgagcgcgcgcgcggagcaacgatggagaagccactcgctccaagcgcggttgcggcgctctctccctgccccatgcgacctcgatatcaccggagaacttgtgaccttctttggacgcgaggacctcaggtttgtgggcccaaacacggacgtggcgtagattctccccgctttgccgacgtggattgctcaggctgaatgccaactcattgcattatgaacgtggcaacccattcacagtgcacgtggtctcacaggtaccaactttatcactttactaactttttctttatcccctcctttcttcactcctttttccccaccccatagccccaagccgggccgagctcctccgctaccgacgggagaggcggcggggcttggcgctcgccggcgcaccaccctcctctccctcctcccacctcccatgaaacaacggcgaggtcggcacgcggaagcgggcggcggaggaatcggcggcgggggagctcggcggcgggggagctcgacgtcggccggcgagggcgccgtcgcttcaccacctctgcgggcgagctcctctcgtcgccgccggatgggatggcgaactcggcacggatctggctcggattcggcgcccctactcttcctctccggcgagctttttcactcactcactgtgtttctctcacaaaatttgctgaggttctcggagccaaaactagccatgcgaacctggtgaaaacgtgggccccatctccttctctcctccatgcacgcattggaccgacatggacagagattaccacacgccacctcaccgcatcgtgaatggcctaacgttgggcctgcataaccagtttttgggctagtcaggcccgtttacaaaccaagccacaaggttataagcccacacacacgtctctcttctctactcgtccccctccgccgcacccgccgacccctcctctctcgtccccggcccgacggaggtggaaaaaaaaaagaaaaagaaaaaaaaactcaaaccgccgcactcgcacatccggctcgccatagtccccctcttctccaacgaaatcttcgccgtgtcaacccgcgcctccgatttctccagcttttctttcccgggattgcgcgcgtgctccctcccgctcgatccggctccgcttgcccgtgctagccgcggactcggggggtggctctcacctgttgtgaggccgctagggtttcagctcgagctctggagccgtagggcgccgggatatggcggcccagggcggggaggcggctgccggatccgacgccaagcccactgcggtatgcttcctctgctcctgattcggcgtcagtccctagcttgtgagttgtgaggcctctgccgccgcatccttttggagttgtgattatttcctgcacttgcgcggtgtgattcgcctctgctttgggttaggatgcagtgggtggtatccataatctagttgattacttcagtgttttctgcttgggcgtgttgccttgagaaacttaggtttagtgcaacggttggatatctagttgtagccggtggaagatgtttagggatgttttttttttgctaatttacttgttcacgaatttaggaaaaccaaggactgaaatagtcgaagtaggttgatgccatatattacaatgttgttgtttactactacctccttccccaaatgtttgacgttggttagttccaacgtcaaacagaaaagaatggagggagtactactgttgctttgcttatagcataatggctgcgcactcttcctatctacgtacctagttgacaagccgtcatggttgttggtcaatttgctgtggtttagccgtttagtcccccggaggttaatacatgaggcgcttataatgttgtccgttgccagcgttttggatgtaactgaatagcttgtttcattctgaaattgataacgttgtttgtctgcactctacataaattgtatgcttcattctgtactctttaatgttcagtggatatggctgatatggagctgccacgaataaagttttaaatgttattaattagagcgtgcccacctatttacaaggcgttttctttccctttttgaaaccggcatgcctaatgtttcggatatagcagtaaacaggtttcggaaagctaggatcaaagatctactggtgaaaccatttagcacgtgaggacctgctttttaggagtctgttttgtgaagtaatgccctaagtgtgaggacctgtgatgccatctgcttattctgtaagacataaatttataaagatgggcataaatgtaactgtacttatgtaggtttgtgttaaatttgttgtgcatctttgcttgaacggcaggttaaagccagttgatgctgtagtttgtgtatattctaatattgcatttattagacagtttctgctgtcatttgtttgccacgtcatccttttagattttctctgccacatctgacatgtcattatgtactatattgtgagataaagcatgaaaggggaattctgccttgtatagataaaggtggttttgtacaaaacaagtaaggggaattgtacataaaggttttttttgtataaagactgtcttataaaacaagtcattactgtgtgaatattaccttggcattctttttgcatctcatgctgtttttttttctgtgggtcacgtggcacaatagtgtactcctaatgtttttctgcctgtttctacactttgctacatggggatcgatatttctttccatgattttccctgttttgccagagaagcgtcatattgtgttgtaagttttttttttcacatcatacattgttccaacctgaaattttgtttgttctaaacaaataatagggcacaggcatggagcagccaagtccatctccatatcaaccttcagcttctgatcatcatttgtggtcttcttcgactggtgctccctggaactattcaatgaataactctaaccaaaacacagtttattatgacccacaaagggatgtgtcagttccaggatctactgaaaatgtgacaagtggtgcaactcatgtggtccaatcagctatgggcattactggtgcaactgattcttatgctccttactcgaattctgttcaacccggttacaatgctccacagtatccaaactattactataactgtccacaaagtacaaatgaatcttctgttcaacaaggagtagatcaaagttcaggtgctgcttatcagcctcttacttcatttcagaattcaggatcttatgttggtcctacaagtaacacatattataatgctggtgctcatcagactgcaccgggatatgctaccagcaacaattattatcaaagcaattcctggactggcggaagttctggagataatcatgtacaatcatatcagagctatactccatcagatactaatgcagcccagagttctagttcactacccaacaattcttaccattatcatcagcagtataatcaatggccttattattatgatcagtccgcaccaagttctggtggtcctgcagttgctgtcagcagtgtttctgatgcaaacactgccagcgtcagttctggttatgtttatccgagcacccaaccacctccaccaggcactacatggagaagtgatgctggtgcaactgctgtccctcccccgcaggtattatttcttcattagtacttgggaacctgtgactctgagcacttcctatgtcctattcattgtatatttttttattcaggtttttcccacaagtagttttgcgttgccaaatttaacagttagcaattgacaggcaccaggaaccccagtgtttcaaaatcagcatgtcaaccaggcagcaggtcccccagggtatcaaaaccagtatgtcaaccaggctccaggcaccccaggattccaaaaccagtatgttaaccaggcaccagctgtcccaggatttcagaaccagtatgctaacctagcaccaacatatcaaccgggcactacatactatagtcagttaccactaagtaaccaagcagatcaacagaaggcttcacgttggcagggtccaatttcaaacgtttcttcagtcaatcatgtttctgaaagttctcaaccaacttttcagggttctgcgacatcagatgctctcagggtaaacaaaatccagatcccaacaaatcctcgaatagctccaactcttcctatggcaatgcccaaagtagagaagagaaatttagaagctgattcatcaaaaaagcctgcatatgttagtgtcgcagtgcaaaagaatgatgtgaaagcagctcaagatggtcacgaagctgtaacgcaggtgagtaacgattctatttacttgtttttgttttggtgattatcaacgatactattattatccttcagggacaaggaaccaactttgtggaaatttaaacatgcttactccttaacatttccatttttgaaattatatttgtacattcctggctctcaaataagtggcagtgcccagattcaaaatttgtcaaatctctaatgtacttaatgcctgtcgatttctcatgtggtcatgccaaatataacatgcacagctttacatctacctgttttgtttacacaatttcctgatctgtttagggatcaatccctgtttcgcttcgtacttatgttgggcggaatgtttcccgttgcaaggatgatgcccagaggtctgccgtgcagaacatcttgaaagaggttcagtaatctgttgtttttaattctttttaaacactatatcttggtttctgtctggctggattctagttatagacgcaaccttcagttcatgagacctttagtaactatgggaatgggtaaaatagttagggttgttccatactgaagttaacacactaacatcaacgacagcaataaataaatagataggtagatatatacaaggtacataaacaaagatccacaaagaaacaatggcacagaggccagacaagcaaatagaaaacagagtagatcacgtaggtgaattcctgaagcctcttggagatttgccagaaatttcttgttagtttttactgagaaaggttcatttctgctgtaagcattctcttccacatatgcttgtttggaggaatcttgtcaaagatgtatctgttctttagatttggcagaaacttcttgttagcttaacctgagaaggttcatttctgctgtaagcattgtcttccacctatgcttgtttggaggaatcttgtcaaagatgtatctattctttataaccatatatgccagcaaccagaagggaaaaaattctttatacacttctttacaagatgtatatgcacgccttgtggagtttaaccataaaagtagagagctcctatggatctctatcaactcccagcaagctagactgaattcacaggagacacacagatgatcataatcttcaatataattgatttgcgaagaatacatgcttcactctccactttggaattcttcattttaagcatgcgcgttgcgtttgttttaccgtggagaagtagccataggaatattctatacttaggcatgcattaatttttccacaaaaagtgacttcatatttaagctcttaagttgattttcattatgcgcccattggagcttgccatgaaatatatgttcttacaaacttcataaagagtctcctaagtcccaagtttttcccttccgataattcagataatcaccaaggcaactgctgatggtatccttcatactaagaactgggacattgagccactggttcctttgccagaaaacattacaagcacaaatttgacaaggtgtgctgctcttccctccatttcctccttccactagtgatgatgtagcttttcatgtggcagtaaccatcaaatcatatgcttgtattcttgtatagcacctttttggttagtagtattctttaggagtatttcctgcagcttgatttgaattatttggatattggaaagcaaattttgttgccattgatttataactatgtaaagatgctttgctttgttcactatgaaaaaaatctcacatttttctcttaatgcttgaacatacaagtactgtaaaaactgagaacaacagcactgtgctagatgcaatatatgccacttaagaagcatcatgggcaggatcaccaaatcataattcctcccccacctccccacatagaactattaagatcaagaaattattggaataacatctgttctttgttttgttgttcaacacatgataagggtaagtgggttacttgcttaggcaggtaaaaacattgtagagtctactaagaatgcatggtagtaggcacattgacatgtcagttcagtggatgcctcggagcaccagtgcatattgtgttggagggcctagcttcttcctgaagatgcttttctggaataagctggtggggacggacttcagctggccagtactataggggcttaagcctctctaacaaacctcaaaatctacccgttagagtcttatagaggatataggctcatgccatatggtggttttaagcttacagagttcatcaaaacaacaccataaccaaacaactaatcttggtcattgagataatcagataaacttgggatttatgaaaaataccaatataccattgccattgtagcactgaggcatcgtgaagttgcaaaatgccatgcaaatatgcttgggttataaatgccatagtcatcaaaatccatgctattcatgtccatttaggagaaaggtaatatcacatatgatggtactttccacactttatcgtatttgcaagttcatgattatcttaatgatatagagctaaatttctcaatcctttttttctttggcagctctgcaaaggatttgagccccttctccttctcaacttctaggaggagccctagtagacgtgcaaaaagcaggtgggaacctgttgtagaagaaaaggttgcaaataaggtggaattgatttccaaagaatcagcaaagaccaatacctacaatagttcagaaacaactaaaagagcggtaagatctcagtatgggttcatataacatgcatgcctttcatttatgagaaatacttagctaaatactttgcagggtagaagttgggatattgggaagtttctccaatcccgtcaggctcctttaagtcaatataatcagagacctagtaaaaagaagcggattggtggtaactcaagtctaactgaaaatggaaatgtttcaagtgacagtgataaggagcaggatctgacaaaatattatgctaatgcaatcacaatagcaaattcaccagaggagaagaaacgccgggagcatagatccaagcgttttgaacgtagtcagggtgctgcatcctcaaaatctaggagctctgttccagataaggatggaacatccaatacatatgctaggagatctatgccaatgcttcttagcagaagtaatggagatgatgttagcttcgctgtggaggatttggattgggatgcactgactgtcaagggaacatgtcaggaaattgagaaaagataccttcgtcttacatcagcacctgatcctgccacagtgagaatgctctgctaatattaccttgtaaactgcctagattggaaaaacatattgttgataggaaattgtctctagatgttgttttcttccttttgctactccttgctttagttttgtttcatcataccttttcaggtaaggccagaagatgttttagagaaagctcttcatatggttgaaacatctcagaagaattatctgtataaatgtgaccaactaaaatcaattcggcaagatcttactgttcagaggattcagaacgagctgactgtcatggtagcctttcttagcccactttgtgtgttatatactgcattatactcctgttcactatgttagtccattttcacgggaaatatcatttcacaatgtatccgagaaaaataatactccctccatcccaaaatataaggcacaaccatttttttctgtctcataatataaggcgtgcatgcatgcatacattaattatcttctcctggttcttttaatttggtttattttaattcatgtaccattaagtctctcaatcacattgcttgcatgtatggatatgattcaattaaggaggtgattaaattttttcttggtctttgtgttagtagtggttgtgccttatattttgggatggatggagtagttgctatttgcactccttttcccaaatttagtaatgtgatcatgtgaatacatagttgctgtgtgctattcaatgtggacgcacatgatcatttcttatcaatttttttcttaaactgctgcttcattggcctatttgcatggttggctaggacagatattacaggacggagtagtttctaacagtttggcgtgcctcgattattctgtttgttttaatgttttgattcatgaaggaaattatttagttaatattattttggcatgccatccttttttactctattatctatctttgatttttcatgtcaacgctgttccaacttcccgccatttgtttcatcttgcctgctttttttggtagcttccatattacttgttttattctctctttttttttcaggtttatgaaactcatgcgcgcttagcacttcaatctggagatttacctgaattcaatcaggtttgcttatcttgttctgaatgtctgtccttattcctgacataagaataataaacaagtgtcatgtgctattgtagtttcattacgcacgtctactaacagccttgttagaaattacccgctctcagcggtttgagccaagttaacgtacataatactctggtgaaataaagccccccatgtccttattagtttctagttgaaagtcttgacccccccccctccctctttttttttaacagaagcatatatgtagcacatggtctatactactaccaattgcaactgccgtagaaatgcagtaaattagccatgttaaagtgttggtactttgcaaattgtgtcttttctaaaactggatgctctattcttgaattattaagttttgtttgtctagttgcctcacagaagaaagaaacctacagcctaatttttttattgtttctgctgcaactctttgcagtgccaatcgcaactgaagagattatatgcagaaggaatcaaaggctgtcatttcgaattctctgcttacaacttgttgtgtgtcatgttacactctaataacaaaagagacttgctttcttcaatggcaaggttggttatttcacatgagttggttaatatgagtccattagggttgcataatatgagcacatatgagttggttatttcatagttacatgaaccttatttgatatacatccatatctaatagcttgccaaaggaagccaagcaagacagaactgtcaaacatgctcttgcagttcattccgctgtttcatctggaaactatgttctatttttcaaattatacaagaccgcacctgacttgaattcttgtcttatgggtaaatatgatctccctctctctgtaatttgaagtgttcatctaatttcattgagatggtgtttttgctttgcaacttgcatgattggtgctgtagatctctatgttgaacggatgcgctttgaggctataaaatgcatatctaaatcatatcgcccaactttacctgtaaaatatgctgcacaagttttgggattcatggcaattgacgaagtttgtgaagctaaaagagctgatggattggaagaatgtgaagaatggttaaaagcgcatggtgctgttctttcagtagataacaataacggagaattgcagatagacacaaaggtaaaacacgcagcaggtttttgcaatgtgtttgtgttgtattggcttttgaaacactgcactacctctattgttcgacaggtttcttctacttccctatacatgccggaacctgataatgctgtttcacatggtgatgcatcacttgctgtggatgattttttggcacgaacatcataggtgatgccatgctgagcatttttatcactcatgtggcactgaacttcgaaggtatttctcgattgcatgtagcaatgcctgtagaggaatgttctgttaaatgcagggtaggaccttgaaatggatcagctgaagggggaagcacggtcccttgtcgaagagaacagaatgcacatgagcaggtcgctttctattatactcaaaacgtgctctgggcctctgaatctcagatgctgtgggatcgttggcatgttgctagctctacagccctgcagcagttccattttgacaaacaaaattctggaggcagcattaaccgaaaaaaaaaaaccctcctcgaagtatacattggcgggcattacttttgtaccgtcccagccagacgacaagtgtacatgttgagatgtagtcgtaccttcaggcttcagtgtattgtacaatttttgtttacatcggtgaccctgatgttactcatttcattgatcaactgcaaatagttaatacaaatttggaagtactcatgttggtcgactactgttttattctctttttgttaggtaaaatgaaaaaacaaacctgagtaatgtcgcaactagacgattagccgtgttagaaactgtgcattatggcagattcgtcctgagtaataaactggcctttttgggacggagggagtagaacgtatacattatttccggtacttgttttcagtagtcaagttttatgtattttgatcaataatcaaagtaacaaatacatttaacgtctaaaagttatatcactatattcatatttcaatgctttagcaaaacattaattttatagtttgttgggaatatattcaagtttaccaagtgtcttactccctccttcccataatataagggattttgatttttttcttatactgtttgaccattcgttttattaaaagaatttggaattattatttatttcatttgtgacttactttattattcaaagtactttaagcacaatttttcgttttttatatttgcacaactttttttttgaataaaacgagtggtcaaacaatacaagcaaaaagtcaaaattcattatattacaggagggatggagggagtaatttttatttctgagatgaacggtgcctgagactgagtctcggttacccagtataattgtttctgtgaccgcagcggcagtgcacaagcctctcgagccaacgatcgcgacggcggagtgccaatcgatccgaatcacatccctttgcacccataagaaaatctcatcattctggcaaggctcgcatttgatcgacctacgtctaaggaatggccgtcaacgcacaaatcctattacccttcctcaccgttaatatcgtggcatggagcagtagcatagcagcaattcaaggcaacgaacaactgaacaagcgatgcgagtgtaaagcatgtacggccccgcgccgcgcgctaatgcgttacatgggtgcggcaaacgagccggcaatgatgtagccgggtgtgggcgacggattccgcagacgagcgcacgcaccgtcgtaccgaccgccccccggcatcccccctttcctcccccggcacggcacaggcaacgggctcagcctgggagcgcgggcgcggcgcagcgtttcacctggcccgcaaggttttgtcggtaagccgcgcgcgcgcgcgtggtcgctcgcgaccgaggcctcggctcggctgtggagcgcgcgaccgaggaggaggcggcgcaattaatggcgcagcgcgatgcccgatctgcggcgcggcgctggcagctggatgagatcaccgccaccgtgcgcccgcggcaacggaattaaacctgcgttgcgaccgggcgggccggcgccggctccacttgcagatttgcagccgcgatcgagctgcggttgccgtcgcgaggcgacgttggccgtgagtcgtgagcacgcatttatgggcctcctccccggtctgggttttcggaggttttgccgtttcggctagctattggcattctggcatactagtattaccgctgatagcagcctactatgctgccgctggttcgtcacgtacccctactccaccttcgatcgctgcggttacgagtggatttcacctttcgggtttctaagaaagaaagaggaagggatacgacgttgatacgcatgggtggtagcagtaaaatagcaagtgcagcggcctatggacttgccagaacggcagaactaccttggtgagtcacagtagtcagagtagcgagggtcgtattttactattttagtgcattctaagaggtggacttatagttttgagagcctcctaattctacactcgcccaacaaaacaaatgaacatgcccgctttaaaaaggctgcaatcaaactatattaaattcgatcaaatatgtttcatattggatctgtggtcaccgggtataaagagctctagagcacgtgttaaagggcgcaaggaaaaggatcactctggtttgtcgtacttagttagggaggttaaagatctactgattggaagggagtttaaactctgtaaggctaagcgtagtcaaaacagagttagtcattgtttagcagatagagctcggtgtgagcccggcctatccggtatttgggctaacaatagctgtaatttcattacatggttagtcttcgagaactccgtgattgagtaatatattctcttttcccaaaaaaaaaggctcattcacgaggatatgaacgtttatgttgtgttgtgtagtgatgtgagcgtgtgtgcgtcataccatgtaataaaaaaatagtcgaccaaatattaactcatattggatcggtggctaccaggaggggagctgcgacgaccatgtctatagtagtggttatttgttaatagaaaaaaaagaacaaaggttgaataaaacattgattacaagctccaaattgacttagtcgagaaaactgaaatgacctatattcataatatttgtactccttttatttcgaactacaaatcaaatattttaatttttatcatccttttcaataaactttatatagtttaacatcgtaagatttatatttttagattcaccgtaagaaatatttccataatatatagtttttatgttgttaagctatacagatttaaaacttcaatggtcaaatatacttatatttgaactagaataaacttagaatgataagtaattttaaatggagggagtatataaagttaggcacataatcagaatattgcatcgttgcaaataaaagtccagacataggatgatcacatatacatggcactgtagatggaccgcaattatgagtgccaccccttacatgaggtcaaatccgtatgcatgcaaatacgagcacgagaattgaagcactagtgaactgttatccatcaaccacaaccacgatttactgaacccacggttttacggttaccgtgaaaaccgtgcggttatcgtgaggtatatataattttaaaaactgataatgttaccgtatctaatagccacggtaaccacacaattttttaaacattgatcacagctctaccaccatgtgaaatttatttttacaagatatcacggtactaacacatacgcttacaatgtactcacactcacctttataaatggacacatgcacactttatccctattagcacctaaaaaaaactagcatgataatatattttaaagttgttgaagtcaccacgaatatctcattgtttgatgaatacatcacccaacattgaaaacaattagcagtaattaaatacctatgttaagtttaggactctaaagtgaagtcgcagtacaacacagtttaatggtcaaggttcatttcttttgttctctaaagtagtctagcttattttcaactatgcgcacgggagttgccagtcttttattttggccccatctgcactgaaaagttaatcttgatatgtcacctaagggcatcaccaatatactatgacaaattgatctatagatgggacccatataaatagattttactttttacatatagcaatctccacaatatatatatatatatatatatatatatatatatattgtggagattgctatatatatatatatagacaaacacacacaatatattattagaagaagagagaagagtagagatagataatataatttatttcatatgggtagtctatatgcatatggatatcttaatagatggctgaatagaatattgtattgcttatacactacttttacacatataccctaagatgagtcacgtcatacattaattcatcaccattggattgagaagtacaacaaatcataacagttccatccaattaaaaagagaggaagcagtaaaaaagaaaacttcctatgtcagaaaaagaatctaggattggatgcgatactccctccgtcctataatataagggattttgactttttatttacactttttgaccactcgtcttatttagaaaatttgtgcaaatataaaaaataaaaagttgtgtttaaagtactttggataataaagtaagtcacaaataaaataaataataatttcaaattttttaaataagacgaatggtcaaatagtgtaagcaaaaagtcaaaatcccttatattatgtgacggagggagtatgattcatagtcgttgattttttataggatgaagggagtacccagcatcaaaccataggcttcccagatgattccatacccttcccttcggtctgggggagagcagacaaaaacaaaaataggaactgctacatcattgcacacaaacagagttaggatgtgattgtcttttttgtattttagtcctaaagtaaattgtaatttagtagtacaaactaatcctgcaagtactgaaattttgtattggtacaaaatgtatgtctatatgattaatttatattttaccaaataacgaggcatatgctctgtgcaagttaggatgtgattgtctttttttattttagtcctaaagtaaattgtatcttacaaactaatcctgcaacaaagaggaatgtatgtctatatgattaatttatattttaacaaataatgaggcatatgctctgcgagttaggatgttattgtctttttttattctagtcctaaagtaaattgtaacttacaaactaaggttgtgtttagttcctgataaaagttgaaagtttagggaaagttgaaagtttggaaaaaaattgaaagtttatgtgtgtaggaaagttttggatgtgatgtgatgtgatggaaagttggaagttgggggtagttggaggtgaactaaacacggcctaagggcatgtacaatggttgtcaatagtggtctcttagcgttgctaattaggaatatttgttgacatggaggaaagagaaagaggagagacaaaacatcgttgttatgcatgacaacggcttaacaacgattcttagtcattataatatggaaatatggttgcatgaggataaaaatatggaaagaatattaacaaaaggaatattttttgagttaatgattagagcctttgtcgtctcaactattgtaaagacatggtctctaaataattttgcattgtttaagagatcatacccgtctctaccattgaacatgtcctaatcccacaacaaagaggatagttatggttgcgcaaatagggaaagcaaaaccatggtcaagatgaatagaaaatgacatttcacattacaagcgtattcaaaatactataaatgacacatttacgaatgtttggtagattatttatttttacaataataattaatcacaaattaagataaatatattatgatatagctatagttactgcaaaaatgcatgtttcacggatacttatttaagctaattaaacaacacataaacacatctaaatctaatagagaggaaggttataatcacgcgaatgggtgacttaataagctagtacgaacaatggtaaactctgcctttttcagaaggtaaccaaacagataggagtagtacgatgacttgtcttcacggtaaagatcaacttaatcaaactgaacttttgccaacttccattttacaacctcccagtactcttccattactcccctcaaaaaaaaaaagtactcttccattacattgctgttgcatatgccgtcacttgtcacgtctgccatgcacgaaacggatatactataaaaaaagcagactaacagagcatctagatactcctacgaggaaccgaacgaccgagttgtataatgcgaattgcgaaccgtgcacattgcctcccacggaaccccctcagaacccccaacttgcccaattccccctcgttttctcgtctcgtcacccacccaaacctaaaacgcacccgctcgacgtgccagccagctaacccaccctccccctcctcccttctcgttgacccgcgccttccctcccacggtcacacggtactcacctccacgggtccacgggtccacgcctcttccacctcgtcgttctcgttcaccgcccccgtcccgctacccccgcgtttttttcatatccattgccccgtgacacagccacgcccgtacgcagctacgtacgcacgcatcagccatcacaacccgccgcactcgtctcccgcgcgcgtcgtgctcgtagtctttaaaacttgagctcgaagcatcacaaagtcctaaccacacctaggactgggagagaagcgcgcgggcgcggcatcccatcggtcgcaaaacccacaccggctaccgtcgcgtggccctacttaaactccactttccctcctcctacctttgcgccatctgaaccacgccacgccgaatcgtccgtcgtcctagatagtgcttcgctagctgtgggtgtgcatgccatggcgcgcgcagtgcacgaccgcctcccgttcctagccacgcccccgccggcgccggcgaggggcaggaacccgccgctcgctgagatgctccgcctcgtcggcgctgccaccgtcgactccgacgccgccgccgccgccgcggatgaggaggccaacgcgctgtcgttgccactgccgcgcggtggtgttactcctcctccgcctggcgggcggaccatccagttcaggctggcgttcaccagcctcacctacagcgtccgcgcggcgcggcgggcgaggcccggcggcggcgatggcggcggcgggtttcgcctgcctctgcagaaccggtgcgaccgcgtcaccgcggcggcgcccgacgcgcactcgtcccgcgcgagggtgctgctggacggcatcaccggggaggcgagggagggcgagatcctggcggtgatgggggccagtggctccggcaagtccacgctcatcgacgcgctcgccaaccgcatctcccgcgacgcgctcaagggctccgtcacgctcaacggcgagccgctcaccggcaacgtcatcaagtccatctccgcctacgtcatgcaggacgatctgctgttccccatgctcaccgtcgccgagacgctctccttcgccgccgagttccgcctcccgcgcgcgctgcccgccgccaagaagcgcacgcgcgtgctggagctcatagaacagctcggcctccgcgcggcggcggacaccatcatcggcgacgagggccaccgtggagtctcgggaggcgagcgccggagggtctccatcggcaccgacatcatccatgaccccatcctcctgttcctcgacgagcccacgtcggggctcgactccacctcggcgttcatggtcgtgcaggtgctccgcaacatcgccgagagcggcagcattgtcatcacttccatccaccagccgagccagcgcatcctcggccttcttgaccgcctcatcctcctctccggtggacgcaccgtcttcagtggacctccctccgccatcccggcctacttcgccgagttcgggtacccggtgcccgacgacgagaaccgcgccgagttcgcgctcgacctgatccgcgagttcgagtcgttgccggcgggaaccggacagctcgtcagcttcaacaagacgtggcaggtcatgcacgcggcgaggcacaacccaaacgatgatccgtgggcgccaaccatgtcgctgaaggaggccatcagcgcgagcatctcgcgcgggaagctggtgtccggctcggacgtggccggcgaggcggcgtcgatgcacacctacgcgaacccgttctgggtggagatgaaggtgctgacgaagcggtcggcgatcaacacgcggcgcatgccggagctgttcctcatcaggctcggcgccgtggtgatcaccggcgcgatcctcgccaccgtgttctacaagctcgaccagtcgcccaagggcgcgcaggagcggctcggcttcttcgccttcgccatgtccaccatgttctacacctgcgccgacgcgctcccggtgttcctgcacgagcgctacatcttcctccgggagaccggctacggcgcgtaccgccgcacctcctacgtgctctccaacgccatcgtctccttcccgccgctcgtcgtgctctccctcgccttcgccttcaccacattcttcgccgtcggcctcgccggcggcgtgtccgggttcgccttctacaccctcgccatcctcgcctccttctgggccggcagcgggttcgtcacgttcctctccggcgtcataccgcacgtcatgatcggctacaccgtcgtcgtcgccatcctcgcctacttcctcctcttcagcggcttcttcatcaaccgggacaggataccggactactggatatggttccactacctctcactcgtcaagtacccgttcgagggcgtgctccagaacgagttcggccgcggcggcgagtgctacgtccgtggcacgcagatgttcgacaactcgccgctggccgtgctgccggacacggtgaagacgagggtgctggcgtccatcggcacggcgctcggcgtcaagatcggccccaacacctgcgtgatgaccgggcacaacgtgctccgggaggcggcggtgacgcagctcggcaagtgggagtgcctcctcgtcacggcggcgtggggcttcttcttccggctgctcttctacttcagcctcgtgctcggcagcaagaacaagaggaggtgatcgagccgtacggacgaggttgcacgcgcgcgcgcgcatttgcgcacgcgtttgaacgtccgggggcattaaacgcttggggagaaatagagagaaaatgatggcctagttaatttgaagctgtttaatttatgcaattgttaaggcggatatgatgtgatttcaatttggacccctttttgtttcctgtgatttgtagctaaataagtggcttatagtccactacacttttttttcttctttttctctttgtagtcgctgtgttaaagacttatatatgaaatgatgaagtgttttgatgatttcttgctttatatatagtcttgttgattggttctacttccatggcacatcatccgtaatgctctgtacgtgttaattgttccttgtgtcttggtgcaaaagggagaaacttcccctttttgttgacgttgaaacgaataaagcagaaattcctcgtcaaaactttatcaaccaaaaataaaggagtaaaatatgctgttcttgagcttgttacatttgttcctttgtgatctgatcttcttaatttagctcatgacttccaagcaactttcattgtctcggtgaaagtatgaaaaaactagtacgtcgtaccagtacatatcaaacttctgagtgtttagatatttatgtttctgtcaactgtcatatggtacattgacatagataaagttagataagaacagtgaaggggttggttatggttaggttaggtacatcacatccagagccaaagaggtcataccggtattggcgggtcttaataaatgactacatgatgagttaaaaaaactatactagcttacatgtgtgctctgatttgcttcttatgactattactcctttaaaaatcactgctttgcttgtgtaaagtaatcaacttgctagttctagaggagtttgacgacactattatattcgagaatttatcatagatgatggatgcactgatgtccatacatttcattgggtctttttcacagttcttaacggtgacatatatattacagcaaacctcaacgaaattttcaacttgacaagtttttctaggatacaaatttaaacatttgatgcagggtataaattactagtatgttcttgttgcactgcctttcttgtctgcaaaccaaaactaccctgctcctcatggcagccagcctctccgtaattgagttactggttagtggttatcacttaccatctccaactggtaatagcaccatgtacttgctgcttctcttccaggttaggacagaagaaaacagcaaagtggtcctggagcctggaccatggagttgaaaaaaatggatcatcctcgtcacgatatgcgagagggggccggttgttgggcaagcaagcaagcaagcggatttccaagggaagctaagcaagcaccagagcatatttccgggcatcacctgcaaggctgcaactggcagctgatggctatctgaaccgaggcgtttaggtcagatgatgatgagctgcaccgtaccaaacccggtgttcggagagagacagagatgccgatacggcaacacctgtattttggaaaaatcgcaggcttggcgtttggaaaatgctccgagttcgcagcatgcagcggtacgctgtactatattgtattcgtgcatacgatgggcgcctgggtcctcgttgtaggtcgccgatcgctcgccaaacgagcaccggaaaccgtcgcctgtcagcgtgacggctgcgtcagcagcgccggcacggttgccgcatgatgatagttaactcgtttattgtgagtcaacggtgcttgggacttggggttggggaagggggaggaatcaagtgctcagaatattcatcggttcagcttgagtagtagtactagtttcgagccactgactgtctattgctcgtggagatcaccaagagtcgagaggtttaggactttgggtgtgttcagttcacattaaaattgaaagtttggttgaaattgaaacgatgtgacggaaaagttagaagtttatgtgtgtaggaaagttttaatgtgatgaaaaaattgaaggtttgaagaaaaagtttggaactagccaaggccatgtagggtagcaattctacgatgatagtcatcatgatatcataagactctattgcttgtggaaatcaccgagtgtcaagagggttttggactttatagggtagcaattatacgatgatacttcttgataccataaaactgtctcatttgcttgtggaaatcactaagagtcaagagggttttggactttatagggtagcaattataggattcggatcagctgcagtctgcaacttaagcagtagtagtgcatgtcattggatggtccagattgcatgctgtatagtacatagtactgtagcacaatactgtagcacaaaatactgtagccattactactgtagcgttcgatctgaaccgttgatcgtaaaaatggatggctaaaattgtgtgcagttttatcttgcagttacaggtgtaagtgcacccgatctcaattcgcaattatacgatgatacttcatgataccataagactgtctctgttgcttgtggaaatcagcaagagtcgagagggttttggactttatagggtagcaattctacgacgatagtcatgataccataataggcggctcttcatcttgtgctttcactttcctgacgcaatttaaggggtagtcgtgtcgccatcgggtagttgcgcttggttcggccttattgggcttagaatgatagcttccaatgtcggaataagatcactttaacttccttaactagtgaccgaatttgatttgtgtccttcaatcgcaatatcaaatatctcgacccctcaactattagaaccagtgcaatttgactccctcggtatttttggaggatgatttcactgacgtggcgtctacatggcagtgttgacttagtatgtggtgttgacgtggcgcttaggtggcattagagttaaaaccataatatgggacccttttgtcatccacacacagaaaaattgtggacccactgacatatgggacccacatgtcatcctctcctcactccttcctcctcgctctctcccttctctctctgtctctttctctccccttagaatgcatcgccacctgccgccgaactgcgccgtgctgccgcccgccggtgccctctctttcacctcccgctgcatcgccgcttgccgccaagcgcacggcgaagggtaagaagtcgtgacggcgcggggcgctcatggcggtggaggacctgctggatgttgctgctcctgt

SEQ ID NO: 34828 - DNA, 5367 bp, Oryza sativa
ccatcgccgccgccgccaccactggtggatccttccttgtgctgctctcgcgggatacagcgccatcgacggagccaacatcctttggtcttaatcaaagatcgccgcttgctgcctgctagtgccctcttcacatacgaaacccccaaatccggtctctggcgattaccattgccgagctcgagccgtgacttgtcgtcgcaatccatcccctctctagcaggcggcagtagggaggcgctcagtggcaggcggcgatgcggcgggaggtggaggagagggcatcggcgggcggcagcacggcgccgctcagcggcaggcagcgatgcggtgtaaggggagaaaagagagagagagaagggagagagcgaggaggaggaaggagtgaggagaggatgacatgtgggtcccacatgtcagtggaccaacaattttttgtgtgtgtggatgacaaatgggtcccacattatgtttttaactctaatgccacctaagcgccacgtcaacgccacagaccaagtcaacactgccacttagacatcacgtcagcgaaaccgccctccaaaaccaccaagggagtcaaattgcaccagttttaatagttgagctgtcgagatatctggcattgcgattgaaggataagaatcagattcggtgactagttaagggagtcaaagtgatcttattcctccaatgtctggccatatttatagaagtccaatttgactcccttaatataggtaagtcgaatctattctatatcactcaatcgccaaacctggtataacgactccaattattaaaacttaaaagtagtaaataatgactcccaagataatattaatggtggttttccttgacatggtatctacatagcacgttgatctggttttcgtcctacgtgacactgcaacccacaaaaagtacaatttaattcacgtgggacccacaagttagtgtcctacttttttcctctcttctgttcgctccttcatatatgcgctagcgctacgccacatcgtccgtcgttttaggattgagcgtgtggctagcctgtggtgggcatcaacgcccacggtagggtggtcagggtggcgcctaccgtggcgatggagagggggattgggtgcttgggatttgatatgtagctaccacgtagaatgaaaaccatgttaacgtgtcacatagaagctgcatgaccgaaaaccaccataaatactatcgtaagagttgttttgcacccattttaatagttctgaaatcgttgtacctagttatacagcaagggatacggatcaaattcaacctatattaagggagttatattgaactttttccattcatatttcatatttcaggcccaatttaagtccaccccgatcaaagtttcactgtgaatacaattttagttgtctataaacaaccggtttgaaattgccagtcggaatttccccattgacacgtacttattagagcaagtttaatagtatagccaactactggcttcaaatcatctatagccaattgaatagccaattgatacaatagttgattactatactattaatacatggtatcaccagtcatatacacattgtgtcttgtagtccgtgctacagctggctatagatatgtagtccgctgatcttctctcacttcctttatctctttaaaatatgtttatagctggcttagccttctattgtacctgctcttagtattcatatggtccggatggagcacatccttcaaaaaaaaaagaaggaaattaacccagtcccggtgctcaaactcctccttggatcaattcttcagtatactcttcaagctgaatatcctcctcggccggactgaacatgcagaacatgaacaggtagaatgcgagggcggccgcctcatccaccgccacgctcgcccaacggtaaccggaacttgcgcccacgagcaacttcaggatgaacacggccatccacgtgtggtacaggtacaccgccaccgcgaggtagagctggcggaacagcgcgagcttgccgagcctccgcgccgccttgtcgtccgtgtcggcctccttccgtagcgcccggatcgccctgcccatcggcatcagcaccgcgacgcagcaggcgagctggactaggacgaaggcgtggccccacgtccaggccacgcctccgtcgccggacaaggtggtggcgatcgccatgtagacctggagcggaaccatcgccgtcaacacgttcagctcacgggcctgcacgaacggctccgggagcgaccaccctgcgccgatcagcgcgaccacggggaagagcatggcattcttgacaagacgcaacgccaagcacggcacgttccacccgcgcgccgtcccggcgacgacgctggtgtatcgcccgtcgtgggccgccgccgtgaggcagtgcagcatgagcgcggcgaggaggccggacatgacgtcgtgcacggggcgcgccgtggagcaaccgcgggcgagcgtgcggtgcagccacgcgatcaggaacacgccgtagcacacggcgaaggagtagatcatcgcgacggggtcctcgccgccgtccgggttggagtcggacagctcgacacggacgtccatggtgacgcgcgtccccgacccgcagttggcgaagtagaggctgtactctccggcgcgggtgatggggaacgatgaggaggggaaggagatgcgccgtagaggcggccatgggttgcagaaaggaaaaatggctgtaagacgtcaagctcactctcggcgatgctggtgttttacggagcagatttatgcgtcccgagtcccgacggccggccggcgggaggcacaaggcggaatggttttgttggattggacgaggcagacaggcaggcattgtattttggcgcgttttttctactgccggcgtgatttctcacagctgtcttgcactctgaatcaagaacagagcatctccttgtctgaatgcttaacatctcaacgcagagccattagcttgggacttcaggttgaagtatcaaaagcatcagagcactctcagaaagtctgagacaatttcctacttcaacctgatttagctgaaggtcttgacgggctcctgtacgagttccaaatctctttgtactattagcagcaaaatgtatgtgctcctgaatttccagttaaggcgttcgatcaattagtttatgcaaaaaatataaccgagttacattccaggaactgatgtgtagaattaagtttcttgcttgaataaaatctcctgcctcgttgtattgtatatctaagtgcatttcagttctcattttaagaatggcatatactttgtactccattcgtcccaaaataagtttatttttcacatattacacacataccctaatacaaaacctaaaaaactataataccctcattttatcaaatctcaatgcaattagtcccccctctttatctactaccaatacatttataccctactttaacaaactccgatgcaatggttactcaaaaatgaacttatttgcttgtgaagccttatcctcctgacttattaggaaatatggaaagaacgaaatcagcaggtgttcagacataaagagctgtcggcaacaagcctggtcgccaagatcaaatagaaggcaaagacttggagcttgaaaggagcaaagggccttcgagacctagtcccttagggtttgcggttttcccctttttgtaaatatatattccatatacgctgtacattttttatcctactctattcaatgagattggcatagttttgtgccggttcattaaaaaaattaacgtattttgggacaaataggataggctaaaaatgaacttattgtttatggggcagtgggagtagtttctatggccatgttagtcttatacagaagttcatttcagatagctcaccagatacaagatggcaatcctacgactacgatattatcatatcattggcatatgaacagtcaagatgaactgtgagcttatagcaatacagaatagcacgatagcccatatgatctgctgtttcgctggttcaagatgcattacattcatgcatcaagccatcaagattaatgaagcatgtcaactagatgctactctgggccttacaagtgattcacctactatgtttatttgctacccagtctgccagtcatgcataaagaacctaagcaaccagatgttgatacaccaataagcatatattgcatagttggtgtccccttctatagttctgtcactcattcctaataacccacctataaaatcatgaacctaggtatgaagtcatatctaccaatgttatcccgatagcaacaaaattctacagctcgtaaatgataaagaacagctgataagtacgaagaagcaaacctgagtattggcaaaatggcaacattgaataaatgcccctaatttgcaacacaagcagcccaattatctttggacttctcaacaacatttgatgctagaagaaagaagtgaaaagagtgaatatatccataacacatagataaatataggctaaatcctgcatctgtatagtatgaccgacatcaatggaggagaaattgaacaggtcaggctgtatttcccatcatgtatcctctcactggatcacaacactctagagctcaaactcctcctcccggagtgccagctctgcagcttcctcctcatcctcatcaagagcgaaatattggttcctctctgctggcctgaacatgtagaacatgaacaggtagaatgccacagtggccacctcctttgcggcaacactcacccatctgtacttgtagttggtgattgtcttcagagcatacacaatgatcctagtgaagtataggtatccaatcacaacaacatagaactggcggaaaagggtgagcttggcaagggttcgggccgccttgccgtctgtcttggatgactcccgcagcgaccgcatcgaccacacaaccgggaagagcacagcacagcagcaggcgacatcaacaaacaagaagatctggttccatgttacccatccctgcaagaatggaccagtctcaccgaccacagctgcagcaatgttagctgcaacctgcaatgggatcacaaccatgaggaccttcttctccttgtcctgaaggaagggcttcaggaatgaccaaccggtcccaatcagagcaatcacagcaaacaagatcacacccttcaccagctggaacaggtagaacatcacatcccacccgtgtggtgtccctgcgatgcggatgtagtgctggtcctcggccgcggagatacagtagagcatgcgcgccgcgagcaggccggacatgaggtggtggatgcggtgcgcc

SEQ ID NO: 34829 - DNA, 1971 bp, Oryza sativa
agagcggcttgacgtaggggctgaagagaacgcatcccgggttgggctcggggttggggttcagatccgtgggcggcggctgctcgtagatggcctcgaagagcgcctcgtcggagaggaggaagaacccgaactgatccggctccgccttggcgagcttcgaggaggtcctcgcgccggtgatggcgatggacacgaacccacggcgggagaacccgaacttctcgaagaggatggacgcgcgggagtcgtccttgaaggactcctgcttgatctccgccgccgcgggacggaggagcgctccggcgacggcgatgaggaggaggagggcgcgcgcggcggccgcggcggtggccatcgcggcgagatctgggggagatgggggagcaggtggaggaggtgcgcgaatttggccagacgggtcggaggcggtgactttcctggaggcttatggaggtaggcgtggatctcacgtccgttggatttgcatcgagattggtgccaggtgggtgggtgactttgaccgagggtactcttagcagggaagcaacgcgtcggtttcgcgtcggttggatcgttggattgtgattggacggtggatctgattagtcgcggctcgatcagtttaggcattttttttccacgttagtttaggcatgttttggacgcagtagcaaaatgttcgtgctttcactgggctcggcctagcataataataaaattccggcgaaatttaagacgaagaagataattctagattctagaaggtttaaacaggataagggatcgatggaaaagagggcgacggcatgccgggtcaagcacggtcatctccttcgacgtgttcgagaaggctaaagtcgccgtgcttcgtacagccgcggccgtgagattatgcgcctcaaattgacccgcaggaacgaaagggtgtttgtgttttaggatatgaagcagtgaagcactgctggaggcagagcgcgtattgacaatgacataccatttcggtctgttcggattggtgctatttttaaccgtaccattttttaataaaattataaaaaataatatctacatttagtttgttgtcaaactttgataaatacatgagaaatcataccaaaattttagtaatattaacaacttgccaaaattttaatattgctaaaattttataaggtttattttagctataatctgaacagactcttcaccctggtgtttttgacgtctagagaaattggtagtaacacactagtagcccatgacaatatgacataaagtactttcagtttggctattttccccattttcgttagcacgtttttaaactattaatcagagtgttttctgtaaaatctttttatagatgagttgttttttaaaaaaataagtttttcacggttaatcatatatgtagctaataattcactcccgggaactgactttagaacacacccagagcctaacaagccaggtttaacttttcaatttcgacgtaaaccattgctcaccgatttacccaagtccaatcgaaaacgagtaaaataccaccgattttcaatcaacaccataaaaaccagctataccgatcagttatcacaaaccaaaacctaatagtttcacgagagccaaccgattttcgtgaaattccatcgattttgtgagccttgcaaacaagcgtccgtgtgtctgggagaggcacaggctgaggcggtaaacacgcctgtgttttatcccctgccgctgcaccggtttgtgcaatgccttgaagacttgaacgcacaccacctttctcttgtgggtttggccggactaatcacgcgtttgacgtgagggcatgcgtcgcggcgggaggaatcggcagccggccgcgtgttaggagtagtagctagcgagcgtcgccggcgccgcgcagcgctggctaacaaggccggagctccgagatagttactagaaaaacatcccaagcgt

SEQ ID NO: 34830 - DNA, 497 bp, Oryza sativa
acgccaaagtaaaggtgtcgaatttcttggccattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattt

SEQ ID NO: 34831 - DNA, 60423 bp, Oryza sativa
gcagatttaacaaaatattcatgttcattttacctttttcaactcatttacatgaacaaaattggagccatgtaaaagcctatatatttactttgatacatatttttgctttaatagaatccgggatattttgccaaatattttgggagttaaattactactgctaagtgatgaatatgtctttataagcgtgtgcctcgtggtaggcaaacacactgtcttcaatatggtgcttctactgatatgcgttcgatagagaagttcatgtggcttcttgaggtgctctataaggaggaaggtgaccagtgaggagtagaagctgcagaatgtttccaggcgatgcatgtattgaaaaaatagcacctgtagaacttgcaggtgatatttgtatctatattttacttctaaacattgtgttttgaaatgttaaaatattgtagaactctattcatggtcaactttgggaagttattaacagtataataatattcatgagaacaatacaaatatctctatcgttattttattcctgaatcttaaatattaccttttggtttttgcattatcaattatcaccattgcgttagcacgggcatattactagtgttcgttaattctcccgtgatcgggagactttggaagcgctccatggcgtttggaaaggaacctccagcgctctcaccgccgtgcagaatcgccgaattttgttcatttttaatttttttaatatttacagaaatactataccggtgaaaatatttacagaaatagaccctgcaacccttcctgagggtggcaggatgatgcgtgtgagcaggcgctagaggccgctgagcgggcatgcgaattttgcatgcggcaaaaaatgcatttcacccccttgccgcccttacagaaggcggcaagggacctcagcgcaaaacgtgcacacaacgccgtgtgccacgtcaccttgcgactctccacttgggcgacaggtttattttttaaatatttttgccggtataatattttttaaatattttaaaaaataaaatctactactacttaaaaaataagaggtgcttccatcgtccgtcaaaaaaaccgggtgaaaaaaaaccgggcagaaaaaaccaagtttgtccgatcaaaaaaaccggacgaaaaaaaaagtccgatccaaaaaaaaagtgaaaaaaaaaccgggcgaaaaaaacacccgtccctggcaaaaaaacacccgatcccttaaaaagggaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcggggagcaaaaaaaaaaaaaaagaaaagtccgataaaaaaacctgggcggaaaaaaaccgggtggaaaaaaaacaaatttgtccgacaaaaaagaaagcaaaaaaaggaaaaaaatcgaaaccaattccgactacatcgacgcggtaaaaagagtttaaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaatgggcaaaaaaaaaatttgtccgataaaagaaaaggaaaaagctgaaaagaatctgactccatcgacgcggtaaaaaaaggcgaaaaaaaactttccgataaaaaaaaggaattatatgtgacgcggtaaaaaaaataaaaaaaccaggcgaaaaaaaagataaaagtccgataaaaaaacggggcgaaaaaaaaacaaatatgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccggacaaaaaaatatctgtccgatccaaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatgtaatctaatctaactataaaaagagaagtttctacagaatattaaaaaaggaaaaaatgcgcgagaaaataaaaacggtttaaaaaaacacgtgagggaaaaatgtcagaaaaaagcacaaaagaaaacgcgctagaaaataaaatttcgtagttctaattttctgattgttatcgacatggttatgcatgaaaaacgtatattatcattacgttttttcacccgttgcaacgcacgggcatatttgctagtgaaaaaaaaatccagaatcgcctctcgtgcaatgctcgagtgggccggccttctgccgtgacggcccgttttgttcggacgcccacacggcccaccgccgttcgggcccaaaactcccagcttcccaagtcgacggctacgcgcagtagcgctgtcgcagtttccgaacggctgtacgcgtcggaattctctgtagccctacagcaccgtggaagtctggggtcctcaatttcggcacacgttagtgtttagatcttttggatctaaacttctaaccttttttatcacatcaatctgtcatacacacataatttcagtcatatcgtatcaatttcaacctaaatttttaactttaaaagaaactaaacacagccctttgtttgttgggacttgggagagtcggcaccggcctgatccggtccggggctttctttcggggaaaggaggaaaagctgatcatggaagaatgtgttgatgactggagcgtgattagtcaggtcaaaataggtcgtagatgttgccagatgccaaccgcatcaccgttgctacttgttgcattttgttcggcgatgatcccctgacacatagtattttgtagcataacatgattaccgttccatgatactccctctgttttagattataatttgttttaagtttggttaaagttaaactactttaataagtttatagataaatatagtaatacttacaataccaacttagcttcattaaaccaatattgaatatgttttcataataaaattattttaggttgaatatgttataactttttttctacaaacttgattaaactgaaagcaaattgactttaatcaaaattgaaacgacttataatataaaatggagggagcatcgaccctattgtttcgctgaatatttgcaaacgaaaactaatttgtgaagaaaacttttatatacatgttcttaacgatctaaaaagcaaaggctgaaaaatgaactttgataaaaaaaattgaaaattcaaaatttggctggtaagtataaacatgagcaaaaagatagggctgcatatgtcagttatcttaaacttttatgaaaggatgttgttagttcttttggctgggtggtggccattagggcaaggatgtgtcatggtttcggagtggaggatttttttaagtaacttttaggagtttaataagttcgtgtgaaaattttgtaaattctttcgatccaaagtagcctatgagagataagtgttccaacactaattctcagcttgcattttatgtttattaccggcttcccttttgcctttaacttgtcccccatcgtcctgatttctcctcgtctgaaacaactgggatgtatctatacggtggttctcttttatgctatatcatgataaaatccacatattgaagtgtgcgacaaagtttaaaggtgcacttgcgtagttgctaaacaatacgtttcatgttgctaaataatacatttcacgcaaaaaatttctatatataagttactttaaaatattaaataaatatatttttaaaatttaaaataattaaaaccaattaatcatgtgctaataattttttcgtttcatgtgcccacacataattagggctgtcaacgagccgagctcgagcaagctcatatgcttaggctcgagcttgacacagactcgagccggctcgagtcaagcctgttctaacattcgagtttcatggtaggcttgagttcggctcgaccgagcctcgagcttgcctgttgttagcttcgcaagtcacggggaagaaaaatgaaggacataagctttcgttgggagggatgagtgatggagaaagatgaaggcatttagtgtgccatgcagcattttgctgtttgatgtgagaggagcggccgctagctattctcctgtgggaaagcttggaggaaaatttggatgagacaactaagggcctgtttagttctttagtcagtgaaataaaaatttttgggtgtcacatcagatgtttgatcaaatatcggaaagggtttttggacacgaatgaaaaaactaatttcataacttgcctggaaactgcgagacaaaacttttgagtctaattaagccgtcattagcacatgtgggttactgtagtacttatggctaatcattgactaatcaggctcaaaagattcgtctcgcaatttacatacaaactgtgcaattagtttttctttttatctatatttaatgctccatatatgtgtccgaaaatttgatgtgatgttttcacgaaaagtttttgggaactaaacaagccctaacagattagcataagggatggcaaattgtacgtaagcccagcagcaaaagctcgtcgagctatttgagctcggctcgagaagcttgcgagcttcgtgataggctcgagctcagtttaataataaaacgagccgagcttgaatcaagcctaaagcgagccgaactcgagtagcttgcgagtctcgagcttttttgacagctctacacacaatttttatctaccgctatctcaaacccagcttgccaattgttttgactggttacttcataaaatcatatattcatgaaaagcttaagccagcatggaacctccacatagaaagcatggtaaacagctaataggcatgatatatttagctttccttcaaaattaaataacctttacctaaaaagatgctagcatggaacaatcataaatatttttttctgagagggaacaatactatttctgaagtcaacaaaagcaacaataggagtatcagaatttcagcatcatgggttttatttagttaacaaaacaagagtttcttgtgaggacaaaatgggaaagataacaacactacatagcccaacagtgacaaaatgggatggacaacagtggcacagttggaagttcaaaccgtttcccaccaactgcggttaggaaaaagggtgtgtttagttgattggctaatttttttttaagtatatgaacacatattaaacgtagattaataataaaataaattatagattccgcctgtaaactgcgggacgaatttattaaatctaattaatttgtcattagcaaatgtttattgtagcatcacattgttaaatcatggtgtaattaggttcaaaaggttcgtctcgcaatttacatataaactgtgcaattaatttttcgttcacatttaatgttccatacatgtgtccaaatattcgatgtgatgtttttggaaaaaaaaaatctaaacacggcaagggtccgacggaaatttgcacgagtatttttcaaaacaacccaacacagccgaaatattcacacataattcgaagacgtgtttaactagcaaagggaactggactgtaaacaattactcattaattcgagggacttgtacgcaaaaaagctaaaaaattgaactaaccatagttagctaacctcgccttccacagaacaaaccagggttgcgcggacgcgaacaccaccagaccagaccacctcctcctcgagcttcccctcctccccctctttccaaatttccccaatctcgcgtcgcttcttccccgaattccccaacctcgcatcccgattcctcccgcggatcgtgcggcgacctcgcccaaaatcccccgccggattggcctcgccgatggcttaattggcgatttcgactctgcaatggaggcgcagtggctcgccgagtacccgcaccagggcgccgacaagcggccgcggaagcggccccgcctcgcctgggatgtcgcgcccccgctgttccagccccccaaggtataatccatgcgctatgtgctgcgtcgatccggtctctctcgggcgtgtgggttgcggtggtagtttttggctagatctagtcgtggtttcgctagatttagagcggggcggttcgatctgggtgtgcatatttgggaattggggatatgctgcgctgttgcagaggatcatcgatgtgatattgtgaatttgtgggataggatcggagccagttgctgatcgaaagaacaatatggagaaaaggggcaatctcacgacctccatgtgcctaagtgctgccaaatttatggaacttgctaataaagtttgatattctgtcattatttttgctaatcgatattgttctcttttggtgggacacaaccgttacttgaggtatttgtccattcagtgctgtcaaacatatgggttacccggtgtacttctctatttaggactatcaaacaaaacagatagataactttaatggtgctaagtggggtgtaaatatcattgaactttgaaaacacaggagatcagtatgcagttgtttctattcatttagaatttatatgcttgttaccaattttgatgtatatggttaatagtaatttacgtggctaattatttttgtaggcaattcctatgctatattgcgggcaggaactaatcaatggaaattttgcgaccgcttttctgccaccgccaccaatctattatacaggaccaccacgcaatctttcgcctccctggaggccagatgacaaggatggacactatgttttcgcagttggggagaaccttacaccaagatgtatttttccacaactcagtattatttattgcatagggttattgtttttgtttgcatttctgatcgcttgcttggttagactgttaaactgtttttcttctggagtaagtttatcttgccacaattgttgaaatactggacacagaactttcattttgtttgatatttgggacttatgtagctgtttaatgattgtcagttactggttaaatgcaacaccgtgtttcaaccacctaattatgggttgaatggcatttcaagcctcattaaataaccattcattatttacagtcaattaaatcagggtaaaatgtttgcatacctttgttcgttgcccaaataacttctgacattgtgtaatggtcgtgcattcttgatatctattgccgttgtgttgtcaactgccctgcatctctaccagctgtactgaacttatgttttgttggcgatgcttcttttggttgagataattctgaggtttaacctttgttcttgtctatggctttgcagatagaatacttagcaagatgggtgaaggtcagtgtgctcctccttttctaaatttcaacatttcattttataaggaatagttcaggataaatgcttatgctgcaaaagttttgccctttgtacatgttaccaacaactacctttcttaatttgtgttgcagggacttttggacaagtcttagagtgctgggacttggaacaccaagagacagtggctatcaaaattgtgcgctcccttcagaaatatcgagaggctgctatgattgaaattgatgtgcttcagaggcttgggaagcatgattttactggtagccggtaagcaaactactttcgtcattgctaagtcttgactctttattgagttgatggatttgcatgaatggttctatgcctgcagctgtgtgcaaatacggaattggtttgactatcgtaatcatatatgtatagtaagtacatgtgcatcaagaaggcttcctttcatgttttggatggtcagaatttaatattgaattactaactttgtcaggtatttgagaggctcggaccaagcttatatgacttcctccgaaagaatagttatcgtgcatttccgatcgaccttgttcgggaatttgccagacaaatattagagtctgttgcatgtgggtattcagttaatttctgctgtttgttggttatgcaaattaacgttttgttttatcttgcccctaacagtattattctaatgtttattttattgtaatatttgcagttatgcatgacctgcgacttattcacacagatctgaaacctgagaacattctccttgtttcatcagaatctatccgggtgcctgattataaggtggcttcaatactaaattttgtcattcgaactataatcttttgcaattttatccgttaacacttgtggttgccattacattatgtcaattagtacgagcatacatttattttttactgatttttatattgttttccataaaggttacaatacggcccccaaaggatggttccttttttaagaatcttccaaaatctagtgctatcaagctgattgattttggaagtacaacattcgaacaccaagaccacaattatgtggtatcaacaaggcattatcgtgcccctgaagttatccttggtattaacatcatatccttttccatttcccccctataaagtggaacacataattatattactgtgttttgtttatggtacctttgtttagttatttcctttctctgttttcatttgcaggtcttgggtggaattattcatgtgatttgtggagtgtgggatgcattttagttgaactctgctcggttagttcacactatctatacctgagtagttccttgattttctctatagcccagtgccggctccgcgaatttgcagtgcttcctattgatatgttgcctctttgattttctctactagggtgaagctctctttcaaacacatgaaaatttggagcatttggctatgatggagagagttctaggtccccttccaaaacatatgattgtcagagctgagtatgtatacaaggtcttcgttatagtttcatgatttattataatctaagataagatggtttacatctaggcttaggttgctgctgagtttcatctgaagttctttcaaattatcaatcacttgcatgtacttgttacttcttttttacagtcgccgtgctgaaaagtatttcagacgtggattaaggttggactggccagagggggctgcctcacgggaaagcctgaaggcagtctggaaattgcctcgtctgcaggtactttgttatctgatgtagtcagtatgttcctcttagcattttcccctctttgccaagtgtcgctcataggtggtatcctcttgacactcgaattgtgctaactcatgcagaatctggtaatgcaacatgttgatcattctgctggagatcttatagatcttcttcaaggccttcttcggtatgatcctgatgcgcgcctaaaggcacgtgaagctcttcaacacccgttctttacaagatgccacagaagatgtggttactgagactatactgagattaaaatgctcaatgctgtatttcttcattttgatgtgtaagaaccacccaaaaaaaaagtgaagatgttccacaaaaatgaaatgtgctaactcgcattctgttcgatgatgtgcaaggtaactgttgtatatagacagagttctacgactgccgatttattttaactgggagatatttttcaattcttacaagttcctgtctttaaacctcacattttacttcatactaatttttgcaagactgcccagtactagcaggtagcatgcagaaatctcaacttggtggagtcaattgaggatagagggaatgccagtggctctcatgaaagattggtacactgtatttgatggtgagctggtgatataaggtgagcattgcattctgaccatgtcctgtttggtgtggagataggcttatcaatataattttatgtgcatttaggatctcagtatttctcgtgaaaattggtgatggcctgttcacttgaccttcatgtccattctattttaccttgaaatgcatgattagccctggaaactaaccggacgttaaagttacaccctggtgagttttgcttgtgactggtcatatttcttaaaacaagtctcgggtgttggataaaagtttggtaattaactgagcttttgagtctgacacttggcttggaaaggtttgcgacaactttgaaattgtggacagtagtctaaatctcaagatgtgctcaactttgaaatattgtcaactgtgactaaagtccagaatccttgatagcagctgatatatatctaatttacctgaatataccgtaaagtactggctttaaaatcttactggttcccatattactagcagccaccaagctcttggattggagatgtttgttagataaatccttgtgggttttgagcttaaaactatactcaacctgtgtctatcgtttgcgccaggtgagcttgttcttaatatcttacaaaagtcatttcctttatcaaactttagtgatgtgatgattgtattcatctattgcttgtttcttctttctataaaggctcattactcaaaagttatcttctggcaaaaaaaaagactgttatttggtctgataacatcttattggctgctacaatatcttctttgacaaactgagtatttgaaatctgctggaaaatgttttacaactatatttaagcaaggacgagtattttttttaatttatcgttttcatttttgcaattgagtgaaactaccgttgaaggtaatttatcaacatcgagtgtcaacactagtgaaacaaaattagtccggcttgttttgttgattaaagatgaaatcattctataggcaagatagactaaccccagaatgctggtagtttaggctcgttttggacatgcgaaagattttactcatcgaaggtggatttggagagctgctgcttcctactgtgaatggatgagcagctggtaaatgttttactcattgggctacgtgacgtcagcccaaagatcgcctccaaagctgtagcagcgggtcaattgtacaagagcctgtaactctgtaaggtatgatatactaacccttcggaacgggcgccaacgcttccatcgtcatgttacatgagatcgcgttcgaagacggcgagcagcaggtttgatcacaggtttcgaacctggcattctcgtatagtcgtatttgcttcgatcatcatatgttacagagatcgcgtttgtttgaagacggcgagcagcggttttgatcacaggtttcgaaccaacaaccctgtactaatatatactactgcatgtgttctttcagcgaggtaggttcttttttctcttgttgaccgatttattgacgtgactcccattctcccaccaaacccgagaccctcaattttttgtttcttatgatcttcaattatttggttgcctccgtgtccctgatgagtccctttctccctgagctcccccgtcaatatgtggaatatactaaatcgtgatgaacgttattcgccaggttcctgcctttccattcggagggttcacgtctcccgcgacgaatgagccaggatcattacaccggcaaacgtgcacattccgacgaagagacgtttatccatcggtagcaaggcgctgctccggctgcctggttgctgctgcttgtagacggtcgtgggccaagcagggacaacgactcctcctgtggattacaggattgtggtagctcatgcaccccggtggcgataagaccgtgctcgcgcggtgaaaaaaacggcctgatcggcacggccaggacgactccggctgctcccgcccacttatcccagcggcgaggcgaggcagcgtcatgcgatgatgcgatctgctttcccgtcccaaccgtgtggctctctgttgcatcattcgctctgccactgcctccccatgcgtacgtggctctctggtgccaggtgcgtgcgtcgtttgtgtggaagaaacacgaggacgatatggtccacttcgcttccagtttcgacatctttttgttggaagtacacgcacctagccgctatccccgggagacgaaagctacggcgatctcgacgcgggaggtgactccgaccacaccgcgcgcttgtttcacgtttgcaagtgggcgcacgcgccgccccgatcagtcataactagcgactctcttcttgaccccaaatgcacttgagctctatagttgtttttctcgaaagttcatcttaaccgagtaatcatgttctcctacataggctcgcaccagccgtgtcatcagctatcaagccaggagccccgtccacgtttacaactgttcgtcgcttcatcagtgcaacttggcaagacagcaaaatcagtgagaggggttgctgtgactgtgagagggattaaatggatctggtaaaggatggcaaataagtagttaaaatcccccgcaatcagcatcggccattttcctgatatgtgtacgggggacagagagaggcaatcaggcgaatgcgtttttaaaccggagaagggggccacatttcctactgcgctgaaccggatcctctcggtatcacctcgcgccacgcaaccgcggggatccgtatcctctcaaattgtgcaccctccacctgtccgtcctcctccgtaggccaagtgcaccgccgtccttgtcaaaccaaagaccgcggcgatcgactatgtacgtggaaaacaattttaatcacttatatgtatattgtatgtcataaatagttataaaagaatttatttaaaaaatcaaaataaattgacatataatatgtcactccaccgatatacaagtttaaactcgactctataagttatgaaagcataaaaaattaagctctaattaattaatcttttgtagaagttaaattttacaagtttaaactcgactctataagttatgaaaagttatgaaagcataaagaattaagctttaattaataaattctcatagatgttaaatttaaactcgtatgtatatcgaatgatatatttcatatcaattgatttttattttaaaaaaatgtatataataatttaattgacatgtgtaataaacgggctcgacagccaccgagacatggagtgattataatcaatctcccgcggtgtatgggctcggcgcacgcggcctaaccctccccttcctttcattccctccccccgccgccctcttgaccctcctctttaatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcctgctctccgccgtcgaggccggttccttcggcggcggtggcgacggtggcggcgcgggcgcagcggcggagaagtcgtggcgcctcaacttcgacggcttccgaccgccggaggtgcagcaggagaggcggccgccccgcgggctccaccaccactgcctcggcgtcctatgtacgatctctctccaactcgccgtcgcgcgcttgctacccttgtaccgtgtgatgtttatggtcttatggatatattgttgtgttcgtatgcttggttgcttgatctaggctttcattcgtttgccttttctcgtgtgttggcaacatggttcatttgtttcggtagttgccttttgcaatagatatctactaaagtaacttatttttatctgctttctataaaagcagttccgtttaggcctttataatataaaaaggcagtaactccttttatttttcgtttcagcaactagcaagagctcagctgtgctagtatagatggggattggattaggatgttgacggtagtggtaggctagattcttcgtgtgcaacctttggcagataagaataggaatggggaatgttatattggtggaatgaggaatttgttgtttctagctttctgatattgcctagttgcctatactatcgtgctcatctggggcagggcaggacggtcctcacgtgagctgctctgttcttggagtgcacgtgaacagagttctaagaaaacttttttttttatcagcgggggtggttagcactgagccgagttgtaaagactggggcactgggtgtgggtgactgacagcgtgagaagggcaccaggtgtcttagcgttcatgtattgtcacaattattttacccttttatgcaattttagaggttttgttctggttaacaaagttgcattgggcacaaaaagttgaattaataacccaatcatgtcatttggccgcactcaacatttggggtttggatatctagtagtcgtttctctcccgtattgtcaatcactgctttcccatggctatagaagtagggagtccttgtgggcttaaagtcgtggtctattggtggttgaattcaaggccccacaatcctagtactagtagtactatttaaatcagaattgacatttttatcctgtacatttcaatagctgtagcattttattcagtggttctacatgtgatataatcaatagatgaaatataattaattagatatcagagttatcaggttcactgagaagtggtataattcagtagaacatgtgaagcatacatgcctgcttgctccactaatgtcactatctttcttcatgctggacataattttctgtgattgatgtacgattctatcttcagctcaaggtcctgaggacgtagttgctgaatactaccaacagcaagtggaaatgctagagggctttaatgaaatggatacacttactgatcgtggttttcttccaggaatgtccaaggtatgtttgataagcttttctgttgtaacagtagggaagacaaattgtttaacaactgcattgcaacactgaacataaatttatttgcctgtaggaagagcgtgagaaggttgctaggagtgagactttagccatccggctatcgaacatagcaaacatggttctttttgctgcgaaagtgtatgcttctgtgagaagtggttcacttgctattattgcttcgactttggattctcttcttgacttgttgtcaggatttatcttgtggtttactgccttctctatgcaaacaccaaatccctacagataccctattggtaaaaagcgtatgcagccactggtgagtcctatcacaagattaccttcatgtttgccatgcttattcttcttactgtaatttatgcaattgattccaagggactcaactctcggctattcatgatgcatagccagttactccctgtgatgttcttttttccgcaaaatgaaaagaaaaagtggaaatgctccaggaatgaaaagaaactaaactattgcaaacattcctggcagatggaccatagtaacatgcggaattttgtgttttgaggattttcatagttactagaaatcacgttcccaatttcccccagatatctcttgctcttaggtcaatgctactgtatcaatatctttgctactccggcagcagacaatttatgcatggaaatatttatgataagtccttcagtctaatttcactaaatgatcgagtttatcgcttctcttttcacttagtattatcagtcatacacttttaagttccaaatttcaatatgttgactgttccatcacaatatcttcttcagggaatacttgtctttgcctctgttatggcgacacttggccttcagatcatcctagaatcagtacgctcgttgttgtctgatgtaagtctgctgatgttttgttggccttgaactcctactctcattttgcttttgaccagaaactttgcctgaggatttcttttctagaacgataagtgtctttgatgtttgttggctttgaaattctgttgtagcttgccatatacctttctgattgctgaacttattgtcttgttctccagggggatgagttcagcttgacaaaagagcaagaaaagtgggttgtggacatcatgcttgcagtgacattagtgaaacttgcccttgttttatattgccggacattcacaaatgaaatagtgaaggcttatgcacaggatcatttttttgatgtcatcacaaatatgattggtcttgttgctgcactactagcgacttatatcgaaggttggatcgacccagttggtgcaatcatcgtaagtaccaaaaagttttctcctgttccattgcagtagtgtaaaactagagttcaagtaaatgctatatttgatctaatcgttaatttggagctaggcacatcatcctgattgggaattgactgggaaaagtaactagtttctgccaattttccatgtatcatgatatattctttcaaaaaaggaaaacataccatgatgaaaagatcagctatgactttattgtaaccagagatgcaaatcctggcagtaccagttactgccatttatccacgagctggtttgttcgtactggccagaacaacttaaattttaatttggaatacacattttgtacaaccatgcatagtcatattcatatgttttatgaacaactacacattagctatatcaaaagtttgaatccaaagttttgaactaaaaaaccggctcgatttgttatggatgttacaggtttttgaattagtgtttgattttgctcttttgtccggtaaaaaccagtaactggcagttaccggtttcttaaagggaccaatatttttttttccttcaaaactggtgtccataaccttgacagtgacttggtttaaaagagagaatatttctagtctgcctgactaaattcctctactgaaagtctgatgaaatagcttccagtggtttccatcgtcctgggtgtgtagtcctttgcaacgtccaaacgtttcaaacatgagaattactcaagaatcttgtattccaaacgtttccttaggtttttgttaagaaaaacacgctgtatttcagagactactttctgttttctcgtttgcagctagcaatctacacgatcagaacatggtcgatgacggtgctcgagaacgtccactccctggtcgggcagtcagcctcgccggaataccttcagaagctgacctacctatgctggaaccaccacaaggccgtgaggcacatagacacggtgcgggcgtacacgtttggctcccattacttcgtcgaggtggacatcgtgctgccgtcaagcatgccgctgcaagaggcgcacgacatcggcgaggccctgcaggagaaactggaacgcctgcctgagatcgagcgagcgttcgtgcacctcgactacgagttcacccatcggcccgagcacgctctgtcccatgaaaaatagccagacgcaggttgcaagttcgcaaccactggtattaagtttagcagcagcaattagtttcagaatttctggtgctcgtcaggaaacctgcgggtgtatgagattttaattctgtatactggattggcgggtgtgacagtgccaaagccgtagattgtgatttgtaactacttgttgtagactataggattcttgactgttaaatccgtcatctcgatcatctcgtgtagtacaatttatactcaaagtctagagagacatatgcctggtaattacaggctcacagccactttacattaatatacggtcttctgctccttcggctacgaatcatgagatctgtttactcggtctatatatatgctactctactgtagaatccattaatctgcacgcatgtgtgcttgtgcgagtgtggtgtttgtttgtttgtttgttctactgcttagcaatcggttgattatttcagtttccatgcatggatgcaagttaggcgggagtaacatgcatatgcataaatacatttatcacacgtatcatacttgctagtactctagaagaatgagcagttcattactccactcccgaactatgcaagcagatcataacaccagcattaatgatgctactctgttctgcttataaatggaacgagaggggaattacttgatctcatattgttgattttgttggattcgatcgagatggcagggtgccgtggccacggattcggacgaggccttgcagtggccgtggcggcaacagtgctgctgctgctgccgctgccaagcatctcctccctgcagctgcaggccgtagcttcgtcttctgctgctccggcaacgacggccacggccacggcgacggacaagagtaagctgccgttcatgcccgtcccgacggaaccattcccaccttcgccgcctcacggccaccgcctcccggttgtgccgccgcctaagcccaagtcggcgaacagggaggcagcagcagcagccgccgccttgacatctactccttgatctactccgatatcgcccttatatatgttcatatatatcatcgattgtctctttctccttgtaccaataaatcaataatatcgcgtttactgtaataaatctctctaatccgtagtggacttattcttgatcattaacgcacttatcttgcagcaaatatcgttgaagacacgcatttccgcaagaacagtaggaaaaacgtaagcacgtacgctgggccggaatgaatagatggccagtttcttacatcagatggcctggccttaggcccttagcccagtactcctacctaagtgttgcattaaaaagcctgtatagtcctactactttttttaattgaaaagaggggggggggggggggggcaatctatcattaatcggattgttcactttcagggtcgaatgcatctgtgcatggttccgccacagatctttaaaccgtgcatggttgaagagcgccgtaaagataaacggatttgttataaaactatcgccagaattttttttacagaaactttcggggtgggtcatcagatgagtgttaagatttgtgctagggcatggataaaagaatttcacaccacatgcgtgaagtgggaatagacctagggatctcatggagatggaagcctactagtcacctaccttttcatgtttgtttcataacgagttacatataattacattgcagttacacctcccttcaactgacgcattatgtcgaggggaggcatagttaaacctgagataatacagtgtggtaagaaataataacggtgtgataaatggcatgagtgcatgacaatagctacagagcatacgatgatgcatgtctagccccaaaacgattaattatgcttttttttaggacacggttaattatgcttgggcggtatataagttgcctagggcacactgggcaaaaggttgatcacgattgctatacacaagaacacatagaagcttaagtagctccagacttatttgcacaagcacttgaccacttgtaaactatgatatggattggaatcctaacaaccaggttaaaacactcacatcattagtccgtacgctgatgggctgatagatcagtcctagtggaaataaggtctatttggaagcctaacattatgacaggaagcagctgatgagaattttgaaaaactatgatttccgatttgtatttgggttcactttcatgattctacaactacaaatttttagaatctagattaaaatctggatattttttcttggagagctgtagattttaggagaagcctgctaagctcccaaacagggtcttaatcaagcagaaaatgttgcaaatgtacggagtactcctaccttaggtcctttttagtactacatcgatccatctcaaaatatagctatttctagcacaatatcttgtcccaaaataaagctattttttcgtctacctcctcctctcaaccaatcacaatcattatctttcatttactttatttctccaaccatacccatccactttctttatactcgtgtcaacctaaaaaatacttactcccttcgtcccctaatataagggattttgatattttgcttgcactgtttgaccattcgtcttatttaaaaatttttggaattattatttttttggcttactttattatccaatgtattttaagcataacttttcgttttctatatttgtagagcataacttttcgttttctatatttatacaatttttttaataaaacgagtggtcaaatagtacaaacaaaatatcaaaatctcttatattatgggacagagggagtacattttaaaacagaggaaatacgtataagcatgtgaagcacgcacgtcaaaacgtcgcgcgcggccgacagatcgaccaatcgacctaccttcctaccgatacgcggtagggcctgacaaaacaaacaccacagcgcgtacgtacgcatacgcgtacgtgtggtgcaccgcagccgacggcactagcacgcaacagtacgtacgtagacttgcacgtctacaccaaaccggcggccaccaatcgatcaccgcgcgcgcgcacgtacgtccacacacgcgcgctatacacgacctagctactgctagcttgcgctgcttcgccactctctcgacgcacgtgtgtcctcgaccccatggcgactccacgcgcggtccagtagctatagtagtactactagctactccttctatctcctaaaataaagaattttaatattttacttgtactgttttatcattcattttattttaaaatttttagaattattatttattttatttgtgacttactttattatccaaagtactttaagacgagtaatcaaacagtgctagcaaaatgacaaaatctcttatattatgagacggagggagtagtattaagagcaaatttaatagtatacccatctactgactttaaatcatctatagtcaattcatacaatagttacttataaaaatatgctacataattaatacatgatcctacctgtcatacacacatatattttgaagtccgtactatagtaattctgtagcccgctgtttttctctatactattttatctttgtcgaaatatgtttatagttgttttatagtctgctactaatgtacctgcgtatacctgtgttgtgtggccaacgcggcacgcgtctcgctctcgctctcgctccccctcggtacaactcccaagtggctgacgacgatcgctcgcccgtgcgtgtcgcgctcgcggtcgatcgagtacgtacgccaataataatgcgcgcggtgtgtacgatccggaggagagaaaaaaaacccagccagatcgcctgtactctgacgacgcgcacaatttcaccttacgtttgcatcaaggcctttgggagaagcacaactcctcgtccaggaaattatacatacatggactgcatcttttacctacaatatatataaaccatgccaaaatttattataaaaatatatttaattattaatttaataaaactaatttggtattatatttgtctataaacttagtcaaacttgaagcagtttaactttaaccaaaatcaaaaacatattataacctgaaacggagggagtagtaccaaattgatctttgtgtaccttgataactcccttaatttttgaacacacgtttaactatttcttttatttagaaaattttgataattattacttactttattgtaatttattttatcatttaaaaatacttaagcatgatatatcctacgtatatgtataaatattttgaataagatgaatgtgaaataaataacggcgtcatttacttaaaaaatcgaccgagagagatccatcgatctttttactgacagcaacaaggtagctaggcactcgaatgtgaatatatgtgtacacacgtacgtcatcttccggatgcatgcaacaccaccggctgaactagacgatggctagctgcgaatccgaatcttaattattttcggggcaaaacgtacataataacggctacattactactatacgctatgtactatgaacagctagatgtaagacagtacgaggtactacgacttgatggatatcctactgtacaagtagccccctctctcgtgggtgccatgcatgcacctagtcgtcgtctccgcctgatctcttggaaccagcagcttcctgtgaagaactactgctcttgctctccgctggttcctctccttggcccttcttgtacgtggcgaagaactcgctgttctccttctcaagctccttccacactgctcacagacagcataatcaagaaaaaatattgaaaaattctcgacgaatgagcagatatcgtcatatagaatacggagtattcatcttatattcgtatttcaaggggaaaaaaagagacatgggagtttttctccgatggccaaacaaattaactaaacgcatgcagcgtgcacaatgtaatgcattaattgatgaaagccacagcttctgcatgtgcatatgcaccgcacagttgcaatgcaagtaataaactcctaggtaaatagtacttaaaaagaaaggtactaaacatgtttagccatttatgcaaatgtggcgtgaagctataaatagcgaattaccggtggaggtgatgacgggcttgatgttggcgtgcttctccagcgtctccatgcattcctccttgttcatgttgtagcagatgcacttctcgatcagatgctgcacctgcgtgcaaattaatcagcatacatctatacattcatcagaatgaggcatacatgcatctcgcaggccacaatccagatcaagctagcagaccacgtacgccgtactaatagagacgccacaatagacgtaccaatctgatgtacgaagccggcgacgagtcgccgccgccgccgccgccgccgtcgtccatggccgcacaccacgcaccactcaccggtcgatcgatcagctcgatcaacgaccaaactctcggatcgattgaggcttgcctactcggaagatttataagcgagagagccttgcagctcgctaatggcggatcgaccggtcgacgacggcgagtagctagcgatcgatcgatggatcgatggagtgatcgaccaacgagagcgtgacaagcagcggggtggaggaggtagaaatagggggggatcgacgatcgagtggggacatgtcagcatgtggggcttgctcacgtgggtgccgcctccccattcgcggagaggcggtggcgggggattttgccgggcccacccgccgcactcaccttacccagtcccctgcttttctatgtggcctgattttgatctcgctccctgacggtcagttcgcgaggtaattaattatgcacgctcgttaatttcaggccgtccgatgcatgtggatggtgacttgctagccagaagtacattggaattggaattcaccgtgatcaataggcatacgtacatagacatgcatgactatcaccgatgtatcttccggttcaaacagtggatgtagctaacgtgtacactgcaggatgagatagtaccaaaatagtagtgacctagtagcatcaaattaacaagctgcatatactaataatcaagaagcgactccggttcggacgcccgatgggactgggagggggttaaaattgggccatgacgtcagcgtcacgcatgcgtacaaaactattttaaatttatttttctcttaaattatttatccaaatcatgacccgattgcaccattaaatttgttgcaattaaatcttcaaaacaagaccatgtgtattctgatgaaaaaaatttagcttattattgaattatttttaaatgttgcacgatgttccaccaggtatatcggaattgtttcactaagtagatcgaaaatatttcacttgtttaaatcggatgttgtttcaccttatataaaaacaatatttcagcaaatagtaaaagtatgtttcagttcactgcaacattagatctatacatagtgaaacattatgagtgcactaggtaaaacattttttgtggaacaaattataaaacaaattctcttaatagagggttcccaaaatatgtgggtgatttgttgcaatggagtattttagttcactgcaacattagatctatacatagtgaaacattgtgagtgcactatatgaaacatttttggtggaacaaaaaataaaccaaattcccttaatagagggtttccaaaatatgtggatgatttgttgcaatggaatatatggtggagatacatggtggggccaggaggagacattgcgcgtgaggagggggaagcgcccgatccggctccccccgcgccggtcgcccggcgttgagcatttacgcaataaccatataatatctttgtttttaatatatgacaccgtgacttttttgacaaacgtttgaccatttgtcttattcaaacttttttgtgcaaatataaaataatttaagttaggctttagaatatttaacgataaatcaaatcataaaaaataaatgataattttatattttttaataaaataaatggtcaaacgtatcttaaaaagttaacgacatcatgtattaaaaaattgaggaaacatatagcttcttcattgctactaatccgtacgtgaccaagcccggtacaactcctgctgatagtctccatttcaagagagaaaacgtagatgaacagctttggggacagctatgtcgtaccaacttacaggtaggagtatactgtctacgtactaaaattcttcatcgtttacccactaaagaggaatagaataagcacaatttggttgcgcttcgctgaatttcctaacaaaaccggaattacggtaagtattgcaatcattcacctgtcgaagatggcaataccgtaacattcagtaaatctatataaaatcacaaatactcatcacatcatacactgtactactgtagcgtatgccactatgcatcgatatctataatagtaatatgtagtatatatgaggtgcaaatcgagcacacacatataaacactgtagcacgcactgttgataattaattgtccacgatttgattatacaactctccggaaaatttgggccaaatgtggccgagatttaaggttaagctgctcccggaatatgggagtgcgccaggtcagccgtgcgtgctagtcttcatctagcttgtcagtgagatcgtgagccacgtgtcctccatccattggctgcccaaattgcatcgtagtacgaattgatcggccggccatccggcggcccacgcccataccgatacagtgtaccggcacggtgcgatcaaattggtacccgttttgtctgtcttgattcagccataattttccgagcccaattttgatcgtccgtcttattcgaaactttttttaaaaaattaaaaatataagtcacgagaaaagtactatttatgttttatcatctcataataataaaaatattaattataaaaaattaaacaaaatgaacaataaaagttgggtgcaaaaactgatggttgcacttaaaatgagacggagggagtatcaaacggaccaatagcgaaatatttcctctgttccatagtaaaattaactcctttcgtttatttcaaaataaatttatttttaaagtaatcattgcatcggagtttgtgaaagtagaaaataattgtattgtgaataaataaagtgaagaataattgtattgagatttgataaagtagaggtattgtaatattttggttttatattggttatatgaaacaggtaaaaaatgaatttggatagtacctctctcttcgattccccatcgatcagaaaaactaaagacaaaagagaccaacctccctagcttcctcgatcaccgggcgcagatgcaataatcatcgaatccgtgacacgaaaagctacaaatggccaaatcatgcaaagcatggcccatctactatgctcgacggaacgccacataaaatgtgtcgccgcggcgagaaaaatatatatcgacggcgactaaagagcaaagaggacttgtcacctactgtgtgagatatttcgagctccccctatccacaacggaagatggcgagcatcacagctcgcaaaaaccgatcaaatgtggatcacaggttctcgatggattcaccagctaagacgcgcgcctcgcggtctcgagtgcaatgctgcgactgccagcgaggtgcagtgcacctggaacgtcgcaggtacgtttctgccggaattttggcgttgatgagcaaccacttgacctgatgaccacaaaagttaattttggcagggccgtgcgcgagcaacaaggcgtacgtgtgcagcctgtgtgatgccgatcgggcagggtgtcgcgttgcagggtgaattggtgtcatggcgtgcgtcatttccctcttggggcttcgacgacgttgttttcgccgtgatctgactgaaccacggcaatacgtgaggctaagcctccagtagccgagtgctgcctagtaatctctagcggtatagtgatggtcagaaattagcaaaatatatctatatcgtctattgacaaatttcagggcatttcgctctacgattcaatgaatgtaggaatgatcaagaatcgacatggaaatgtcattattatacggaagaaaaagcaggggccagcaaacagcgacgctggaacggacgcaccgatgtgcccctctgcataaaacacgtcctcaaaacctcaacgcagatgaggcgcaaagatgccttcgcatcgccgcggaaaaattttggataaacccaatcaaatagggagtataataccaaccacatttcaaagaataagatgataagcagctggttaatgaaaaaaatcgacagatgacaaacggaatctggaactaattagcatgggaaaccaaaatacacgataattcatatgcaatctactcagcaaggagtaatgtgaacaagcaatatgccgaaatcaagttttcctctagaggttggcgggagtacagagttcggattctacatttccgcataaatcaatccagtgccctaaagaagtcttcgcactttagtaccaagttatcagagatccagcggaatgactaaggacaaatacatcgtcgtacagcaagagatcttaggtgatgtatctttcctgctgctcctgaaggagacgcgccgacgatttagcatccaagtacagaccactgacttcctcaagatcggcctggtaaaggtcatgagttcaccgtgtgtaagatagtaagaataatatcacaatataagtgcaggtagcagctctaggagcgaagaggcgaagaggatgttacaatatatcctgatgaaatgtcaatacataccttgctgatcttttctctcccattagcctttgcaactacgctggcaggtgatagcagctgaatagcatgcctgcaagagattcaagatatacagtcgttcatcagtagcaatctcaattaaaaatgcttatagtagaacactgaaactggaaggtaagaccggtccactcaacatattccctttactcaacgtttcagcttaactatcttttgcaaatttgtgggcatagccaggaggaacaataacaaccaaaaagcagcagtgtggtgagcacaaagcgacctattcttttaccttttacaataacaactaagggtgtgttcgggagtgaggggtgggaaccctcaccccctagcacccaaaacgaagcagcgtttggtgcatgatcaattaagttttagctaaaataaatttgaaaaatggattaacatgatttttttaaagtaactttcacatagaaaatttttgcaaaagacataccgtttagcagtttgaaaagcgtgcgcgtggaaaacgagggaagtgagttgggaaagtggagataataactcagcctaagaatcatacctcaaagatgtctgttgtccgatctctcctaaaaatgcaagactttcttcatcgatctcaatctcttctacctgtgctctaatagcaagaatctgcaaacggcgatgagcaagaatcacacacatttctagacagaaaaagcctaactgatataagacccaaaatcaaacctggatcatctcagtgggaccgtatgtttctgttcgaataatcaccaatcgatctagaagatcaactggtataccatgcggacttgtcatatcagttcctctggacacattcacacaagtatataaaagacttgttaactttaaggagcatagtaatagacaaactgatagacgcagtattactctggtactgcaatgtgacagagtgcttcgagcggtaaatcaaaccgtttaccttacattacatattcctctatttgtcgcaagtatcacaattggtgataatgggctctccagagcacgattaagataagagaagcattcaatatctagcatgtggacctgcaattaaagttcctaacaataataagtaattaaatcaaacaacattaagacatatttctaccatatagtagaacaatagtaataaataagttatacagcatggcactgcttcacaaggacaagacactgtatgcttcacaacatataaacacaccatcattcatatttgtactttctgactccaaaattagcccactgagagcagtaaactttcaatcatacggataaaataagaagatacctcatcaatgaacagaacaccaggtacaagctctgcaattccttcatcaatatatctgttgaccacctactaaaatgcaatataaagattaaagatcatacatcgatcctggaatgttcattaaatttaatccagtttcaaagaatgggtgccgctcaatcagaaactgaaaaaccttattgatttcttgccgaagcttgtcagtgatttcagtctttcgtggcttcatcatttgccccataagggacaaaatatcttggcctccttgtggttgagcatttgcagcgtcaaggtcatgaagtgtaacatcctgtacataaatgacaggagaagttttcctatattcattaacttccatataacttaagagccataagcagaaagattgaatgcactaacactgcatatgagaacaaattttcttatacagcagtaaaagaatataatgtttgagagataatagataaaaaggcaaatcatacagcttgacctttgtcagatgtaacaataattaatcaaacctaatgactccaaggattataatacgtcttagtaagacatcaagtcatggatttgataaaatcttagtgtttgtttgttaacctaatgactccaaggattataatacgtcttagtaagacatcaagtcatggatttgataaaatcttagtgtttgtttgttaaccttatgaaattatttaccaatggaggtacaattacaaatgtagacagttaggtgaataagacaaaatcttatttatttttgtttagcagggatgtaagttcaattctccataaaggtgtcagacttggtcgtaatcccctctattcagacaaggtgtgatggccacaaaatgcaccatagctctactttcaatcttctaaacgtcgacatttgacactgtacttcaaatttattaaacacgaatacacgatacatttatttcttcgattatcaacaacattaattaatggatagcacaatgcaaagaagagttgactgtgcaaaatgtatgggcaaaaatccttaagacaaagattcatcaaattacctgcactatttcctttttcttatggacctctcctttgggaatcggaacatactcctcagcttcaagatcgtattctgtagcaaaagaatcacatctaccaactcttttcactgcaccactattagcttcaatgtatataacatcacccactgccacctgcatcccacagatagctgatgataaatatgaaacatcttgtgcagaaaatggaagtaacagaaatgaatctcagtaccgagggatctaatcagctccagtccaaagtgataagttatgagttcttacacagtagagtatctgaagtcaatcatgcaaatttctacaagtaacattctccaaagtttgtacgatatattaaatattcaacagaaggcattcttttgaataagaaacaaacaaactcaaatttcaaaacatgaaagaaatgtatttttaaagtctagcacacgacataaggatgaggatcaggaagtaaaccttttcctttattaaagcatcgtaaattgtaggatctaacttcagctgcttagtcccttttacagtcttcagacctatgattacatggctaatgctttttccatatccacttgttgtactctcagcttcttctggcgaaagttcagtaacctaaaaggcaatgaagcacagttttatattattttagaaacagacaatgggaataccgtatcagttatgaatgagtgtgaaaacgtaattcaagaacactatccttgcacaaacttaaaaaactagctaaaactatgtgcttacctctccttcataaacctctttattttcttttatacgcaagcctatagctcgacggaaattttccatcagcacctcagttttcttgacctctgaggaatacacttctgatcccaccataggacagaaggggacctgtgttatgaaataacaagacaacatatcaaccattagatacattggaacttttaccaaaactgaagtagatgtagggcatcaaacaaaaaactcataactattacagacaaaatttatcatatagttcttaggaataaaacaaacaaaatgtacaggtatccaataagttgacatcttatgccagtgatccacaataatttagcctcagaaatcttagcacaaatattttcaaggaataaggaacttttcaccaacaggcgaaaaggcactataacatattgaaccagctagcaacaaacatccaaatctcaaaaaatgctgaaaggcaaaaacatagaccataacacaagtttaattaggtgaatctaaaatctaattgaatcatcctatcaaagttcaatttagaaaatgacaaggcatggatctcaaatacctgaagctcaatataaacacctttgtggagctagatgagcccttgtgaatgcagaattacttatttacactagctaattgaagaatgaaaaaaatcaaacatttcaagaaggcttattatcaagtgtccaccagtaatcctcattgaacttgataaatgggattcatctgagcagctagatgatttaactcattcttcagtgaagagaactaggaaactgaataagacctcttaaactaagcatgtcgtatcagaggtaggaaatttatcccccgtcacacatcataattgtaagtgaaattcggacccagtttggttggtttgcaacctttcgaacctaccattttaccccaggaggatcctcaatctcttcactagcagacaagcgaaattgcaaacttctgccttggaataagcttgcagtaagcatccgttgtaaataacagtgtgtgttcactatggagcctaaatctaacatcctagtttgtagcgtcgagtacaaatctagcgcagtcctcaacggtacgaaatacagcggagaaagtgtagcattgtgcatttcagaagcaaacatttatctccatcaatccaaataccccaacaataatacagtttgtccgaggagaataagttgaagcaccaaccttactacctagctcctgagagatgccgagagcgagggccgtcttgccggtggcgggcgggccggcgaggagcagcgcgcggccggccatcttcttctggcggatcatgtcgaccaccaggccggccgcctcccgcgccgccgcctgccccacgaaccccgaagccagccctatcgccgccccattggcctgctcgatgaaaccaaaccaacaagccaaaccgtcagaaaaaagaacaaaaaaaacacggagatctacgcgaatcaccccgaggctaaaaccctaggagaaaacccccccgcgttgcacggagaagcgcggaagatgagcacgcacgtcgaggccgaggcccttgatgtgggtgtgggtggcgatgcgctgcttcttcgccgccgactgcacctcctcgatcctcatcgccgccgccgagcacgcgccgccgccgccgctgcttgtctctccgaccctctcccgccgcaacaaatttgggaacggcggggagcgctgcggggcagagcgcagctgaagaggttttatcccgatttttttatttgtgataattagttatgcctaaattaaatatttagtaattatgggatgggatttactatataggaaggacgctcttgactctagcgtccaggattggacgctgtagctatgtgcgtccaggtcgggatgttgcttgtaaaaacgtccataacctggttcgcatgcgtcatgtgtccagccaaaatggatcgcgtatttggggtctctgggtgccgaagtctacgctgttggctactagaagtcagtgagtttcctctccattcacctatcactgaaaaaaagatcggcgattgacgttttgtgtccttaattattttctgcgcccctgtatttagctattgaagtgcaaatagctttgccttcatccctttctctaacagactgtatacgttatcaattttgtcaatgtgatgcaatcatttgctctagcttgttactcctattagcgtctagaaggctgcacagaagaatacatatatgctacgggttcagcaattgtgttggctcagacgattcaaaaaaatattcaaatgatatcaccacatatcagaatacaataagttctgaccacataaaaaatgaagcgatatcctttcaatccaatcaaatgttacagcagtattttttagcagattgtgacaattaactagatagtggtatgaatggaattcactaatatttgaaagtagagcactgtaagtacagaccttgagcacacaaataattttacaaaataaatagcaatgtctagttttcggatagttttgatatattgaatgaccaaggcatccataacacatcattagcggccggtttttccaacctgcaaacaaatttatcaagatcgatcaccaatccaaacattgggcccgaggagagggaagccggtgatggcgtttcttcgcgtgccgtggcaaatggttgtggagagcaccgaagagcatccgaaccgagcaggatgaggtgcaccaggttggacgccgcccagaacagcgtccacctttggacgctcttcgaaagtgtgtccaagtctagacgctatagggaaccgcgtccatcctattttcacaaatttaatctgagatttatttatttaatttaaggatcattaattactatgaataaaaaattcggggttttatcactagtcgctgcacagtggggccagaataaaatttagtctgaattgtacgcaaaccatcactgaatgcgtattatttagtttacgtaaattgtctacagaagcggagattatgtgataaagaactaatgatcgacattgccccggacaggagagcaaacacccgcacgcttttgcacagcagatcatttcatgcttctactacgtgctactactacagactggtcgtgttattgtgttgactgttgagtgggagtcgttgagatccaaagtggagcagtttagcataagaccaactccatgtcgcctcttgattacctaaaccttaattttgacagcttaaacaagcacacctcacaaaaaaaccacacctccaaactcccaagcctcgtctacgagtcaaaactgcgcgccgagatgcaagcacaaactcgtcgtcgcatcctcgcccaatcctgcgttgcactcgcgctcctgctgaccacggtacacacggcagccggccgccggccggcgagcaacaaacccacgctcccctcccatggctccgaccagaccatgacgctctacaccaccgtagccacgccggcagaagctgccggcgttccttcgtcgcaacaccccgtcttcgccggccacggcccaatcggccaccactccggcggctggctgcgcgtcttgacgcggccgggagcgctccagcccggcgcggcggccgtcgtcgacgagaggttccacggcaagaaagagttcgggatgccactggctgggaagcttcagggagttctcgtcaccggcctggaggatgacgacgatagccgtattgtggcagtgacggccttgttttccggcgacggcgaggaggatagcatcaggttcttcggggtccatcgcgacgaccaggaagagtctcacatcgcggtggtcggagggacaggacggtacgacggcgccaccggtttcgccgttgtcagagcagctgacgcacataaagctggcagaaatgtcagctcgaactcagttcttagtttcagagtgcatttgaagtagagtagaagaggagagcttgcagagatgcataccatatgatgtaaattaagatgagaatgctcacaggtgtcaagactaaagtactgtactatgttaagcttgctgtactacaatagattggcagttgaacattagtgaactaaggaacatgattgaactgaagagcaaaaaagcgaactcgtctgaatatatttcacttgaatcaaatattcgtattacaattaggagctagatgaaaatttgaaaccaataacagctcctgatatacaaacctatacttctcacaagacttactaagattcacaatgtggacaaataattaactaattctgttctgtctcaccaagatacaaaaaaatcaagtaattctacaacatttatcgtgtatgcagtaaataacgttgtactgcgtgatccagcaggtgaagtgctactgactatatttgcagcatcatatagaatccagatgagtaaacacacattgttttgattactcatccaaaattctttgacggaagtccttcaccattaagggaagaccttccctgagagagacctttggctcccaacgtagcaggtgcttggccttggtaatatctggctttctcatgtgaggatcatcagctgtgttgggtttgaattcaattgttgccattgggtcaattgtttccttcacaacctggagaaggcaaaatgtttgtttatgcaccaattcaagaaaaaaaatctgtaaaacaaattgtgtacaaacctgtgcaagttccaacatggtgaattctcctgggtttcccaggttgaaagggccaatgtgatcaccctccatcagagccatcagtccagcaacctaaaaaataccacaaaagattttggaactttaagactttgcaataggaacataatatcctgcagtcatcgttcaccatttatctgctggagataggaggagctgaacatatgattgaaagcacaacagaattgtcgcacagagggaaaaagagtgcaaatactataagctggtgatttcctgaggctcaagaatatgtcctaatttttcaagtttttccaatgaagtccggactgaatgccttttggttaaaataagctataacagaattctgtgcataaaacacttcatttcatttaggatcacagtatgcaagtaatctgcaaaagaatgctgcctggagaacatacttgaaaagagtggacaacatctgtaactaatgagtaaacacacacacagaaagcacaataagaatactgtttattgcttaccagatcagaaacatactgaaaacttctagtttgttttccatcaccataaactgtcataggctgtctacgcaatgcctacaatgataatcatgtataaactcagaatttcatattgacagcgcaaatgtgtaaccaaaagttaataaaatagcggtacgtgttaaacgaacctgggcaacaaaattgctaaccacacggccatcatctagacacattcgagggccatatgtattgaaaatgcgagcaatgcgcacctgcataataagtcagttagcaaaagatcgtagaatagctatagttactaagatgttgaagtcacataatgctacaatacgaactacagtattgcagcaattctactctatttcatcctaagagttagtgaacaagattatatgttggacacgttaatgtaattgttactttaaccattttttcagtttcatgaataatatagactgaataaaaagtaatgaactaactaaaaaatgacaactaataaagatcatcatcgccccctcccccccaacacacacacccaccctgcaatagactgtccaaaacaaaagaaaaaaaatatctttcaggactaaatggtaaaatgaaacagatctgtcataatacctaaatccatgtaaatgaaaatattagaaccccaaaagtccgcatacaatcgtcatctcaatatgttgtaaacccagcatggaatataagtgggacatatttagattattacctcaacaccaccacctctgtgatagtccatggttaaagtctctgctgttcttttcccctcgtcataacagctcctaacacctgaacaagggagagaagtcagggcttagttaattggaggtccaaatgcaaaggactgaccagaaccaaaagattatataatgtggtaccaataggattaacatgcccccagtaagtctccttctgtggatgttcaagtggatctccataaacttcacttgtgctagttagcaagaaccttgcaccaattcgctttgccagacccaacatattcaaggttcccatgacattggtcttgtaataattgttaagaaacccagatttgataatatacagatgcaacacatgattatattgtaaatagtgaaaataacataataagttgcaaaaaaacatgattggtcaaatatccaggtaaaagacataacggttttatatttaactataaaacttcaactatatattgagttacgatagagcacataaaaagcctttttaagaaaaaaaataaatgtaccttataaaaattcaggtgatctcttttcctaattctcgtacaacagaagctggtttgtgctatatctatatggcatttcaatgaacaaactaatcgaatcctgccaaggattgttcatggaagtatgtttagaaaatgggttagaacccggcctctacatccaaaacggatgtacacagccattgttcatggacgtatggaacaactactactctctgttaaaatcctgtagataaatggcactacagtagaaccggctaccccacatttaccacctgtgcatcacaactaacaaatctatcgcgtcttcctaagatctcaacagaacaaccacttgatattgaaaaaaggaggcaaatttaggatccagggttcacttgaatccaaaccaaccaccaaaagtttcagcatacgagcttgatctggaccacttatgtgctagtttgcttcaagcatatctcccacccaccaacccaataaaaaaaaataaaggagaagatcaaatcaagtcgacatgaatgtaagcaaatcaaaggtatgtgcagatccgggacgagaaggatatgatcgtcttgatggggttgtacttgtagtgcacaggggacgcggggcacgcgaggtgatagatccggtccacctcgagcaggatgggctcgacgacatcgtggcggagcagctcgaacctggggttccggaggtggtgcgcgacgttgtccttcctcccggtgaagaagttgtccaccacgatcacgctgtccccttgctccagcagcctgtcgacgaggtggctgccaacgaacccggcccctccggtgacgacgacgcggcgcggcggcgggcggaacccggggggcacgcccgacgccgacgaggtgtgcgaggcgaaggagaagagcgggcggcggtcggggacgtgggaggacggggagagggagaagaggtaggggcggaggaggaagaaggaggaggcgatcagggcgccgaggaggacgaagaggaggcgctgctcgcggaggaggtagccgacccaggatcggggcccggggcgggacgccttggacgccttggacgccggggcgtgcgccgccgccggcgcgtgggtgggggacgacttgtggagctgcttcatggcgggagagcggcgcggcggaggaggttggtggtggtggcgtgggttgggggaaaggggggtggggggtaggagaagaaacaagccgaggtgtgcgagggtaatttggggttttcgttttgctccgcgattgttgcgaattgaccctccaacagttcgccctttgttagaaaagcaccgcatttcatgcaggaagtgaggaagaagaccctcttgtttgatggttttcatcccccccccccttttaccggttatattgtcaaataatactctcttgactatgttcgtcagggtgagattgagtgagaaaacgcatcgttttccacgcgcacgtttcctaaactattaaatggtatgttttttttaaaatttttttatgtgaaagttgctttaaaaaatcatattaatccatttttgaaatttaaaattgttaatacttaattaatcatgcgctaatagctcatctcgttttacgtatcttccctatcttctcaatccccttctccttaaactcgtcgcttgttctcgatgcaattggctgcttaaccaaccatatccttagtacattggtgatgaggcatcgtgtcaaaaaaatccaacgacaaaagcgatatagcttcaacagagttgtggttgtagcagcttaggttatttgtaaatgagagaaagatctgaactttcaaccaataccgttgaagctggatatagctaccaaagatgatagcaaaagaggatgcgccctagtggcttgctggcgttgtactttggtaaatttcggatcgtagaagtagctccataggctgtatacatattacaagagataacccgtttaaaactgtcttttctttttgttacatgtaaactacctcttaaaagcttaatgcgatgatatacttcgtgtttattatcgaaaaagggattgtgattggctgcaaatatctaaacttgtttttttttgtcaattaaccatgtgtattaatattttttttatggtcaccttgactcaaaccctgttggatggatcgccacatcactaatgcttccagacaagaattttcatataaaccatgtttgacccaatataaatagttgtatcatatatatagtagtactacatataacgaactcttctccatataactaagtactattttatcgtcatgttataatcaaagagggcaataaccatatccgtgcactaatgttgctatattattgtgctcacccaaatagccatgcttccatgaacattgatgacgagtgttacgtgcgttgatcatgtttttgctttttcttttaaaaaagtgcacgctgctttcgaaataacctctctgaaagataatacagtacagggtgccaaacgcaaatagacccgcgcaacatggaggattcgttggacgcttgacttggaagggttcagaatctctctccccatccagatctggcccacggacggcccgggcagtaggtgcactgttagattcgtgcttgcgtgcctttgagattcggatccgcgagtctgttaaaccgaggctgtcgcgcgtcatcgaacgacgacgatctgttctgaatttctgatcggagacggcgcgtccctctccctcgtggccgcctcgtcttttcgtcaaatcgaagcaatcacgcaaactgccgctccttttcctgtctccttttcaagacaaacaacaaccctttggtggttagcaaatgcacgtcaaaccttcggtttaatttagcgacaccaactccaatcaaccaatcatcatccagtctaaagtttaaccgattaccagtacaaaaatcttctgtcagcaatgtgatctgttccaagctctctgcattctgcatttctctagtgcgcaattcctgatcggaacgagttatttattcagaacaagtttcagtatatcgttttcggtaggacaaatttacagcggacaagcacagggaaactgcaatggcacatgattgacatctctcagaaagtttcaggaacactgcctgcacaatccgacctttcgtccagccaggagatgatgtcagaatagacacgctcgacatcgtcaggaagctcagccgtcagagcatgccacatcccagggtaaagcttgaaagttttgtccctgcctgatgcttcttcgaacagcagcttgctcaccgaaggatcggtcacgatgtcgtctccgccgtgtaggaccaagaacggcagtgtcacctgccaactgaaaatgttaagcagaatagcagtgtccagggagttactgcacatttgcatcagttgcatgtcgtgtgcagctcgaatcgagaaaataaacatggcatatattgaaatacgctgttctaatgatgatacatgctttttttgcttccaattaggaatagagagaaaataaaaccattttcacctcatgcaggttcttctcaatgtctaggctgaccatcaggagttcatgacaggtcttcagtgggagctttcccctgtatatgtacggatttgagcgaacctaaacgcagttaccaacaaagacaagttcagtaaactctgcctttttcttccggccatgcaactaacacatgttagctatacctgctttctcatctctggatctttacaaactttgtcaattatgtccggtgtgggtatgattctccaactaggagccacagcgcacaccattttcagagcgctgaccgcgatcgggtgaggccgcatgtcatcaggaatctgacatcataaggtagcaaacaatcatacgaaaatcgtttagaaaaagggaaatttaggaagaaaatcatgaggtggtataagtaaaaataaagaactctacaggtttcagaggaaagagagctcgttgtcgagccatttcgccatgaacggaccttgcacataggagcaagcaagacggcgccatcccagtaggttggctccttcctgtggaggagaagcgccacgcctccacccatggagatgccgtacaggaacctcttcttctccctgttctccggcttctctgaaaccagcaaccataatttcagagttttgccatccccaaactgcgtgttcgatgcgtttgatttataccgcaaatactcgtgaaaaagtttgcgcagtctgagacgatgtcaccgaagtttggtatgtagcatctctgaccagatgatctaccgtggccttcatgatcaatcccgtaaacggcatatccggctcgcaccaatcgagcggcggtgtctgaatatttgtgcagctgtcagtatttcagtcaggcaagaataaatgaataatcgaaggatggtgttgatacctctcatcgatacgccgcactctgctgcgattcctggagaagaataatcaaggtgaaaatgatcagtttgtctaatcgcttctttgaatcgatttaacacaaaagggaaatcttgttagtagcagtaccatgacagataaagatcagagcttttggttcttgtttatgcggtgtccatctgcaggtgaacagcttgttgtcacgggagttcacaaaaaactcctgtgaaaatcgagttagaaaaagggctggcgatcagaaactatgaaggctaccacggtgggatcgcttatcaggattaactaacctcgtcatacttgatattctcactgtactgatcctgccaagagaaaaaaaaaacaggttgaggaactcagcctgaatcatgatccgtgatacgcaaatgaatatctgaactggtgtagggtgttactgaacgtaccatggccatatgcgtctatgtcttcagatgctttcggaactagcaaacttaacacgattggtgcctacatcgactatgcatatgtatatatactgcttcccaaaaaaaaaaaaaaacgagcaccgcaaaatcgtgagacctgggaagttacaaccaagcaaccatgggaaatctctgcatttttctttccttaacatagccaatgacacgcaacagttttatacatgtgtgtgtaaaagagtggattccttaacatcagaagattaaaaatgcaactcgtctaaatggaactccagagaccataaaaacaacgcgcatgcagatgaatgtctgcggacgcaggtcagaatcatgtggcattatcagttgattcctcatgttgatcttatactactagtacagtatattccatctggattgcaggacagtggcatcggatccacaagtttgatgaatataatatacggtagcttcagaattaagagtttcagacatctgaagtcccatttcgcaatatccatcgtactttgagagtttttacagtccttgaagaaaggaggtaccaaatccaagtcgtccattacgcaccatccaacggttgcaaaggcttggtacctcgcggtaccgcgtctctaggaaagcaggtaccgagtaattttcaacggtggaagggcagagtagtactttcgcatatgaattggaggggaacatcgcactgcttgctatcgtcgccacaaatcgagcaacccgatgcggcagtcggcctcccggcggcggtgaccacgggggaggtggtcctatatggggatgcgggcagagtactaccctatctcctccctcgtcctcagcgctagtacagcggaggcggcggccatgggagtggacgacggtggcggagacctctcggatggtggccgttgttcctcattgtgctaagaggccgatgcagaccgaggcaccgagctgagcttcgccgccgcagcaactgttgcagttgtgcatggaagaggaggtggacgctgcccctgcatcatggtatgaagccaaggccaccagcaggcagcagctacgcgtccagggcaagacgatggagccatagttttttttttaagactggtgatggagccatgggtgaaaacaacgttctgaataattgaaatttctagttgatagataaattggcttattgaacaggaaacatgcatacatactatatctatatcaatatcaagaacttcagatgttgggtttctctcatccagatttttcaacaaggatgaacacttaggcagatttgcccaggttaaattcattggtgaagttattgtggaaacagaacatcacggagctgcaaagaaggagctccaagcaccagccagctcgagtgcaccgacggacagaggttgaagaatcggagcgagctcgacgggccggcggacaagcttgatgatttagagcgatctcgagggcggtgaattggaacgagaacagagcgggcgagagctggcggcgagggcacaggcatgaaggtcacgaaccctgcggacattcccgggggtggcctcgatgcgacggcggcggcgcggcagcctagatgtgcgacggcggcgcggcgcagatggccagcacaaacgacgtgatgcggcagatggaagaggggagaagagggcggctcagaggatgtcgctattttgttagcccaatcatacccctgctaaaccaacggttagattagattggtacctcataataactcgtacctcatagtacctcgtggtaactcttcaaggatgggaaatatgctctcgtacttatcagaaatactgttaccgtaattactatagtaataaattagtaattgactaattgtggatactttatttgatttatttacttcaagtggactgtgtggtatttttactactattttcattacagttgttcatgtgtcaagcagtagtgtcagcaggagcagaatcagtttcctcttcgaggcaagtgtcttccggcagcggaactggctgccagccggtgaagcactccagtagctccttgagcgccattgacgccggctgaacggaacaagactggtagaaatccaattcctgaatcttgaagtcccacagctcatctgccgcagcttctgaatcctgagcagtgcactcctctgcaccgttcaggaacaggtcgccttcagaccggatgaacccagttgaactctggtctctgtctgccgcctgttgcaatcaccatttcaccaatgcaaagcatttttagaagtatctaagttaaaacgttttatccaccattacgtggcgtaacataatttaggataagatactgaactagtacagggttctgaaacgaggaaaatgacctgttctatcatgtacttgaagactttcttcttctcccctgcctcgtaaatgttgcactgggatacaatctgcagcagtaatcaacttcaggttaaattcgtacaattccccgaaaaaaaaaatctcgtacaatgaagttccagcttgatctgatttttttttcaggtgtgctctctccggccaaaaaaaccaatctagtattagatgtgatactttctaaaacaacaaatcagacatacttatgtataaaaaacgtcttatttaatactaggttgggattttgggatggagggagtagttacctgtgactcgacactggcgcagacagcgtaaatgccccagcccctggtgtagttgttgtagaggtgcaccctgccgaagcggacgcgcgggtgcctctgccgcgtgccgtcgaagaggcagtggtggatggtcacccggatggcacggtcctcgacgtggccggcgctgccgccgatcagcacggccttgtcgtgcgccgagaagcggcacctggacacggtcacgtccgtgctgccccgggtgacgtcgaggaggccgtcgccgcagccgcggaggccgcaccggtcgatccacacgtgccgcgacccgggcttcaccgccacggcgtcggcgtcgtggccgcggcacccttccaccttcaggttgcagacgatcacatgctcgcactcccgcagctggagccccttgccggacagtgtcacacgctgcccgcggccgtcgatggtcttgtacgacgacacgcgcagtcccgtcgagaggtggatggtgcccgacacgtcgaagacgatccatagcgggtcgcgcctccggcaaccctcccggagcgacccgtccccgtcgtctggagatcgagacccatttgctacgttgttagatgcagggagatggaatatgaataggcttgtgtgtgttagtgtacgtgccctcgagggtcgtgacgtggtagacgtcgccgtggaggccgccgatggcgtggcggccgaagccctcggcctgaccggccatgacgcgcagcgaggagtccgcggtggcgtacggcatgaacacgactccctccacggatgccggtggctcgcccccgcactggccgtcgagttgaggaggctccatggctaccgactacgaggaggttttcgcgtcgctatttgttgagtcgcgcgcggggaaacgcctgctgtagtgctgtttactgctggaatttgttgcgaccgggccgtttggcccgtttccgcttttgcagcggcgcgcgcgtttcgggccggcccagacaagccgccaaccggaagtccggaagggattaacacaggtcaaacagagcgttttaggagtttgcagggtcgttgcattgcatccagcacgagctcgttactatctgcatgacgttacgagcattcgatttcaaactatcattcaatctcgatcgtgatgtttttacctcccattgcccggaaacgtcagtgcatttaagcttgtccctaacataagttttcgctgttagatcgtttaatgttcataacatcacatgagactaatcttgaatgaaaaatcagttgggaaactctccccctttgatcaatcttagctaaaaacatcacatcggaatatcctctttgcctgaaaaccctctctaatcttctaggccaaaaaggcaaaaaatcggtcatggcccttcccatttttgtactgtttgatgaaagttttaagtaatatcatcgtgcgagacatccgacagtgcgaagtttggtgtgtcgttgtcacgtaaccttccctcgtttcctcatattcctaccgccggttgcgggtcgtctttttctcgcccgtttcatgggctccctttcatgtcagcatcggattgcgtccgaacaaagtccactcaaactctcaaaggaagatcctgaatggtctccgatcgaagctgtattggctatctgcgaagtgtcattgccggctcagtggatacacacacaggacacgaatgtacaatcactaaccacgcagcaggtacgcaataaccagcgttagtttaagcaaaaaaagggtcgtcgattacgtataatttccgctcgatagagccaaaaccgaacgtgcccataatccccccgtgcgtggatttacgtgacgcgcgacagcgcaattctctcccacttccgatctcttcttccgcttggactcatcgccgtgacgtcgacgttccacgaggaaaaggacggcgtcgaagccaccgggcaacttctcactcccgctcgcgtctctgacaagtgggccccacgcctcgctttcttccccccacctcccgcccggctgatggcccaaaccccaacaaaacctcctccgcgaaagctacaatccaaagggagtcgttaccgtctcgccattgtcctcctcctcctccgcccccacctctctttcctcgtgccttcctctttcgccgccggccgtgcgcctcttaaagccgctccccgcccgaaaccctacctcgggaaccctaccgcgcggctttgacccagggataatcccactactggctactgcattcgcttatctcgctcgcgatgtcgctcgaaatccatgaaggtgagtgatgggaatgtttggacaggtttggtggagtgtgcgtgctcgaggcgctgatttggtttgtttttggttgtttgggcgcagaggagggaggaggtacggcggcggcggcggcggtgaaggtgatgacggtgtcggggagcgggaagcgggggcggtacgtgcggcaggtgacggggcggcacaacgacaccgacctgcacgtggcggcccgcggaggggacgccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcgccgcgaagaacaggtcggggtacgacgcgctgcacgtcgcggcgagagaaggccgtcatggtgagatgacacatttagagcaactgttgccatatgtttatctgctgggcaagattttgagcattgacgtatgcacggaactgggactcgatgcaaaagtctgattgatctgtaaattccaaaacttcgagatttcttatgataaaaatttatggtataacttccactgcaattagcaagtccatagagagagggagggataaattccaattaaaaacagtaacagtgtgtgtttcgtaacactaattattgctaggacctgagtttgctagatacaatattgtttctataatctttagacacaaactcatgtctaactgactaccacatattaatcggtgcttcttcttgctgatttttcccccatctgtccatgaatattagttgttcactttcctctgaggtcagtgtacttatgtaaattgttgtgattcaaaaaatatgttagcctgttatttcattgttagcatggcaacttgtaaccttgaatttctggatattgggtttgtagcagaaaactgtgcataattccataatcaaattaaaagttttggtcttttatgtgttctacacattctgaattttgaacaaacctatcactttctcatttatacatgttaacagcgaagccaatatatgcagtcgttcattttctcttcatacataggaacaactaggataatgtaactaatgtctttctccagttcagtgtatcttgatgttatcccttatgtatatagtatgcaaacctctgagcaaacatttttttcttgcagctgttgtgcaggaaatgttacttcacaataggttgcttgccaagacctttgggcctgcgaatactagtccacttatttcagcagctacgaggggtcacaccgaagttgtcaaattgttactagaactagatgattttggattggtggaaatggctaaagataatgggaaaaattccttgcattttgctgctcgacaagggcacgttgaaattgttaaagcattactcgagaaagatcctcagctagcaagaagaaatgacaagaaaggtcaaacagccttgcatatggctgtaaaaggaacaaactgtgatgtgcttagagcacttgtcgacgctgatccagcaattgtaatgctgccagacaaaaatggaaacaccgccttgcatgtagcaacaaggaaaaagcgagcagaggtaattaatcatatttctcaatgttttcattttgaataattttatgtcttcccttgtgcactggcattctttttcagttctgaaggaacatcatacagaaaacaattactaacactatggaatgtttatctttcatatgattacttcatatctagaaaactacaatgtaaaaagaacatggaactctacctgatggttatatcttgttaattgaatgatcaaatatccattaagatttactcttcttctggaaacattaatgtacagtttaaatgaaatcaaataggtgatgccatgtgttttcaccttctaagaaataccttgattagctatgttgttaccccttttagtatgggcatcatccaatcaaatttattaaaaccaagttattctcctagctaatcaaattatcttgtatgaacaaatgctttcttaggatgcgctaagtgatatttgtgcattttttggttcaccagaatagatagtcattagttccttttgtattaataaatataatctaaaataatcaaataagtcattaatttcttttttcttatcttctacagatagttgctgttctcttgcgattaccagatacccatgtcaatgcactaaccagagaccacaagactgcgtatgatatagctgaagccttgccactctgtgaggagtcttctgaaataaaggatattttatctcagcatggcgcactcagatctagggagctgaatcagcctcgagatgagctccgaaaaacagtgacagagatcaagaaagatgtccacacacagctggaacagacaagaaaaacgaacaaaaatgtgcatgggattgctaaggaactcagaaagttgcacagagaaggcatcaataatgcaacgaactctgtaactgttgttgcagtactttttgccacggtagcctttgcagccatattcactgtgcctggtggaaatgccaacaatggagttgcggttgttgttcaggcagcctcctttagaattttcttcatcttcaatgctatagctctgtttacatcattggcggtggtcgtagttcagataacggttgtcaggggagaaactaagtctgagaggaaggttgttgaggtgatcaacaagcttatgtggctggcatcagtttgcactaccatttctttcattgcctcttgctatattgtgctaggccgccatttccaatgggcagcactactagttagtttgataggtggcatcacaatggctggtgttctgggtacaatgacatactatgtggtgaaatcaaagcgcatgaggaagataagaaaaaaagagaagatgtcaagaagaagtggatctagctcctggtatgataatactgagctctcagagactgagcttaaccaagtgtatgccttgtaagagaaaaggtctcctagattcagtctctgtctctgggattgatatgtacatgaaaattccagatatacacattaacagataacatagctcacagtatttcttgatttttacaattccttcctgtatcaaccaaaccactcagaactaaatggaataccaattgtccaattgtgcaaggctccttcagctgcagaattttatggcaccaaacgagctcaacctattgtacagtgagttgcatgtttttttgtttttgattttcattctattgccaactttcatgagaaaggatttttttttcttattctttctgtgcctacttatagtttgtgatgcgctcttcagttttcataatgtaacaacagaacctgacacgttttagttccctttatgctattggtcatcttattcttacaatgttgccctttgatgtaatttttacaatactgattttatgttgtttcataaataaaattttactgtggatctaaattatgtggctgtaagtctgtaactttgcctttctattttcccggaccttttcaatcttctattgaatctataacgtttctagcaaaactagtaagggtattcctggatcttatcagtaggtttctagcaaaattacctagtgtaatgaatgaagcaatactcacctcgctacatcgtatatttacttgtggcaatgattcttctgtactttggggggggggggggggtgcttttttttttttttggaaaaaatgacccagatacataagcctaaaggtatgattggtgcagagcaaaaatggtttttgatatgcttgtgccctggttacactccattacaggtgtccttcactgggaaaaagactgatttggttcaccattcaccagaataacttacgattgttttgctcactaattagaaaatggacagtccaagtcagggaagcaatcctagaacactttaaattcattgaaaagcacaattgtgcagcttatgtcatgcaaactacacagaccaatgtgctcataaccaatggaaaacatttggctaactatgggttagggttatatagaagcagggaggcataaagtaggccctgttacatgcgtactatcctaacacagcccaacatcatcaatgtggtcggtaactctgcttaactttggcttcaatgctgccctgccttttatcgacacacacttttagtttaaggcttatttgtcttcacttggtcatttatttaccagatgttctgttttgaagccaagaaacacaatattcccttgagtggattttttttctttcaatttatgatagactttagtaaggagtgttatatattattacccaaccttctgtatttcttaaaaaaggaaagatgatcttctgtagtttcatcactttatgcttaaatgaagaaaccaaccagttggaaatttagtacttcagaaatgaagctgatcttttccgtcatgctgcagttctcctgatgccaaatgggaatggccaaattggacgattgcctttgttttgtgctttaattggtggcgtggtatattggtatatgtccttggcatgctttgttgattgaacctcctgttcttattgcaattgcttggtcaatgacatctcttgaaaacttttttgagcactaaagatgatgctaataacatcaatggaactatagcacaatcaatccctgatatttattatgcaaattctgagaaattttgtcacatccaatggcctatatcttaatctgtcttcgaatacagatcaggatacccaggcagtcatcaagtgtgaacataaagctcttgcctccattgttttcacattttcccttctttttcatttaattttgttgccttatcatattcttccttcccttgtgattcacagctttagagttgggcattatgtgactataagcagatgtttctaataagcactacaatggattttttttatgtatatacaactagaaagggattttgtccttttggatttcatgttttaagtgtgtcggccaccagtgctgtgtatttcccaatcaaggtacttgccatagtacaggtgtgttccttggttaacttagagccatgatagttgcattcagaacccctgaaataataaatattataatacagaagtgcaaagctcaagatgcagattaaattattaataccaaggtgccagaaaagctttttgtgcataagctggactcccttgagttaatgtagtggcgcactttgcccattgttacatacataagtaaggcccctccgcccatgccgattgttaatattcaagctgcacaataagaacttcattgtcttgctttatctgggcatgcatttgaaaaaacagccttctgagagtaaatatgtgtcttgtatagtgaatatgaaagggcatgtagcctagtggttatagtgacctgagtagtaccccaaggtcctgagttcaaatctcctatggagcgaatttcagattgggttgtttgcggggctaagttccctattttcaatggccgtatatatccggttggatgtagaggccgggtaaaaaatacccttctctaaaaataaaatgtgtcttgtattgtgtttaagaaacaagcaactaagatctaatcaggaattggttgcatgtggagacagttacacacacagaaacagaataaagcgacaggtccacccaaaaagtaattggccctctttggttaattatgctccattttctcttaattgtgatgtttgtttatattacttctttttttttcttagtagcctactgcacatgcacctgcaatagggatggttatgagagaaacttttacttcagtttagtttgttgatgggaaatctgcactctggtattagacagtcattccaagtgcttacactatttggtgttaaagattagaattagaaatttgaaactatttgttcttacacaaattacacaagctacttgaatttttctgaaggacattataagatcatgtctgcaggtatctgaagatcaaaagtgtacagaattagcaaaagtgtttaaatttgtacataaacacttcatcgtccgcaaatctcaattatatcatctggatcttcagactctgcagctatccttgacgctgatgatgacatgaaacggaaacctgcatcgcttgcactctttctcaccgaggccagttgctgtgaccttttgcagtatgctattgctccctggattggattgtccatctctgagcttgcactgctgctcctcctgagcactggccccacaccagagtcagtggagcttagtatggaggaggatgaatttgatgaagagcatgacgatgatgacgctgaggatgtcttgtttgatgatgagtatcgaataatgacgctggagaaggacctcctgtggccgcactcatcttctttaagcctccctccaagtgtgacactgttgctgataggcgaggctatgtacctgttgcttctgatctggccaaatgggttcttcctccaagacttgaactgcgcattggagagctcatttgcactaggtgtaccagtcttgccatctggattgcctgctttagtggcaaatattgtcttgatataagcttttgatgccttgagcttgaggccaaggttgagatgcctgatgaacttgagcttcttggaccatggcttcttttcgcaggcggcggcctcctcagcagcaccaataccagctgatgtgcactcgtggaagtaatgctcagcattgagctctccactgacataacatgaatttgccggtgatgcattgcacgactggtatggcgttgctggggcagtgctcgcggagaggaggcccttctcagctgcactctcgaggagcttctcgaccatctggatgcgtggtggaaggtggagcggcagtagcttgcccttgtagaagagctcatcggctggtgatgccgcgggctcccacttgtcaaccggagccgacatgtggaactcgaactcccttgagttttgtggggaggctgccatggctgtgctgtagcagagcaagcttgctctggcactggcagtcaccgcctctgccgctgcaggtgagctcaggtccatgtctatgtagtcctcttcttggagtggttggtcatggctttgagggccatgtctcgccattgttgttgctaccttgtcttgtgtgtttggtgtgtgtttctggtttggttttggcagagatagtggttgtgttttaggaaggaagtggaaggagtttcggcatgctttaaagcaggatgcctgtagctaaagagtcttattaattggcttatactagtactacttatgagggacctacccttaaaccctatgatctgccttttgttagcatcctaatcctctttctgtcacggcaatatgcaatgcagtactactatggtaccagtatggtgcatatttactgtcgtgctctattattgccctattttttggctgcagtgcatttggtgattaggctattttagttgtttcgtccttcgcatgcttctcttctcatgacttaagctatatgtttgtttaaacgtgtaggtttacaaggtatccattaagagctaggccaacgaggtgcgcactttaaccaaagatttacaaactgcttggtaccttctgataatgtatggttgcaatgggaagcctcattttccttcaagcaagatagtgtagacagaggttttgtgatggttggatcgcttgatggtagccctgaattatttgtttgtggaggagtggaaggtgcaggatggttaaatcatcccggcaaaaactacctgacctgggaagacctttgaacaattggaaggtttttctggagtgaacttgcttccaaggtaaacatcttattagctcttgcttgacctttcctgttcaagtctatcattgtaaattttaaaggacgagcgcatgccctcaaaacatggatcaacatgctatttgtttatttcatcttcatgtcaacctgaggaagtgtgagagtgacatcagtggaagagctcaggccccttgtttaagttccctgtccaaactgggcgtgcgcagctagacgttgtttcttggcattttctctccctaatcttcttatctagcaaccactgtcccttcctgggctggcatccaatgtcaactttgtctctttgctgtaattattgatcactgggcgtgcattagctctcatcgagtcctttgtgcatggttaagagctactcccggcattacaaggcactttggatttattctaagtcagatatctttaagtttgactaaatctataaaagaatattaatatctacaataaaattagtttcattgaatacattttgcttgtatttttattgtgttagaaacattactatatttttctataaacttgattaaacttaaatgaggtttaacttaggacacgtacaaagtgacttataatataggaaaaagtccaaataaccccctaaactttgggtggaagtctatctagcaccctaaactttgaaaccggacattcaacccctctaaactttaccataccgtttatataaccccctaagttagttttgcatagtggtttttatctaatttgtatataagttgaatgagtttgatcacatgtcatacactttggacatatatattaaagttttgatttaaatatttcattttgctccttattagctctcactcataaacaagtcccaacctaataataggatggtctcactcacaaacaaatatattatattaattattcaaccttattcgtttaagcttccaaaatatgcaaaaccatcatctaaaaccatcttaggagataacatggatggtatggtaaagtttagggggttggatgtccgatttttaaaactcaaggtgctagacaaacttccatgtaaagtttagggaggtatttggactttttcctataatataaattggagggagtagcagatttttccatacaattctgtgcggtgattttaatagtacaattaggtttggtatatgaccgttcctttattttttataaattcaattgtattttgcatacaactttatcgaccaacttagcaccattataatttagactcactgatgaaacagtgcgtttctttttttcttttttttttctcctccacgtgataatttacgttttgaacacgatggattttttttaccctatcttaataagcacttatcctaaggtggacatggtttaagctcatgttatctcgttctgatctgagctgatatttctcttttgtttgtagaagttattcacccccttttctaatatacatatctttcttgattcttagaacataagggttaattgcccctgaagaagttctgaggtaaaagaaccttggcagctcgtggatttcggcagaggtatttgttccctatacatatctatatacaaattcgttaggttgtcatttgctatccgttaaattaaagcccttgactttatgatattcttctgaacccttctttatatctgctagtaccccaagcaccagcttgagcactaagcaacgttccacaaatggcttaaagatctaattataataacaccaggtccccagccctaatccatgacataattatatctaaactaacacccattgacaaactgcaggccaggcctgcaccttttgcaggtgatagtgctgattagaaagtggtctcaattaggttaggtgttgatcgagtgcctaacaccctactaaattccacatattggtttatatcaaaatatcgtcgtagaaaagtctgcaactctgaacagttaatcccctgaattgcaggtctaaaggtgaatgttttgcaggcactgttacttggttagtgttggttggaacttgaaaaagattcaagtttgcccccctacagattcataggcactcggaaatattatagaaacggtgaacaacccatgcaaaacttcataaccacctttcttacggacatggtgacatgattgtacctgaaaatgcatggcgcctgaggtgacagtataaaccctaaacgattaaattatggtagagttagtttttttttcctgtacagtaatctaacacgctgcatagtgttttaactgtatgtctgtttttttaaacccatgcgagggcagcgaggccagagctgccggacatttcttggtgggagtccaatattttttgccctgtaagaagagaggagggccctctgaaagttctcaaagctcgaggtgttctttgccgcttctccaaacttggaaccaagcaaaagcttctgatcttgcagcaattctggggtatctgatcatctaaaggcagaaagttcatgaagaattttgactgcttaaatctccaggtaccgatcctaatgattactccgtattacatatggcactaagcagtcatcttctctgctttaatctgcataactagattcgcactgccaaaaatgtttgaaaagaatcccagccaatgaacagtgatactcgcaagaaacaccaggttcctttcaactgtacacatttgctgtgatgtgactgaactagttgtttggaagataacctattttagacgaatggaacaaacatcctttatcaaggaaaattgcttatcttatggaaaagttgcagttgtgacgacttctttatcggaatttatgctgtgtgtgttgtacatgcacctacaacctgtttcgcactgaaggcgctagtcctgtttctgcaaatgcattgcatgtagtacaataatacatacagatgtttcagcttatgctatttattactagctccgtctcaatatatagcaatttaaaatgagatcagattcatcttaaaactacgaacctcagtggcggatccaccgtggggtctctaccccactacccgtattgtaactatgggagaccccatgaagaccccactaaaatgttctgtcatacatttattagaagagggggctataattttatatagtttgttcagacccttctgttaatctttgttggatccgcccctgacgaaccctatatccagattggtagtttagatccaacctagattactacattttaggatacattttaggatggagagtattattttgctcgtttcttttgtaaaagcctaacactgttgtagacgggctagctgtcaagatgggtgcaggagaattgatacgttgaacactgacaaaagctcatgcaaatccaagaggaaaggcaacgtggctcaagaaggccgaaatggaaaaatgcgcttgtagatcaccctccgtgcagagttccaggccttgagcgctttaaggcaaagataagaacgatgtgattgctcaagaacagcgtgatagggttgtccatgatatgatggtcagtaaacataatacgttaatcgaaagacatcttgaaccttggctccctgcgccaaggagcagaagaagaaataccatgggctgaatacctcatcaagcagttgacctgtgtgtttttctttctgacctcgatttctcgtgacactttcttcagaactgtaacctgcaagaatcgtggcctgtcagcctgagagcgttcgctctacctggccaattcctattttctggaggcccaaacaaactaaggtcgcgacttgcaagtgctattggcccagccagaagtccctgtctatcttaaccgtaagcccaaacacataatagttaatctgcaggccccgagcctctccaaccggcccaccgcaccgctttaggtacctcaagacggtataattttttattttttaattttatttattacatttttaaagtatttttttcgttttaaagttttacaaatctacatcctactgccctttgagaggacgcttttcttccgaagagccttttttatgacataacacatgcccgttagtgtgtaacggtcatgcggagggagaatggacagggactgcatgtaaaatgtgatctacgatattttgcaagcggtcaccttgtagtcctctaggactagggtggcaagggggctgtctgtaaatgactagctcagttattttgcaggtgcttcttgcagctttctgggagggtgataaggaggttgcctgaaaaatagccgatcgtgattgttagcatacgtcaaccgatgtgtgccataccataaaaacgccctttgtaagggattttttttaagaaacacccttccgcagaaaattaagggtgtagatttgtaaaactctgaaaccaaaaaatatttgagtaaatttcataaaactacagatactttgcacaatctatcacaaaactacagattttagaactagtttcacaaaactacagatttaatgtctttgtttatcacaaaattacaggtactttgaataatatatcacaaaactacagatttatgaacttgtttcacaaaagtacaggtttaatatcttcatttatcacaaaactacaaatctagtgtcccattgggacactaaatctgtagttttgtgataaatgaagacactaaatgtgtagcactgtgataaacgaatacaccaaatctatatttgtgtgaaacaagttcttaaatctgtagttttgtgatagattgtacaaagtacctgtagttttgtgataaacgaagacactaaatctgtagttttgtaaaaacaagctcttaaatccgtagttttgtgataaattgtgcaaaatatctgtagttttgtgaaatttactcaaaatattttattaaatatttcaataaataaaactcatgcatgagggaggagggagaggaagctagaaagatgaagagaggggagggaggggggggaagagttgtcctatgacatacgggatccatgtgagtctcactcgttacattagccaaaaccaatcattgtattaccgagggattaaggttg

SEQ ID NO: 34832 - DNA, 214 bp, Oryza sativa
acacgctccttttcgtgctacaatctcaccatctccttcgaccacttcttcagtcttttcatcttgtggacgatgcacacactctgtccatgcatgcacccgtcttcctgcagcctcacaattaaccgtctgcttcggccacaagtagtgtatccatgtcggtaattgcagctggatttcgtcgcgtttctgcaggtcgtcgatctcacacaat

SEQ ID NO: 34833 - DNA, 210 bp, Oryza sativa
ccatggacagccacccgtggcgcccccagcgcggccttcccgaccgcgccgtcaccatcctccgtgcctggctcttcgagcacttcctgcacccgtaagtactccactttacattgttgtttatacgtacatacacgtattacgtatacatatatacacgcatgcatcaatcatctagctactttgcatatccatccatgcttgatcgat

SEQ ID NO: 34834 - DNA, 1205 bp, Oryza sativa
ttgattccgagcgaatccgagggagagagagagggaaaagagggggaaacggcggaggggattacggggagtaaatcccccctcttgattgcacgcggagcggccgggagcggcgggattcgcggcggcggcggcgctagggcacgggcgctggcggcgggcgcggcgagaggagggggatgacaggtgggtcccacccgtcagcgagagtggcgggcgggcccgcctgtcagcggcgcgcgcgcgcggggagccgatgggccgcgggagaggagagagagggagggagggaatgggccgagccggcccaagagggaaaggggggggggaaacagacttcttttagggttttctttttataaaacctttttaactttgtttatttcttttcaattattatttgtgctctgaaaattccactaaaatttatttaagcattttaggcttttaggaaatatacaaaaatcctccaagccccatttgacttttatctttgcacattttaattgttggaggctttcacattaattttaattattctttgcacaatttcgaggatgaattttagagtcgatttgggtcgcgacacttcttcattccagtactggctgcttccctccgcgattgcatcgtacaatatctgttcctcatcgcggtcagccatctgttcatacaagaaacatctgctaagtcacgagacatttatgttttaacaatctaagtcatgtatgctaagtgtaaatgtcgtacattacaaccatacacaaccttacgtgctaagtctaattacaaatcgtgatataagctaagtctaggtgacgtatattacacaaccctagctagtaaataattacatactaagtctaattacaaataaagtaatcttatattaaaactcaaataatattacatgctaagactaaaatagtcatctatgctaagtgtttcatgcgtatatgctaagtctaattaatactacaatagtcaattgctacttgtcgcactaattccgttgtcaataattatacatactaagtctaattacaaataaagtaatctcatattaaaactcaaataatattacatgctaagactaaaatagtcatctatgctaagtgtttcgtgcgtatatgctaagtctaattaatactacaatagtcaattgctacttgccgaactaattccgttgtcaataattatacata

SEQ ID NO: 34835 - DNA, 14690 bp, Oryza sativa
aaattctcatatcatttggacaccatggaatggttggcttatgttggaagtggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcggaattgggtcggtactcttgtctaaggctaggatgggttggaaactatgtcacatcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcctttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgttttcccttttgtttttgtttgtagatggccggcagcgttacccgtcgtggtttgcacatgactggcttcgtcttggagctgcgaggcatgtgcgtggtcttggggtatccacatggagtggattaccaggccaggccgcttccggatcaggagggtgaggatgcagagcctcacgctggttgggaggtcactgcagtgatcctctccggctctcccgagcggacttcactggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgggacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaacctgcagctcaagaaggacctcgacgcgttggaggcgcagctgcatcagctcaagatcgcccagggagagatctgccgccccaagcgtcgccgcgtctgccgcagccagaagatcaccgcccgcaagagcacctccaggcctgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtcttcttgagtcgtgtggggcatggttacgccggtgtgtggtgtaactatgtcggagcctgtcttattttgtttgcctaagcaacttgaaccttaatgaaccaatttaatatcagtaataaatttaagaataatggtagtcgtgggtggttagttttaatcgtcagctctccttctctgtttgctggttctgtgtggggttttcagatggtgacgaccaggagaaatgttaacaccggtgaaggcaaccaacccgaaggcagcaaccccaacccccaaggcaatccacctccaccaccaccaccagacaccaacgccattctcacccaaatcctcgcccagcaagccaacatgatgaatgctttcctccaccacctccaaaacccgccacaacagaatgctccaccaccacctccccaacactccaaactcgccgaattcctccgcatccgcccacccaccttctctagctccaacaatccagtagatgcgttggattggttgcatgccgtggggaagaagctggacactgtgcagtgcagtgatgaagagaaagtcatcttcgccgcccatcagctgcagggacccgcatctctatggtgggaccatttccaggccacgcagccagagggacagcctattacttgggcccgcttcaccgccgctttccggagaacccatgtgcccgctggagtcgtggctcttaagaaaagggaattccgagagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcaacagcagcagaatcagcaagggactcgtgcgccacgtcctcctacgccaactgtgcagcccgttcaaggccgcagggacgcttcaggtccgcagcggctgtgcttcaactgcttcgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttccccgttcattccatccccgctacaattttgttcgactctggagcttcccactcgtttatatctgtgccattcgtggaaaaaaatcagttgggggtagaaaggcttagaaaccctctgctcatcaccacccctggcggggttatgacggcaaagtattatagccctgccgttcctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccagaacaaccggttgttttctttgcacctccaacctctgtcagaagttcagaactgcatcagataggtctgtcagaaatccccatagtcagagagttcggagacgtgtttccggaggaactacctggtatgccgcccaagcgagaaattgagttccggatagatcttgctccaggaaccactcctctgtacaagcgaccctaccgtatggcagcaaatgagctggccgaagttaagaaacagttggaagagttgaaagaaaaggggtacatacgtccgagtacttccccttggggtgcccctgtgatttttgtagaaaagaaagacaagacgaagaggatgtgcgttgactacagagctctcaatgaagttaccatcaaaaacaagtaccctcttccccggatagatgatttgttcgatcagcttaaaggtgccactgtattctccaagattgatcttcgttccggatatcatcaattacgtattcgtgaggaagacattccgaagaccgcattcactacgcgatatgggctgtatgaattcacggtgatgtcgttcggcttgaccaatgcacctgccttcttcatgaacttgatgaacaaagtgttcatggaatacttggataagttcgttgtggttttcatcgatgacattctgatatactcacaatcagaggaagaccatcagcaccatctccgtctggtgttgggaaagttacgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactaccggagattcatcgagaacttctccaaaatcgctcgacccatgacacagttgttgaagaaagaagagaagtttgtgtggagcccgcaatgcgagaaggcgttccaaactctcaagcaaaagctggtttcctcgccagtgttaatcttgccggatacccgcaaggacttcatggtgtactgtgatgcttcgcgccaaggattggggtgcgtactcatgcaggacggtcatgtggtagcctatgcctcacgccagctacgacctcatgaaggcaactaccctacacatgacttggagctagcagcggtggttcatgctctaaaaatctggcggcactatctcattgggaatcgctgtgaaatatatactgatcacaagagcttgaaatacatcttcactcagtcggacctgaatcttcgacaaaggagatggttagaactcatcaaggattatgatgtgggaattcactatcatcctggcaaggctaacgtggttgccgacgctctaagtcgaaagagccattgcaatactctcaacgttcgtggcattccacccgaacttagtcaacagatggaagccctgaacctaaacatagttggtcgtggatttttggccgcgttggaagccaagcctaccttgctcgatcaaatccgcgaggctcagaagaatgatccggacatgcatggactcctcaagaatatgaaacagggtaaagccgcaggtttcacagagggtgaacacggaaccttatggaacggaaagcgggtatgcgttccagatagcagagaacttaaacagctgatacttcaggaagctcacgaaagtccttattccattcacccgggcagtaccaagatgtacttagatttgaaggagaaatactggtgggtcagcatgaagcgggaaattgcagagtttgtggctctatgtgatgtgtgccagcgtgtcaaggcagaacaccagcgaccggccggacttctccaacctctccaagtgccggaatggaaatgggatgaaattgggatggatttcatcaccggacttccaaaaacccaaggtggatatgattctatatgggtaatagtggatcgattaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgacgccgtgatctggaattcgcagtggatgactttgtgtaccttcgagtcacgccattgcgaggtgtgcacaggtttcagacaaaagggaagctcgcacctcggtatgtgggtcccttccgtatcatcgctcgacgcggagaagttgcttaccagctggagttgcccgcctccttgggtaacgtgcatgatgtgttccatgtgtcgcaactcaagaaatgtctccgagtgccatccgagcaggccaactcagagcaaattgaagttcgcgaagatttgacctatgtggagaggccagtgaaaatcctggacaccatggagcgcaggaccaggaaccgggtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttcccccccccctttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccggccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgccgtgcttcggttagccgccgccgccgctccgctcttcctcccgactcggcgacacctccctcggcatcgccgcatcgccgtcgaccccgtccgcgcctccacttcgcccgccgaccgccggagcaccgtcgtcatcgtcttcccgaaccgcgccgccgccttcttccgcttcggccgccattctcgtcgtcgtcgttgtcccggggtgagccgaagaccgccgttcgccttccccctttcctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgaggggctgacgcgtgggccccacttcccgtggacccggtccgcgcgcccgcccctcggctgacgcaataaatggtattttttaattgaaaattaaatgaagaaattcgcaaatatccatttaaagagcatataatcttcaaatggccatatcttggccatttgaactcggaattggaccgttcaagtctctaatttttccttaagatgtaaagaacccatttttgtgctttgttcctgcttgttgtatggagtttattagtgtaaaagcctttttcttttccgttggtcgtgtagacgctgcagcttcggaagatccgctcttcgtggaagttgaagccggcgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagatgaaacaaaaccccaactagtgggtactctattcatggttccactagtatgaatttaggtagatgcttcgctgattaattagtcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgggctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagacgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttcctccttcaaatttcaactagtactagatggtcaggtcagtgatgaagaagacatcgtcagttgttcgccgaagctccggaagactgcaggatctgctagtgaagtggaggaagcagtgaagccagctgtgaagcaggagtgaagatcttggaaaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcagaagtcaggacattggtacctcaagctcccgagtgaatgaaacaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaagatgaaatggaacgtaaggcatgctctcgttggggagaagtcggtcatgttgccagcttgtgtgccactacctgctttcattgtgaggaagaccatccacccggtgaatgccccatgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcctccatgcatcccgaagcagtcctatagcccgcgttgcaacagctccaattccaatgagtgcactaccacaaggtgtcgatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaaggagggcattactccaaaaactgtccccaaccaaggcaaaatcgacctccacattaccgccaatttacacgaagcagacattccaaccgtattgtggtcactggagcaaacgccgtacccgtaaggcctcgtgttaatcagaacccatagcagaaacaatgcaccaatgctcctcctgctgcacctgactcggcaataaaccatagcaaccactctctgcatcgacagcctcagcgaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcaccgaaccaatcaaggatgcagtcactagaacaatgccagctatatctctccagaatcaaaatgagcagccatgtttgtggttttcagttcactacttatcatggtgtaatcgaaagtttgcagcaatcatgtaattcataaatataatcatgactgtaaacagtgagcttgctatgtttagagatgattcatgttgaggatacaatgtatcgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatatggcagaagaacaatttggatgccccccatctcgaggaagcactaaggatgatcatcggcaattaaaccctagtggtatagatacaaatagcaggcaatgtatttccctgaaggtagtcagtacagctttttgacgaaccacatcaaggtttcaccgaaaggcagcaagccaaaggacctcatcgtccccagaagcgtccgcaatccacattaaagaataccacctgatagagataggccgaaagatgattgataaaaagagattggcaaagatgttctctagcatgaaagaagtaggccgaaaggtgattgataaacagaaacatgttctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaagtgcaagtaccggttaccaggcaatgccatgacttgggagatgatccaatgggaaagaacacatcaaggttaaaggtgtaaaggaatacgttgaatgctaaatgatgacaacatgaagagaatagcggaaagtaaactgaacataaagtaagtgaatctgcgttgcttgttcgtgggagctattcccagttatgaatcaggtgatatgttcgaagatagtctacagaggtcagacaacgaagcttcagatttggcaggataacgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttcgaagcaaatgacaagcatggtatcctagtaatgacaagcaggttacgacgcatgacatgaagttgataacttgtccgaggttgactccgaagatatgaatcatgagaagttctggaacggaagcatcactgcactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaagattttataaaaagaaaaaccctaaaagaagtcttctttcccccccttcctttcttgggccggcttggcccacttccctctccctctctctcctctaccgcggcccatcggtttcccgagcgcgcgcgcaccg

SEQ ID NO: 34836 - DNA, 15635 bp, Oryza sativa
  unsure (1)..(15635): unsure at all n locations
gggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccatttcccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctcccccctaattggtgcttgctttaggagagagaaagcttcgttttcaaatggtcaagctcgggcctggaggagcatatatggccgatcatcgcatgcggtcccttaagccagccgcatgcgaaaatagacccattatcgcatgcggctgtcttaaccagccgcatgcgataatggatcttcgcatgcggctaatcaacccgccccgggggggcggtttttgcaggcgccgccacaagcggcccgcatggaacctaccgaccccctcgtacagaaaaacgatttttgtagtagtgtcgtgaatggatatattggaaatggtacacatttttaatctcaccaccatattactttgaattgtttttgaagaaccagaaagtttaagacccaaaccatgatccaaacttcgaaaatgttcaaaaatctcattcttagtaaccatgatgataaccgaagaatatctataaaatcgtcaaaaatcactactacacaaacggtcctgtacatggtcggagctcttttagattgcagatggaccgtaaccggtcacgtatgtaaaaatcatccttctatttttatgtgtagacctgaagaggaccgtacgcgaaaatcaatttttgcaggtgggtctcttaagggttcgcacggaaaaataaggctatttttgcaagcagtcctcataaggggccacacgcgaaaatcgattttcgcacgtgaaaataccttccctcctcagacatgttttccctctcaaccacttcaaaaatttcatcttatcctctctatccatctcactcacgtcctcatccttattctcatttctccctatcactcactctctcgtctctcactcacgagcggcggcggctcgagtgggcaaagggtgaggggcggctgatggcggcggcgggtggcggcagctcggcttcatgcttccccaggccaggcggcggcagcacggcctcgcactcccgtcggcgacgcccctcacccgcttggatctagaggcggtgcctctcactcgcctggatccggcggtgggtggtggcgatgcggccgggagtggcggtgggctcgagagctggtcgcggcggaggtgggctcaggagtggcggaggcgggctcaggagcggtggcggagcggaggcgagggaacggctgggagcggcagcgggcggcgtgcatgcttggaaggcggtgatggcgacagcgccgacaaggagggcggcagctagggttaggttttggattttatttgttttcagttttttatttttgcgtgtaggcaacataagcacccgcacgcaataatcagattttgcgtgcgggtgcatcactcgcacgaaaaaaaaaaacagatttttgcatatccttcggtgcagacggacgggatatctgcatgcgaaaacaccttttcgaccgcacggaaaaatcgtttttgtattagtgaataaccaacacgtaccattttcctccaacaaattacacattagctggaacaacagcgtccatatataaaagctatcctggtgcatccgtatgtcatcacaaaaataataggagcatttgatgaagcaactatcttagcatgacgacacggtgaatagaccaaatcaagatctttcttaatttttggcaaatcacgaataagatctgaatcactaatcctatgagatgataaaaacaatatatccaagtttacaatgccaaaacatcatctctttagagattttagcaactatatacactatctcagataaaacaaagactttcaaaatcaattttagaaactctcccatagcaagaaattttctcccatagtgagaaataccgaacactgaatctccagacgaatcaaagtatttttcttcccgtttcttaaagtgaatctcatacttttcatcaacaactagcttataatgtcgcgtcttcgcgcgactctaaccgccctccgatttgccaaaactttcaatgtctctaaagagttaaaaattaaaccatgaacatagggtgtacttcaattctggaactgcacaccatcggtagtaaagagtaagaacttagcactcttgcataatcatttctatcaaaaggagacggaaaaaagcaacaaagatcaggttccacgtggttttgaattgtcatgcaagagtagtaactgatagcatctggatatcatgctgcttgaaataatctgatggtagctacagtcacagtttatttttggtaatttgaattgtacagcacccactgtaataactttatccttgtatgtacaacagttccatttatttttttaaaaaagattaaaagtgattacatcctaattccgtctgttgccttgaacatttcactaaaatcagcaatcccgtcctcggaaaaacacccggtttcaccttgaatcatacatgacagagcatagtcccaaggacgtcctggtattaacatataagtcagtcaacaaatcaaaaagtttgtggctcttcaataatttgagaaacaaactatgcatgaaggcaactaactttaaaaccaatttgagaatgtcacaacattttccttgtaagatcatttgcaatacgagatatattttgcctcacaacttaattattgtcttttggaaaaaggaaaagaagatagatacaatcctttctgcaattccaaaatgatggtagcaccacattaattgaaaattaagtacattagactatggctcataatcaatcaattgatgcacacaaaaagttcagcgttaattcattacatgaacagagcatgtaagttataacaataaaatctacacatgaagacttgctcctggggtcgttcgtgcaaagttaggccacttataaggcataacatgggccactccgatctacacatcaaacagtgctagccgcttagcctagttggctaatccctcttaaggtattgttgggatttttttggtggatttgcccttaacccttgaagttagtattaagaaataatgcaaagattctgagctgagaagttgacttgagggaaatcggttttaagttttgtatctagttaaatccatcagaccatcagttgcatgcaccaaacagaaatttctaaataatattaactgaaagccattggctttagtcttatctgcctcagagggccatggctcttttttgcaaatagtatttgctgcagatactacgggaatgctgaatagcagatagcacatacatgtcattatccagtattttttttctgacaaaaaaatagcaaagaatgtactttggattttcatgtagtaaccttcattactgcatttatataccaagaggcaaaattcttgatttttcgcatctggtattttcctatcaccaatcttgcctatactccctgcatctacttttgatcatcatattttatcttggcatacagaccaagtataagtaattctacttatcatccatttaaacatgctactagttattcctcgtaaacaagcgattcattaatatttacatttctcgatgcctatgcagccaatcttgcgtggaagaatggaaagtcactcattaaatccgagaaagctattaagaagatatgttattggattgaaatatgactatcaaaaatatatttttcagatttggaaatatgactataaaaaatatgagacttttacagtgcttgggaggtatctaggataccttttaaactattaaagatccaccgttgattactaaatattaatctaggaatagaaataacataaggatgggcaatttagtaattgttttcagttataacaacttctaacttctccctgattgttttcagttataattcaatcgccattgctgctcgcgtattacttccgttcactaattctcatctcttgctgctcctgctgcttacattatagtcacttattaatttcatagggtatcacatcctctagcctttggaaggcaattttcttctctgtcttttggatgacctgaggatgccggtgtggatcagtgtcttaattaaattcaccaatgaactactaaaactttatataatatgacaccacccgctttatggacatcaatatttataacaaaataaatctgtaatcgatcaaaatgtcatgtaatcgatgctatgaacttcatactacgtacagaacaaactcgagatcgaagaaaccgcatgaagaacttctgttactgtgatttgcctttcatagattgatttaaataccaatggagacaattacctatctaccctcccgccaaatctctgttagtacctggcccacttttgtgcacacacatgcatgtactgatcacacatgtacacacgtacatgtatcctgctacagtacctcgtgtactgtaacacatcttttcttcttccagttttctacctccaatttccttcgcgaacaccgacgcttgcacgcacacctcgtgaagcccgttgtgaagatctctcccacacgatgtccatccaccgtatgccatctcgtatccggtatctttaaccgtctggacctttcaactcctccctgagtctagtcccgatccccaccattgaccgaagttgccctccaagaatcctgactctagtcaccttctcacatggtatcccgaccgcactagacctctgctcctccctaagcatagtcccggtcctcaccattgaccaaggctgacctcaagtcacctgcacacaatcagacaaaacaaccgtttctgggcacagatatcacaacctgacccacattagtcacacgcactcacaccaacatccacacattttttcaaactaattcatcgattaaatcattttacaaagccaattgttcatcacaaatattaatcatgacaatgatttcacaacgactactttattagactcgaaaaccaacttaaatctgtctctagtcagacgggagccactaacaaaattcctgttgatagtagggacatgttgcacattcttcagctgtacgatctttcccgaagtaacttcagatctaccgtgccaacaccatgaatagaagcatgtgacccattccccattaggacggtggaatcccgtgcgacttgataagaagagaacaacgaaatatcagcacaaacatgtacattggcccctgtatcaatccaccaattagtagactgattaactgaaaaaatagtaggtaaattaccataagttgtttttttatttgtatttgccctttagttaaaattttcaatttcattaagaaaaactaaatagaaaaatggaaaatgaaaatggatagaattcctacttttttcttcaaatccaaaaactttctcatttttttatacataggtcatcgattcggcattggataaaaaagggcagggtgccccttctagtaaatagttcaaaccattttatcgatatgagtgttctatatcagataaattctacattagctatttcctgtttaaagcatttggtactaatactaatatagttgtacaaagagtacccccttttgcctagacttcaagcagtttagctttaaccgtgttaatggtctcatattattggtctatagagaatcaaagttgatttgatttaccaataggtcacgaaatgctatggatctttcatatgatttctacatttattcagaagtaattcgtcgagatctccttctctagtgttaccaatggtcacattagcagatttagaagtctaccctgcaggtgctttcatccccttgcgttgtggacacttcctggccaaatgaccaggcaagccacacacaaagcaagttctctcatcctggttcggattgttgttgttcttcttttgcttcttgaagttggtggtctgctgagctttgtatttccccttgctcttgttctgggccttgtgcacaacattggcactggactgcccaccatcgcccttaggtgcgaagtctttttcatgagctttctcctcaacatcaagagacgctatcaacccctcaacggtgtattcctgtctgttgtgtttgagtgcagtatacgagttctttagccatggtctgtctcatgagcctgcttaactacagaacggttgtcagccatcctgtagtcatgaaactgctccacgagttctttagccatggtctgtatctcatgagcctgctcaactacaaaacggttgtcagccatcctgtagtcatgaaactgctccacgagttctttagccatggtctgtatctcatgagcctactcaactacagaacggttgacactgtagtcatgagactgctacataacgtacagatcattgctagcatcagtagcaccgaatttagtattcagtgcatcccacatcccacaactccttagcgtcatatgcatatacacctcgaccagacaatcgccaagaacgctaagaatgtatcccataaagagagtagtagcctcatctacatccgcgcaagggtaaggaaccaatttttcggaccattcgaatgtacgtcgtgcacgtgcgccgcctgccctgcccagcaaagcgaggcgagcaagtacgcccgtgtgttccccctcttctctccacctcacatgcttcaagtggctaggagggcgtcctcccttttaaggaggtccccctctcctagaataatcaatatggtactaaactccccatgcatgccatcccatgaggtgggcttttgtgaattttcaaataattaatcttcgagtgggctaagacccatctattaattccaacaattcctcctccccaagcagctacgtaaggaaccctagaccctcctcatcctccgtgctacgttggttcaaggtccctcgctcccaaactgcctcctcgcaccacctcctctctctactacgctagtgaactccggtcactcctcttccatcgactggagcagcgccggaccacgccacgacttcccccggtgtcgcagccgcctcctattcccggccctaccttcgttactctcctggagaccgccggaaacccgtactcgcattttcctcctctgattgcccctcacgtctcaccggagtgccgtctcgctgcacagtcgctaccgtcggcatcaccatgttgtcctcctcctcgtctgcatctccttgctactcggagaccccccggaacactaccgcgacaccgtcgccttgctccggccgtcgtcaaggccgcagcgccaagccagtcatcgtccacctcttcaccaaacctgaagatcgccagagccattccctcgtcgttggtccgttcgtctatgtcgtcctcttccgttcgtcgttgccggtcgccaccattgttccctcgctgtgttgtacccatggtaagagcctctcccttcgctgccctctcctcgtcctccccgtgtggttgccgcgtggttgcccacgtgtgcagttcgcgtggtagtcgcgtgaggtccgtttgacggccacttgtttcggttgacacgtaggatctcactccgttctctctgtggatagtctctgtgtacccggtccacgggtgatctagttgtttgacccgtgggtctcggctggaagttgcttgatcctttcttttcttgagcaatattgtgttcacctaatttaatggtacaataataaacaattgaaaatatccatttaaattacacttaaattaagtttggatggtcgtatctcggccatacgagctcctaattaaatataggggagaggatcgtttttgcaattaattcgcccagaacttgggcaagagagtaggattcaaaggtggcagcgctagggtttcacgggagagagaggataccgggcgagaggaggaagacgcgcctgacaggtgggtcccgccccccatcgcgcggtaaaatacacatgtataaatgagattgaaggggccaacccagtgtttcctcaggattcgaagcgaaacagggagagtgaggagacacacattctgaaattctgatgatatatacatgcatggcatcacccaattaaccatatcgacatgtttgattcaaaccttctgtgattgatgcggttaccgttcatgtagttttggatcttgcagccaccactcaaagcactgctcgtaggtatgagtgggattgggaggcatacgagaatgcagcagaaccgtggctttgagatgttcttcaggactgtacggagctactaccagttctatagatggcagatggcatgtatatatgatgccagcacggaacaacgtcggagaatgttggactcatgactattcaccttgcggcctgcgagttacccgtgctatcctcattgtatgctcaactagattttggacctcaactagagcatagaccaactttatctgattatctgaagcgttcaccaaaatttactgtgcttgagttacgaacaaccttccagagcaggttttagtaaattattgaagtgttgtgttattgatgcattgtcgtgctaaggttaagctcgactccaagctcgaaattgcgtagccttaattaacaataattcttgtgaggcatgttattgcctgttagtgacttgtgatgtggtcgtatatatgaattgtcattttttttcccccggaagtatcacatggatgtagtagagaagtgatagagttaacttattgaactataaaaatatttcagaaataatatttttctatcatttgtaatctctctgttttgaaatgtatgacatttttattggcttttagacatgacgttagacaatttactataataaaattttgaataagacaattcatcttatttaaaatttagtgcaaatataaattaaaaaacatgtaagtcatgcctaaactacctttaatgataatattgtgataacaaaataagttatacttacatacagtgctactacatgatcccaaataagtgacacgcacatcctacgtctcaaaaatggcatcttcaaaaaggggcggctgatgggcgggtgaccgctctaggctatcaccccccatcaccctataagctactctctcccttcctcctcccctcttctattcctactacaccatacatttttaaaaaataaaaaaaataaagttggaaaaatttatgtatagaaatactatattaaaaaaatatttgaattcaaattcaaatttgaaatgggtatgtaaacttttgacttataaattttgggtctataaactaatatttgaattcaaattcaaatttgaatcgggtatgtaaacttttgacttataaactttgggtctataaactttaggtgtatagactttagatgcatagaaatactatatataaaaatatttgaattcaaattcaaatttgaaatcgggtatataaacttttgacttataaactttgggtctataaactttaggtgtataaactttagatgtatagaaatacaatatataaaaaatatttgaatttaaattcaaatttgaataggatatataaagttttgacttacaaactttgggtctctaaactttagatgcgtaaacttgagatgtacaaactttaggtgtataaatttactaaaataggaaaataatacggtgccgaaaaaggaaaccacatgaaaggggggaccgtgctaggggcgatcgatcgccccttagcctttccgtcttcaaaaggcactccggtggatatgcggcacttcatggcggcgctctgatgggagctcattgccatccagaaagatggtgactctattgtcaccctgtcagtcgatccactctgtctcgtgctactgaggtcgagctggtatttattacgaacatggaataatctacaaacacacagataccattgtagccttcatccaagagtatttcaggtgatcgtatccacaagaaacgtgtgtgaactagttttcttattcgattacccaagaacacaagataaatggtaggtgagcatagagaggaactcttatagattaggcaaaactctatcaattgcttcgggcacttgcttacccatgtctgccaaaaggttccggtctacagctctataatgtacccgaacgaggaggattacgaaggacggacagggatatcaccacctgccgcctaccactacaacccgtgtagcacacaacaaagaaatgtaatatctagcccatacactacatctctgctattaattactaccccaatctcggtaccaaccttatggaagatcaaggtactcttgtaaacagagcgataaacccgcaatgatgagaatatatcttacttaaataataagagtaaatatcataaataagtcacaaacacttacttatatgaagacaagcatccgtcgaggtacaaacttggaggagaatgtcgacagcccgacacttctccagacttcccaatacaacattcctaatcccctaggaaaccttcccgtacaagaaacaaactttacaggctccaatggtaccaaatttggactccctacaaatttgactctgcatcccatacgcacacaatatctccatcgtatgccatatgtaatcttcaccaaccacgtgcattgatctttagcctaagaatcccacataatattaagatcgtccggacatcgttttctcccaagttgactccagatccatcactagcaacattctcctgaggcatcaagacaacctacatatgcattaaccaagaaaccatatccgagcacaagttcttactaatttgactaattgttagcaaacaacattactacatacgcatagtatccatctagaagtcataaacatgaattatccaaggatattcaaagaatcaaccctaaaccgaaaccgacacaatgtcggccggtcagaccgtgggctggccggtcttaccactcagtacacgccggtctgaccggatccaatccaatagcaatccttgttcaacacctgaaaagtccaatcatctccaagaaccattcgctaataatctccaaatatatatcaaaaccaataatctcatatgctaattgttcatcacaatataatattcaaacacactttgattttacaattttcatggtagatgtcgaattcatcataagaaaatttatgtgactaatttgtgacgaattcatgttcgtaaaaaacggagcatcacattagtttcctcacgacgaattggcaaatttcatcacagaacttgttccatccgtgacaaactaagttcgtcgtagaacctatctttttatgatgaaatttaatgtcatagaatttttattgttcatagttaagcctagataccatcatattaaactgctaaccggcgtgacatggctaaatccacatcgcattgtccatgttggcagatgatgaggctcctatagtaggatccggtgtgtcatgatcggtatccatgtgttgttttactattgagactcgcgtgtgtccgatgtgtgtcatgagattgggtttatccaagttgtcgatggagttataggcacccgtcatgtgtgcaaacatggtgttggttaaaaagaaaacaaatatggtattgaagaggtactaaaattaatttttagggaaaaattatggtatcagtgactggccggtgtggtgctcatagatatttctccttttccggatatgtatcatattcatagatggttctatagaaaagcgaccgggttaacttattctattataggacctcattttttggcttatatacttatgcttatcagctaaaatttaaattttcaatcttaaatttgaaactgatttgagattttttcatcgaagtttatttttcagcatttgcttttagatggataagttcacatatataaaagttttattcatagatcattttttgtttgcaaatatgccatttcgcttattccacgaatattttagaaagtcctttttatgtctgatgtactaattaacacatttgttggttcagctttcatataggattcgtttttgactgcaaataatatctgcatgtatgctatacaacattgtcgatatatatgtgccacatgtgctttctctccctcttaagtgttctatgcttactaaaatctgttgccttattcttgaccacaatttcctttgggcttctcatgaaatataaatccttgtaccaacacaataataaatacttcaaataattgggtgtatggctggtggtccagctatagatggccaaaaggctcgaggcccgacggctcagcccatggcacggcattttggcctggcccaagcacggcacggcccgacggaggtcgggcccgtgtcggcccggcccgaccaccgagccgtgcctgggcccctccaacggcacgttgggctggcccagcacgaccaggccggcccggcacgatgggccggcagccaaccccgatacacaaataaattgggtagtaaaaatagacatattatatgtcctggacgaaagaatagggatgtaaaatagacttattttatctatacatatgtcagccgaaagaggagcgacggaaaatagacttattttagctatacatatgtcagcccaaagaggagggatggaaaatagacttattttagctgtacatatgtaatagcccaataaggaggacgaaaaatagacttatttttaaaaaggcccgatgggccaccggcctttcgtgccggcacgacacggcccgacagctggtgggccgtgcctgggcatgaggtgcagcccatgggccggcacggcccgacacgaagtgccgatcgggccgtgccggcctgatggctggtggaccgtgcccagccgtgctgggcgggccttttggccatctataggtccagccaggcgaggtcaagcttacatgcaaaatatacattccatataaatggggagagacaggtaactcaggtggccatatacttgcatccaaaatcctaatgaaagccagctgccaaacctcgaggannnnnnnnnnnnnnnnnnnnnnnnnnnnnnnnnnnnnnnnnnnnnnnnnnn

SEQ ID NO: 34837 - DNA, 1166 bp, Oryza sativa
attgagtatgtggctatatgctacctccatttttaaatgtctaaaacaattgattttttcatgggtttaaccatccattttatttaaaaattttatatttttatgaagtttagaagtatacattaatgatactcgctccatgtatttttgatagtcatatttcattttggcacaatgactaaggataggtaattctacttatcatccatttaaacaagctactagttattcctcgtaaacaagcgattcattaatatttacatttctcgatgcccatatagccgatctttatgaaagaatggggagtcacatattaaattcaagaaagtcattaagagaataggtggttggattgaaatatgcctatcaaaagtaattttttcagatttaaaaatatgcctatcaaaaatagatggatggagtataaaataagttgtaacaaaaacaaaagatatttagataatatttttaataagatgaacgattatcaataattgaatgtcctttctcacattactaggaaatggacctatcgccagaaaaaaatcattgtgttagtgcaattatcatggtaacaactatatattgccacgatttcgatcatatactcaatccagtcttcgcactatatagtattctaattaatatgtgaaatccccaatgttttcatctctatgattaataaggatcgataaatgttcaagagtagcctccaattagcaaagataaatactataccaaaacacaacttttgaagagtcaataaagtgagtaattatccagggttgaaggtcaagtatttccttacaaaaaacaagatattcacaccaattaatttgactaatatataataaataagatatttgcaaggcttaaataaacaaacatgaacttcaagaccttgtacaaagatgaatgcacctaacagatctggcttaataaaaacaaacttcataggtttgactagacaatttataatagttcgagggttttagagatgcattttcccttcaagttagctatctagttagcctccaaacttcttttattttatacttctaaatatttatgtttcagtatgtcttgcattgttttggtgatgatgattgtgtcaagatacttagacggtgcaaggaagcaatacctgcgagagatgctggaggaaa

SEQ ID NO: 34838 - DNA, 29056 bp, Oryza sativa
  unsure (1)..(29056): unsure at all n locations
aagtccctatccaaacctaactctaggtggcggtggtggcttcggtgatggctggtggtggctgtgccgggcgatcgagcggcgctgaaagtggcgacgatggtggtgcatcaaaaatggatggctcggcttcatctttggtcgtgcgtcaccgcactggtgagtgcccttggggaattgtccattgtgtgtgacacaactggtagcgcgaacattgaggaccccaaagaacccaaacaatgaagtttgtgaagtaccctaatcgtgaacatatgagtttatgcaatgaaatttggctttgcaaacatcgtttgtgcaaaattttcatgttgccctgttccatacaaggcttggtcctatttcgtaggtcatcactcatatcaacaaccaaagtgagcctcctcatctcccagtacatatcaaatgtatcaagcagcgcaaagaactatctctgcacatacctcttagtatttttgtcccaaaaagttattgttatctgttgttgagaactacgtttgacctcgtcattaaaatcattcataaggtcattgcaacaaatggtatccttgtctagtacccaactaatttcacaagacacatgaaaatctggtctaccgttctcatcaaactgaacatatgaaccaacctaaacaacaacgctgcaagttgagctagcgtccatcctacgtgaaaaaaccctaaaaaaatcatacaattcaatcctaaattgtaacaaaaaagcactgagacttaccattaggatcccaatacatgtccaatggcttcattggaacctccgtgctcgttagacgtagcgacgctttcctcccatctcacttcttcctcagtgacatcatccccagtgctgcttgcccgctgacaaaaatcacagctccatcgccatcgttgtcgagtctagttcaacaggccacttccagcgccattcgcctgacgtcaccacaaaccgcctccaccctgtcgccgcctagggttagctttggggatttcgggtgtttctttgggagcgaaggggggggggagggtgtgggaggacggcgaagagtcgggatacatggtgcgacgccgggggcacttccgtcattttgaaaattttctcacctctttttacccgaaaataataaaatattatttcgggtgtcctacaaccaattacacaacttttgtggtatctcccagtcaattacatgatttttcgatatcctgtagcaaattttgccaaattggtaataacagcatgattgcacaaacatattgtgcatgtgacagcatatcctaatactcaaataatgaaactgtccattaaagaattttatagcgccttcaaagaaataaaaataaaaacataaagtttaaattccatattgtggcagacataaacaatgttggatataatttatctgtgcaaacttctggaaatttttggatcaaaataaattactgtggatatcacgtttaaaaataatttctgaaaaatcgccaaaatgaactgcctccattttcaagtttataatgaaaatgattttttttatcactgctcaaaacctaggaaaaccaaggaagtagttctattgaaatctatacgtgaatcaagagtcccatcaaaaaaattttcatatttgtgatcctcagagaacactgcagcctgaccaacatatatcccataatttttagtgcaaatatttggactatgagacaccaccatgcatttgcttctcactaaaatttcttcagcatcccgttgcacttgtcaaatgagcctcttctgcgtcaattttgggaaagaagagagggactttgggttgctattgataaggtccaataagcatataaaatatgtacaattgacgtgaaatgtctaaaactaatatgcttagcactccactcaaatgcaacatgtatgtaataacattgcatttgaaaggtacaactaaatactaaatacattcatttgaaggttgaactctatattaacaatacattataagataaatccaatgtctttgcttgatgtgatgtcattgaagtatgcaactctttgatgatgaagaagagaagttccatcacgttcttagtgaagtggactcgagagtgttcataaacttttgtatggctcttagtactataagccttcagaagttatccttcggctctccactgatctggaaacagttacaatgatgctgaaataccttcacaaattgttattcgatccttcagtgattgaggaagatacctgctagttccgatgggaagctgatgacatgatagaccaaccgcgatggcacgttggtgatgatgataggatgatgacaaaggctaactccaacgtggagttggggaagttgcaaacctaggtgacctcaacaaactaaaagagagatgtaatagactttggtggactcgataggagaaacatgggaaattgattagcagaggacactaatataatagcaaacaggaagggatatagtaattagttggagaaattttataatcactgagaggtaccaagaggtattaaaactttcaatgtaaattttcattccagagatatcaagaggaactaaattttacataaaaattatttaaaatattgtatttttttggtaacgccacaggaactgtaaaattacttaattagttgacagcggtagagtaagcatataaaataaaggaaatcgtgacataggaagatccaagccaatgagggcagtgtcagtatgtagcgccaaccatgtgcactagtgaatggctactgatttacgcgcgtttgttgctgcaagttcctaactttctctcactctctcgtttttcacgcacacacttctcaaactattaaacagtgtgtgttttaaaaaattctacacgaaagttactttaaaaatcattttaatctatttttttaaaaatagctaatacttaattaattatgcactaatgagtcgctccgttttacgtgcactgcacgttagttcccaactactctcttattctcaaaataatcatcatatatatatttatgcaccaagaccaatgataatttaagtcacatcaatcaatacaccatgcataaattctctcacaatgcacgtatcgattaaaacatcatgctaattatgatgattaatttaagaaattttaaattttattatatgattataaatttgggaaggatgcggcgatgaggatggtgctgcgatgcacgtatcgattaaaacatcatgcttatgatgattaatttaagaagttttaaattttattatatggtgataaatttaggaaggatgcggcgatgaggacggtgctgcgatagttccgatctgtagcatcttgggccaatgtccatcccgctgctttccttgcgcgcgcgcacaagcttaaatataaccgtcacttgctaatactttatccaattatctatagctcttgcgtcctcgtgagaatctaatcgcgtgatgatttcgggcagtggaccggtaataaccatttgataaccacgaatcaattaacaaagtactacaactgcagtgtttgaaccgatctcgcctcgctctaataaacaacttccatcttccgattgtccggggttggtgagttggtctgttggtggccgcttgcttcttaattcatttggagattataatctgattgttggattgcttttgtgcagagtttgactttccggaggatcgcgaagaaggaaaggacagttctgttggccccaaaccttcctacacccccaaatgctagctcgagaggtgaggagctccctcacttttaagttgatttaactcctcctaaataatcaatgtgggactattcctaacaatctcccccgtcacacattggtgccgcttagcactgatcgaccccacacacgggtacatacgggactcacacccgcggtccactaggctttgggcttacaccacactgagtgtgcacaagcactagagaccggccccacacacgggcacatacgggactcacacccgcggtccactaggctttgggcttacaccacgctgactgtgcacaagcaatagagaccggccccacacatgggcacatacaggacacacccgcggtccactagattttgggcttacaccacgctgagtgtgcacaagaactagagattggctttgataccacttgttggccaaaaccgggagacattggcccaatcaggaagaagtcttacaatatctcaaaatctaactcgagtggtgaggggctctcctacttttaagttggtttaactccccttaaataagtaatgtgggactattcctaacaagtaccccaggatgaagagataaaggtataagcacctcttgatcacgcttgaactcgtcctctgttgttagtcactaatttgcgtagttgtagtccgtagtaatagaaaaacttggtggtgggggtgcgatgtgtgatctactgcaagaacttgagaatttttttgataatggattacatgtcgaaacaatatttcagcactataaagggggtagcgcatgagacctaaatatggatggatgcagagacaaaggatttagacaggttcaggctatctcgatgagaggtagtaccctactcttatttgaggatttgaatccgctgggtgtgtattgatctgacgatctggggtatgaatatctgcccctagaggcctcctgcccaccttatataggatggagggcaggattacaagatagaaaccttaaccaatacggtatcggtttcctaaatctaatttgcaatattatcaaaccaggactttaagccgttccgtaatatacaaagaaacggaatacctaagtcatgatccgttacatattccataggtataagctatcccctataactagtcagataaccatactgtgtgggtatggggtacctataatctccacagtagcccctgagaccttcccaatcgaaaagataatcttctctcgaactagattactccaaagccgagtgcttcaatcatcttcaccgtggtctccctagtaactttactaaatctgaagactgtggagggctgaaaaataattaaatgtagacttaggtgcatcgactagatgcacctaataggtggagccccccgactatgtgattagttgaacaaactaaacatatagtcaaggagtaaataatccaaccaaccgaatggatttgataattgtagtcaaccatttgacttgatattaatatgtagcatgtgcagtgtgaatccccgaataacatgatccaagtgatataccgactgctttgtaaaatatgatgcgtacaatctaaagttgactatatcattgaaaattcacatagcaaaacaactataaagaagcttgtatgttgtgaataaataaatttccaaagtttttgggcatacaccatgcacacactgctttaataaatgtgcttgagtccctaaaagatacatggtttcaccacatctggaaatatatggcatatgtggtgtaacatccgagtaaataaactcataaatgatttaccaatcgcctgaaaaatgaccataatatatgatcagcccaagccataatattggtcaataaaaaatgcacacttacgcggcaaaaagcaacgatattgtatccaatcaattgttttataaaaccaaacagtgccttgactatataaaaagtcagcggggcagccatataaagcttcactgttcggcaccttttaaaatgcattgtaccaactcctaaaaagttgagtaactgtggtataaaaggattttaaggtattgggcactcgatcactcgcacttttgcctaagcaaaaagatgcctaagtccctaaaagaacgtgacaggccacacctgaaaatatggattacagacatattaggcctagacctaaagtatgtctaccgatacccttaaaatatgacgtataaaatacgccaattaatatgatcctgagtgataaatatcctcggtgatgtagatcaagcgtatctcatttgagtggcttctcatccgagtaattatccctcatggagaatacaaaagtagatgtgataattgaatcccgactggcgcaagcactcagctgatggccctcgtggggaataatgaatagtccaatcgttgagcttgagaaatcgactcatgaccatgaatccatgttgaatgtatcctgaacaagtccaaattgaaaatataatcctcatgcttgtgttgatgagcccctaagcatgtagcttatccttctgttgtagtcacaattgtccattgatggtagctgacgcagtcggcatagagacaaaatgaccaacatgaaaatgatatcacccatcaaagctgacgaagatgttggtggtggtaaagacaatgacaccaatcaaaggtgatgaagccgcatagccatggaggcgaagaaaccagtcggcagcagacaagtcagctagcagtgaagacgaaggcgcacagcaatggcgacaaagttgtgcagtcatggcagcgagataatcagtcgataacagacgaggtgcccggtgaagaagacaaagacacccatcagtagaagcataataagccagtagtgaaaacgaataaatcatgggtggcggcggaggcaagccggtggtgaagacgtggacgctcatcaatggcaatggcgaaatccatcaatcacgcaaaagcataaaacaatcagcgatggtggatgcaatcggcgataatgacaattggcggcaacagagatagccggttatgatgacgaagttgcgcatcaacggcagcagagtaggcatagccgaagaggcatggtttgatgaagatgacggtgtcgttgatccagtcaatagcagtgtagtagtcaatgataacgatgaggtcctctatcggcagttgcgtagtaggccaaccgtgaagacgaaataacaagtcggcgatgaaagtcggtgatgacaaaagcaaccaatggcaaggacgtagtcaccccttagcaatggcagagatatcagggccgatgaagtagaggtgctggtgatgttgtcagtgacaataatccatcaaactgttgagaagaaatccatgctcaagtattttcttaatgttggcatgtgtgtgacgaagattgatgcaacgcatcttaatttatgaagatggcagtagaacttggtgctatagctgttgtagatgcttcacttagaggaaagtatatgctgttgtccaactcgtcaaaactgagctgattggttgataactctaaactcctggacatgtagattaaatctcaaacttgatacttgagaaatttggagtagattgtggcggcattgtcgaggagtgatcctctctagcgggagatcgtgagatcccccttttgtgagttcggtcgagggaaagggctcgcctctagagatcgcgtatcctccctgagtgttgctagtcgcgtgtgggtgagaggattatacaggttcgggccgctatggagcgtaataccctactcctgtgtgtgggattaaggttgagagttactagggttcctaaatttcggtgagcgttcccgcttctcttctcctagagctcaggtctgctgagagtcgtcccctttctcggtgggcaagatcctccttttatagctcaaggggataccacatgcaccgcctctacctactcttctacagggtgggaacccaccctaccttgaccggatcacgatctatcccttcgcccggaagctaagccgtaacttgtccttgagcgggacccagcgccgccccccgcctgacacgggggacaaccttgtcattccctcataaatgggtgaagacttgtggtggtcgtcctttcgtggagggagctccgaatgacactccgatgggatgggtcatacctacctccactccgccggatacagaggcgacgtgggggcacggccgcccgtccaatcggtcatgaccggtgacaggccggtcacagaccggtcattcctgactgccgtgcgtcagtcgggtggcaccgcacgtctgcccctgccgcatgaaatgcggcgaggggcagttggggcgcctcgcgcattgatagcggttcagcctgggtcccctccccgctcgctccccccgccacatggcagttgggcgagggcctcggggcaaggtggcgcgagggcccgaggggcatgacgtggcacctcgaggcctcccggctgcttctgcgatccgcgaggtgcgggggtagggccaagctgtagggccacgcggcaggatgggaaggtaaattcccctcacttcacatacccccgagcccatatctccgacagtagcccccggcaccacgtcagacattggcctcttgaggacagtctgacgtggcgcctcacgacttcccaagctgtggttgtgggcccggcggggaatctaaacggattctgccgagcggccaggctggcgcattagccataatgaatacacctaacagatctggcttaataaaaacaaacttcataggtttgactagacaatttataatagttcgagggttttagagatgcattttcccttcaatttagctatctagttagcctccaaacttcttttattttatacttctaaatgtttatgtttcagtatgtcttgcattgttttggtgatgacgattgtgtcaagatacttcgacggtgcaaagatgcaatacctactagagatgctggaggaaaggtgataatcataaacatagtggttggatcaggctcgcagagggacatcttctgtaacagccctaaaatttgacaactttttaaaaccgatttagtttgctttgatcttctaaaaaaataaccgtcaagttagtagttcatttaaaatactattttccatgtttgttttcgatgtttcttttctcgtttaattttgtcgcaaagtgcatatcattcctcaaataattcctttgaataagatttaaatctatcccgaatgtcggaccatctaaattccacatcaattcaaatcctaactattttaatcttccccatattttcttcttttctctacatggctaggccaagctaggctgagccagcccgatgcaagccgcgctcgagctgcctcgtgccaaccctgtgccgcctcgcgtcgtgctcgcgcccagctcgtgccgcccctcgcacgccacacgcccgcacgagctctcacgaggatgaacgacgaacgaatgccgccgcgacacctccagcttccagcctccgtatttccttcgtccctccactagaacgctcaagaccggaggcaaaagaagcgcaatttcaacctctttcacctcctcaaatccgcccctactcccgttaactcaatcgtcgtcaccggaggaaaaatccccgaagccctaataccggcgtcattgattgagctccgaaactcgtcgcatacatcgccgatcctctgaaattgaaggtaaaatcggattccccatgccgagtactccctttcccctctctttacccatccaatctatcgtcggaacatcgccggcaccgcctctcggcgtcgcctctctgttcggccgccgccagccgcatggtgcgccaccgctccagggcccgctagctttggccgtcaccaccctgggactcctctcgcctcattgaacctcaccaggccgcctcccgaaccggagttcgccggagttgccgccaccatggccgcctccgcctcctgttactgcccgccgccgccagcctcaccgccagcgcttttctcgcagccgaccacaaaaacggaatcgcctcgagccctagatcacaaaaccggcgcccccttgtccaaaaccggcctcctctgccgccggcaatgtgggattctggccagttcctgtgcagaacgagaagaacagcaaatccaattttcctattgaaaaataaatcagaaaaatcctttttcttattctatcaggttgaccattgtttgacctcaaaaacaaaatccgagacctattccaaactcttagaattattccgaatccatcagtatcagtttcgttgcaatccgagcacccgttgccgcgaccctaattttagccctagggttcgccgttctccgaaattccataaatccctaaaattatttctttaaatccttttcacccattgttgcactttgtgatactatttcttttggttatctttgtttttctattatttattgtgatgatgatggttgcataaatagaaaacgctgacgttggtccggtattcggagcgagtgaaatctccgcgccagtaggagacggtttgtacgactacatcgagcccgaaggttgcaagacatgcaccctcccttgaacaatttaatcccagtagatagcgagttattttagtagcgtacttgtcctttggagtacgatagactgcacgaattctttcaagttaattatattgctattattgcattatatttttctgttgtttttataaataccttaataagccttagagtctaacaaacttaggataaaatttgataaacacttaaacaaactgttaattatttaacatactattgatttattatggatattattactgcatatgaaagcatgcttatagaactatttatggctatatgctgagaattgttgacaccgcatgtaagcgggtggtacacatgatagagtgtttggttttatggacctgtttatggtcgtgttgaatatatggatatatttatggttatttcttatttaaaattgatataataatcaaccccccttgtgtcaataagaatgacatagtttcgcccatccacacgatcgagttatcgaatctagccgtatattgctccaattgattaaacttctgcaggcctttcggtgtactggccattagctttcaagtgtgtgaagcaaagtgacatggtccatgtttatatgatttatatatgtgggctcgatgggccccgagagttcagaactaccctttgggtccatgaagttctgagctgcccatcgagtaacgaacaatggtaagtggatgcggaggtaggttggtacacaccttggactggatcactccaagcaacatctcgagcatcctttaacttactagacagaagggagagatatatggagcaatattacaccttgttacttttcagccctgccagctgtgggtatcgtgtgggtaaagctgggcagacgctgcagagtcgttgagtattcgaatacgccatgctcccggttaatggagatgtgtctatgggtgattccagattatgggcacaagttaaactaaatggctattaattaatatggttaacttatttattatttaatgttctattcatgttatttataagtaacattcatacttttatgctcgttattattgtttaaattaaatgttcaatagtgtttataacaaatgcttattaagataggctctatgaaatgaaataactgttaaggttagggtataatccttccagttctcaatactacatgttgtatattgcaattattgtatttattatcataagcatgtcttgctgagtaccatttgtactcataaatgggttcagatcatgaagaggaagatgcatgtggaggacctgttgatctgttagagtgggacaactatggtttctaggtcatcctacgctcaggcagttcctgtggtgaagtctagcagtttatctgtttttagaaataaggctttataggccatatatgtaatggtttgtatttatgttgtgttgtgaactaagtgacttaagtattgtataaacgaagtttatgcttttatatcatttcatgcgtaactgaacatcctgggcagatacgtattcgtgggacaccatgactttatcgggtgtccccacatcttcaaagagacacaagcgttgtttgatctctacatgatgtacatagatggggttgagagagaggagaaagaatgggaaagtatattttccaaagctggatttagtgcctacaaaatcatgccaatattaggttttctatcaataattgaggtgtacccttgaatgcgtattggaattcagacctgatcttcagttttcgtttggtacttgaacctaaagttttctttagataatgacttgaattcatggtgtggtttgtaacttagtagacatacatatataaatcggagtaccaagtcttgtgttgcgtgcttctaaaacaacttgcacgcatggtggaaaaacaaagagatttttgtttggaagttgatatttcttgactacatggagttgaatcaaactgtattgttggttttctttgcaagttatttatttttataattcgacattgaattatactgtagatctaatttccaattatattcatatatgcttccatgtcacgtaaagtgaataggaggtgaacttttactcgtatagtagctgagttgccgtcatcttttaacctccggtatctttactacttaaaaaattcgtagtggcggtggtgagtcctaaacaatctaatggctgagagctctcccaggatcctcccgcaagatcaacgcaccagcccactccccatccatccgcgctcgcatcgcgcatccacccacccctacacggctgcgcctccatccacgctcacgcaaccgctcgtgtccgcgatgcacgcttccatctgcgcatgtcgcagcgctcctccccctttgacgccgatacatagctaggaaacgttgattccctatcaccgggcacacggagtgcaccatcagcggcactgcggcggcacaccgggcacgcggagtgcgtcatcagccacacgtcgatgcagcctgggtggaacgcatgctggcaccgggacaggacgcggagcagctcggcggtgtcgaacgcgccgtggcacacggcgcattcggtcacctggtccctcgccgtgccgcgcagcgtcgcccatgtcgccgaaccgggacaccggagtgctcccacggcacagctgctcaggccggagcggcaccgcttgcacaaagacgacgacggctggaacccgaggcccagcacagcgacaccgcgcgccacgcccaggccacggtgcttgcagtgcttggcgtagatgaggaagaagaagagctagcgcgaggaggacggccgtgagcaggcccactacgacggacacgtccacggcgagcgtcggcggcagcgggggtggtgccggcagggaggattccttcatcagaatcatctctttcagcgaccatggataattaaatcttacgcgagattaaaaatgaaaaaaaaagtttgtgaggcaaggcgtagctggaatgatatagatctgctcaattcgtaaagtgaatgagcgaaatgggcttgaggaaaaccgtgctttgctccaaatcctcaattcttctaaaaatagcggaagctatctttgatcaaagcaatttttagttgttgattttcggttctggattgcttgatattgatcatactacttcagaacatgtacattttgttagggttgtctattggatcacctaggtttagatctagtcgggtggttctatttgcgatggatgaacaacaatagatgaatgaacaaagagggagtgagagggtttagggatgtgaccagtcgttgttgaggaggaggaagtccggccggccatcgtcgttgtcgtcgcgggcttgacgtggacggcggcgacggtgtgctcggtgccgatggcggtgatgcggttgcggcagcgacggtgtcgacgacgaggcgtggcgcggcggtggacttcccgtcactggctgtgccccctcgatcggttagggtttgtggggtggagtggcggcggcgacgaacctcgttccttgtgtcatgttatcccgtcccgtcctccacccctctttatatggcacagtgtgacgggggcccaccagccattgggctgggcgcccccgatcagggcgcgggtcaaggcccccttgagccgttgggctcaaggggagggagatccatctaacattctccccctttatctcactatttcctttagctttttctattccatcacagatttacatatagagcatgtttcatcgtcacggttaattaccgatggattcgacagccactatacacatctctattcagaaacatatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccatagcctcatggcatgctataaactcggcatacatggtagaccctgcagtggtagactgttttgagcttttccatgaaatagctcctactgccagggtaaacatgtatcccgatgttaactttgtattatcttttgcaaagtcagaatccaaatatcccactatctggagcgattctgcttttctgtaagacatcatgaggccttttgttccttgcaatcacgcaagactttctataccaatttccagtgctctaggccaggattactttgaaatctgccaaataacccggtaacaaatgccaagtcaggtcgtgtgcacacttgcgcatactgtaggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgtagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtcttgaagctttgctttaacccataaatggatctctttatacggcatcccatatttttgtttcctttcatgacaaaacctttcggttgcgccatgtatactttttcctcaaaatctccatttagaaatgtcctttttacatccatgtgatgtaattccnaatcataatgtgccactagtgccattataatcctaaaggaatctttacaagagactggagaaaatgtctcattgtaatctcttctctttgcgtgaaaacttttgccacgagtcgcactttaaacttttctatattccctctagagtcatatttggttttgtagacccatttacagcctactgttttggctcctttaggaatttcttctaaatcccagacatcattgatttcatttcatctttcatggcttctcatggcctcttcatatgagatgggatcatcctccatatgcgactctttcaggccttctaggggcctcctattcaggcacattatctgtttgaggctgttgcagctcctcctctgatgtggcaacaatttctgttgaatcctgtagaacaggttcctcactttcattcattgttgctacatgagagataacaacaggtgttggtaccgcaacggcatgcattgctggcacaacattagcaggtaaagagaaggaaagttcctgagtcgacggagcgagtacagacacccgcctctcctcaagatcaatttctcgaattaccgagctccccctaatcatttcgtcttccaagaagacggcgtatcttgtttctacaaactttgtataactgtttggacagtagaaacgatgaccctttgatctttcagaatagccaataaaatggcagcttactgttttgggttaaatactttatcctttgcaggactcccccacacacggaggatccatagctcatacggtgttttgggcaccgatgcattctatacattgtatgcattgttctaaaactgagaactccaatggaggaagaattacattcttaaccagtctctcaattctccccctcgaaatatggcctaaacaacagtgccataatttcgatgagacatcaggagttcgctttcttttcttttgtcaacgaggacacaacattcacattctcagaaagagataacaaataaaactgatcttgcaacataagaccaatacattcattattataccatagttcacatttgccatttccaaaatggcaatcatatctctcaaaatccaatttggatacacttattatcaagtttctttgcaaagaagggacataaaaacgtctggaagtaaaagtgtgaagccattcgcgagttctaggcgaagatctccaacagcctcaacttttgcttcaactccattggcaactctaatggatctttcacttctttgcgtagtcctcatggaacggaatccctttaaacaattacacacatgaatagttgctccagaataaatccaccatgtggatctagaataaccaatcataatgagattctttacaaatgtaataatgttctcacctttctttgccatgatcactgtcaggaagtcaagatgatctttcttggaatgtcttgtcttcttgcagtgtagacactgatcttgtctcaactgtaaactgttgtttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttatttactctctgtaaaattctcccgttggttcaaatttaaacagaggtaaaacatgtaaaaacaattcaaaattctattgtaatttgcatgaaaatatacaaagtacatgttcagaagcatttctcacatttatctattctctaaacaattttcacgttggttcaaattgcttagaaataaacacaattaacaactataattgtaaatgcttctgaaacagggacttagaatgaacttcctttcttttgattcggccccgagggacctaaaatgaactttttcggcctttgccggtcggcccacggccgccttgcgcgcgggcgggcgccccctcccctttcgccaggccgcaacctgggcctgggccgggaaagtggcttgccgtgcgctcccacatgggccgatttcggtccggccgccgtcggccgtccgattgctagggtttcgatcggacggtcgcgcgggcggatcgggcaaacaaaaccgcctccggccgccggcgccgaaaccctagctcctcttctcttctttctcttgcggttgcacggagcggcgtcgccgtcgccgaaaccctagcacagcgccggcggcggcatggcgacacggcggcgccgtcgcactccccttcgccgatgcgcgcactcactcaagggtgagtgcgccgccgtcgagcggttgtgccgcggcgccctctcctttctcttgcgggcgtgcgccgtgccgagcggtgtcgccgacgccggcagccttcgcgccgccgcgccatggccgacgccctcgcgccgccacgccctctattcttttctcttctcccccccaccgtctcacccctccacgcgagtgaagagtgagagaccggcgacgacggagatggtggcgccgccgcgggccccctcgccggcgcgcgcgtgcacccgcgggtgcgcgcgcggctgtcgagtggctcctcggcggtgcctctttgcccctctccccctccgtggccggcgtcaacgacggccggcgacgaggtaagattagggttagggattcgatcttttcgatccgttggatcgtttgcttttctttgcctttcttttggatttctttccccaaccaatctaaactctagggtggctctgataccattgttagggttgtctattggatcacctaggtttagatctagtcgggtggttctatttgcgatggatgaacaacaatagatgaatgaacaaagagggagtgagagggtttagggatgtgaccagtcgttgttgaggaggaggaagtccggccggccatcgtcgttgtcgtcgcgggcttgacgtggacggcggcgacggtgtgctcggtgccgatggcggtgatgcggttgcggcagcgacggtgtcgacgacgaggcgtggcgcggcggtggacttcccgtcactggctgtgccccctcgatcggttagggtttgtggggtggagtggcggcggcgacgaacctcgttccttgtgtcatgttatcccgtcccgtcctccacccctctttatatggcacagtgtgacgggggcccaccagccattgggctgggcgcccccgattagggcgcgggtcaaggcccccttgagccgttgggctcaaggggagggagatccatctaacacatttcacgaaatagtgcggccaagtagcagtatcattcaccacaagaaagaatgaagcatccagtaataggattacgaattataatacaagcatcacaatcgcagactaacagttcaccgctgatagctttctctgcaatgtgctgttgagagaattaacgagttaataatggtacaagacaaagtgaaatcagtagctgaaattaatactgacaaatccctgtttcgacagtacgtctaaacaggaaagtcaatacaacatcagctctctgcgacttgcattttcgaaacgctctgctcttggatcttatttctgtaatcttcttgaattgcgatggagatattgagcagaacaattgagttgacctcccgccgatggatggaccatagctgcatcgcagaagaagctccgtgaaccgtgaatgaaaactctgcggtgcagtggcgtcccttcaccggcgacggccgtcttgggggctaaagctcgttgtatgtccccgctgctgatagttgatccatagcacaacgcggggcaggcaggtcgccccgtccaataaaaacaccaggctccactccgttgcggatgcggctaacgagattggggttggcggaagaccaaatgggactccaaggggggaggatggggatacgctgagtacatggtggggtgcgggtggtggggggccggggggggggtccagactcactggggtcttgtttgattaatccccttgaggctttgtttggtttggagaggattgaagaggattttggattgagagggaataaaatcctcttcaatcccctctaaactgaacaaggccttagggatataccgtgcgtgtattgcttccagctccactaaatgcatcccggatctccaacacatccctgcgtgaggataaaaactacgtccccaccagtcgccgtcatgttgctcgagttgaccatcgtgcctttttgcagtgctgcacgcccatcacgccgctcagctcggcagtggtccatggcggcggcaccgctatgccagcggcccacgggggtggtgcggtaggggaggcccgcggcagcagcgcaacaggacgcgccgatgtggttcacagcggtcgcaggctgcagcgcgggggctgtaggcgccgtcgagtagagtcccacaggcgccggcgaggagggtaatttccatgtgcttttctatgtgcttgctgtttcttgctgtccttgttgtttctgtgtgctttacttagaaattttaggtacccatgattcacaatcgagctcagggggtgaatttagatgtctatgaatttagatgtgggtagaaatatacatgaatgcaaaataatattgtgtgagcaaatggatgcctaggggtaagattgtcttttcatacaacttaacggagaggagttaacagtagttacggtgtgatggtatttttgggagaaagaggcttgtgcaatggcgtttctgcgaagttgtctttgtcgatggcatttctggaattagggtgcttgtcaatggaatttcatggattttctcatagaataatgtgcaaccacgatgcctccgtggctcacaatgcttggtagagattactagattagaggttaagtagaggcctcacgaaaacaatcttgtccacgaggtagtaggtgacatgatgtgatttatatttacgattgtttaagtgatgatttttcaaatgtatatatacccgttgcaacgcacgggcatccaactagtactatagaaaaatggctagtttatttaatttgctgcctttcagttatcctaagaattttttttgagtgcttgacaagtataggtctaaacactagtacatatcctctcatctctgacggcccatcacatgcctgggcaacgtggtgtacgttcgttcaaaccattcgaaaggcatatcactgtaaatgaagtctttgtagtaatgtaatttccaaattggtatcagtatgtatttaatttgtattggagccttaatgaatgaattgcatatgtttcatgccattccagttaattacgatttaaaactctttgaagaaatggatttgttaattatgtggttttaaaaaattgttaggaattttaaactatatgtgagaaagccaattgtcaattatatgattttaaaaaattaataggaattttaaactatgtaaataagacatttgttaaaaattaaaaggaattttaaactatatgtgaggaaggcatttgttaattatatgaactttagaaaattactaggaattttaaactatgtaaataagacatttgttaattatatgtgattataaatgattttataacttatcataattttaaaactattttaataagttatctatgacgggctttagtactatgctcgatagagatgtaatcatctcaatcgtgcttagtactaatgcccatcataaatgagtgtcatccgtatcaggcttagaaatagcacccgtcacggatgagtgtcatccgcatcgggtatagtactctgcccgatagagatgaggattgagtagggtttacttagtcaatcctcatccacgggtccttatccgttctgtccgccgccaccgcctctaactctctcactctctcagatccaccgccgttgccgcctcctcctcctcgacgccgccgttgcctcctcctcctccaccgccgctgcctctcactctctcagatccaccgccgacgccgcctctcactctatcaccctctcacatccaccgccgccgcctcctcctcctcctccaagccgtcgcctcccgactgccaccgccgcctccttctcctcgacgccgccaccgccgcctcgtcctcctcgacaccgccgtcgccctcccggttcaccgaccacggcctcctcctccctcgtcgtccacgagccctcatggatccggcctccccgaccaccgccgccgcctcccggttcaagatccggcctccccgaccgccagcgcctcctccacgcccaagaccgccgccgccggcctcctctcgaagtccgccaccgccggcttcctctccgccaagtcctcaagacagacgtcgcggccgcttcgccgaccgccgctgccacgccgccgcctctcagatcctcaagaccaatgtcaagcccgcccccaccggcctcctttcctcccaggtacacttcctctcccttgttttttttatgcattgtggatgcaatggatgcagtgtatgatttttgcatgaattttggatgaattagatgtatggatgcagtggatgttttttgcattgtatagttgcatgaattagatattgctatgcagtggatgttttttgcattgtattgctatgcagtggatgcagtggatgaattttgcatgaattttagatgaattagatgtatggatgcattggatggattttttttgagtgcttgacaagtataggtctaaattaacaaatactattagcatctggcatgttttccagagctaaaatttgtaggcagaatttgctactggacatctaaaatcatgtaattggctggaagacaacacagaaacgtgacactgcgttggattccacatataacttgtgtaaatggtcgtaggatacccgaggcattattttattatttccaggcaaaaagaggagagagaatttcgaaatgacggaagtgcccctggcatcgcaccatgtaaccctaactacgtccgattgaactagaccctgtcagactcgttgctccctccacaaacactcgaaatccccaaatctaaccttaggcggcgatggtggcagtggtggagatggttggtagcaatgacaggcaatcggtgctagaagcggctggttgaactacacccaatcggactcgtcgctcccgccacacacaccggaaatccccatccaaacctatcccaaggtggcggctgtggctttggtggcagctggtggctgcggcgggctatcaagtggcactggaagcggcggcagcggtggtggtggtggtggtggtgcatcaaagatggatggctcggcttcatcattggtcatgcgtcaccgcactggtgagtttcccttcaggaattgtccattatgtgtgacacaattggaggcacgaatgtcgaggaccctattggtgtttcttaacgatattactagaaatataattcccagcaatggcgcagaaactctcgtggtatattatggttaccgatttcatctgtaagcgcacgaatataccattatagtatttcacccgagagtattccaagggtatcgtatttatttaatcccgtgggatgattataatagagagagctatactaataatttatatattacttgtaataatcaaagtctaagaaggggttaagataatgaatagggtagagtgacacacagcaagagaattgcatactctcataataaatcatctaagctaagtggaacgaaaatagaaagaatctattcctatacttctaatatacatacacattatacatacttcctagttatatgattatttagctaataccctctttccaaatgccctcgtggtgcttgagaagccactcctgattgccgagtttcttacgataatccgtcatgaccatccaactagggctaaatacggatgagtaccctccccaggaaagtaacttaggattatatacatgcgcggaggaatacccgtactgagctgtcaccatcagcggcccacctcgacatgttcgcagcatataaccccaaataacgatatccagcaatctaaacaccacgcttaaattaccaaatactatcctaatatcatcgtcatgacatagagaaatcgtatacatgatcattatgctcacaccattgcatttcccagataagctagcatcataattaatataatttggatatataataaagttggtattcatatactcggaaagtaatacaataccagagtagtataaagaagaatattctaatatatcaatagtaaaatcaaagaaatactaatcaagaaaaaaaacatcaaagccggccgtccagcacttatgtgttgtccatagcctttaaactacgattttgttaaaaatactacacagaaataagtaggggacaaaaattataactattttcatcacctcctccttgttgtccctctccgtccttcaatgcagggtatagtattcactatgctatcgtaaatactgcaagggtatacatatggttgagttcaggtggcatcagtgaaaggctaatgtaggcaatgtatataaagggacatactaactaatagaatcatttgtgagtgtgccaatagtgtattaagtgttaaatgatgctataggctgatctttggggttacggctacgtcgatgtgggactgatgttccagggcattacataagaaagccttggcaattatagtcaactttatccgttagagagacattcatgtctatttttaatggtgttattgtattattcgattgaagtggtatgtttagactatttatacatagatgtggaaataagtggtgaacaccaagttaagcggtgtagatgatttttagtgtattaataatgtataatttattttagtggtattaatgttgttttattaaaaatgcacatagcttttgaagcaagaacaatagaggagtttatatatgaccacgacaaaaagatttttatttaaatatgagagatattcttattcttatcatatttagtagtatattccatctattttacggtaaatatttttctttttttattgctagataatttacatttccttaattacattgtatatagtgatgtatgatttattttatcattcttttttttaacaacaaatattctctggcttatatcccatctttatagtgtttgaaatacagccctacgatatatacttacgcgaatgcgcgggctaccttgttgatttaaaatgaactctctcttgctggtcacttcggcagtggccaggttaaattcattggccaagctattatggaatcaagacagcacgaagccgcagaggaggagctccaagcacgagcaggctcgactctcgagtgcacaggcggacaagctcgagcacgacgggcggcgtgacgggcgagctcgataggtcggtggacgagctcaacgaatcagagcaatctggaaggaggcgagtaggaatgagatcggcggcaacacaaatggcaagctccatagcagcgctacgttgaatgaatcccaccttgatgtcgagattttacttcccatcataccctttgtaatggacagttggatatgaatggtacctcgtacctcatagtaccttgtgagaccttttcaaggatgggaaagatgctcataaaatttgcttacgtttataaagtgctgcagaagcttaaatggtcattctgtattaaatcaccatgttgcatatgagcaaaattttaaagacgactatcctatagagagagagaaagagagtgtaacaattaaaaagatgaagtaatgtgtaatttgattggattactaccctgaccctgttatggcttgatcgttcatcgcccaatcagtggatcggtatatgcactagctctaagcttgctggaaacaacaaaaagaaaatcacatttttccacatcgtcggagttagcctttgtcatcatcctatcatcatcaccaatatcctgttgcagttggtctatcatgtcatcagcttcccatcggaacttgctggtatgatactaatcactaaaggatcaaagaatagtttgcgaaagtatttcagcatcatcgtaaccgtttccggatcagtaaagagaggaaggacaacttgtgaaggcttgtagtactaagagccatacaaaagtttgtcaacgctgtccacttcactaagaagggaatggaacactattacgaaatccatttttcatggcggctattttgggatttcgttggctgaatttagagccgccacaaagcaaaggccagtgaaaatcaagatctagccgtcttaagctagccatcannnnnnnnnnnnnnnnnnnnnnnnntagcttaagacggctaccagcgaaaaaacattttcactccgccagtcaaaatgctggccatgttttaaaaaaacgacagacggagcgacaccgctccatccgcctctgtcaacactccaccattcaaaaatttcacagaaatttacccaagcactaaaaaatccacagaaatttacatcaacaatttacagtaaaaaatttccattcacctgagcattcaagcatcacaaaaatcaacacattaacaaaaatccggctagccccgagctggcggcagcccgcggcggtggtggcgacggcagctggcggcggtggaggagggagagggagaaggagacacgccgccgagccctccagatccatctccctgagctgacgccgagagccacccttcccaacatcgccgccgccgccggtggggagtcaagcgccggatccggctctccctgccaacacagccgccggatccgctgctccctcccccgtgtcgttgtcgccccctccctgagccgacgttgtgagccgtcgtcgcaaccaccctccctgagccgataccgagagccgtagtcgcagccgctgacctccctgccgccgccgtgcccgaagcagccgctgccgcctccaccgccctccccctccctccttcggctgccatcgccaaaggagcaaaagaggaggccacctgccaaagattggccagaatggtccagcccatggttcggccgaaccctcccaggtgccgttggacgcagggtttcttctgaatggcttggatcactccccaatgatggttggagggcatttccgaccattccaaccgccacaaccatcattggagggctatataaagccctctcatcctccactccatgagacacctcaagcaagaagaatcaaagctctctctctaatttagtagtgttctaaagctagtggagtaggaatagaataggagtcttagtctgagaagtcttcagaaggatttgggtatggctctagtagctctgctctcaatttttctccatagtatatgacgtaggtaattaagtttttttttccagaaagtgagaaagtgagatgatcgtacgtacgatacgtacgtacgttattctttttcgggatggagattaacagcgtgggagttttaatagatctaatccaacggtttaaaataacggatccaccaatttaagtgaaaattgaaggttgaatgtttttttttcctctgattttctaggatttctataatttattagagcgccaagcatatacactccacgtgtgattctacaaacgctactaaaccatcatatgacagtataataaatcagataaaatcataaaaattctaaaaaaagtctaactatcgattttaacttaaagatgagagatccattattttatatagttagaattatcttaaaaattaaaaaggcgtgagatgtacgtgagacatgtacgtgagatgtgcatgtacgtacgtatttatttgtccttctcgctcctcacctcctctatttttttaactgacaaaatcatataaaaactcaataattagataaaggtcacatgatctaatttttaatttttaaataacaaaatatgggtaatatagatcttgaatttgatatttaattgataaataacacaacagttgaaaaaaatgagaaaaaatatgtaacttgagaattttgtagatttagataatcgattattatcttttttatatattaagtgctagctataaaataggagaagttagctaaaaaaatacttcatccgtttcacaatgtaagtcattctagcattttccacattaatattgatgctaatgaatttagatatatatatatatatgtctagattcattagtataaatatgaatatggagaatgctaaaatgacttatactgtgaaacggaaggagtaggagaatagcggagagtttgaatggtgtggaggggagtacgtgtacgtgcgtgcgtacggtggtggggataccgaatcttttttcttttaggtggagatttaattggcaaaattagtgggtccacccttttttttctaatttattagaacgccatgtggcggcttatgagagtttgtaggaggctacatggcagctcgggagcgtttgtaggaaggttaatggacttttagtatataatataatataatataatataatataatataatataatagataatagatttctcattttcatccttgttgaaaattttggatgagagaaaccgaaaatatgaacttcttgataactaatacgtatgtctcctagtcaataggctaattcacactggtggagaaaccctttgtagtcccggttcgtaacccccatttagtcccggtttccaaaccgggagtaccaatccgggactaaagatcgctatctttagtcccgggtgaaa

SEQ ID NO: 34839 - DNA, 4519 bp, Oryza sativa
catttagtgacggtttcctagcagtgagtgtcagtccggcactaaaagtcgctatctttagtcccggattaaatatccgggactaaagatcgagctgacctttttttttttcatggctctgttgctgcatggtttatatatatatatatatatatatataaaccatgcatatatatgtttcaatacatatatatgcatacatatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaataaaacaagaaatcgctacgtactgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaagcaacgagagatctaattaatatacacttgtatgtatttgaatcggagaaatataaatgtagagcatgtgtactcacaggaaatttgaacttccgcctaagtctttctctccatttgccgcggaccaaatgacgaaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgggccttcaggagatggacgagattgtcctctgtttcttgtggatattggtcgagcattgtgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaattctaactgaacgatatacttacaaaatccagcaactcataatagagacgtcgacggcgtccagctggtatagttcgtagatatgtgtgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcggctcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatagcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttctttgcggcgtcaactttcgccttcttcgttgcccttgtgtgggcaggcggtgcagctgggggggcccttgaccttgaaggtgccggaagaggagcttgcgggggagtaggtgtaggagcacgaggaggagacggtgcaggatcctgaggacgagtcggtgctggagcctgaggtggagacggtgctggcggagcatgaggaggagacggtgcaggatcctgaggaggagtcggtgcaggatcctgaggtggagacggtgctggcggagcatgaggaggagacggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatacataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttgtcacgaccggaaatcacccaacaggcgttcctgacgtgcgtgtattattccttgtcccaggaggcaaggtacaccaaaagttgatacaaatcagagtttaacaagcggaagcgtatataaaattattacatgggcagcgaaggcccagcacacacaaagacaacgaaaaacagcggaagactagggcgacgaccacaggcgcttgacggcaggcacgagctagacaccaaagccttcatcttcaaggagctcctcatctgggcttgggaaaattaagcaagactgagtacaaccaccgtactcaacaagacacacccacaaatgcagaataaatgcaagggagtacaaaggaataataacatagaggggttagggtt

SEQ ID NO: 34840 - DNA, 1090 bp, Oryza sativa
cttttttataaccatgtttggtacacaacaaatttggtcatttatatacaataattaattaaatatttacattgtgatctccacaaggcaataggtatatactaaatcaagtctgaaaccaaatgaagttgctagattttttttagataatgaaatgaagttgctagatgtaatgcagcatctgtaatcaatagaacgcaataatttgtaaagaagtgcaggtagatttcattacatggcaacctccttatgctggtcggccttatggcttcatgcgcttcttgagcatttttcaccttcttgaagtattttctaatgccctctgaagcatattcctcaccataccttaaaaagaagaagaatgaagattgcaaatgacatgatggaacacataaagttgattaaaaaggtaaactatcaaaataatgattgcatgagactagcccgtttagcattcaccatccagtgatgtccagttcaaattaaagaacttttgttcgcttatgtactaccaaaagggcacaaaatttagaaagataccactctctcacatttagttgaaaacttaggctgtgttcggcagccaatgatcccaactctcctccctcgttttttgtgcgcacgcttcccaaactgctaacagtgtgttttttgcaaaaaaaaaagatctatagaacagttgttttaaaaaatcatattaatccatttaaaaaatagctaatacttaattaaccatgcgctaataagtcgcgccgttttgcatgtgcatgggattagttcccaacctaaacagcagaatacagccttaattgtgacccttaagcccctacctcacatgcatcaattctccattttgtaataataaccatcaattccacatggtgcatcccactgcttcctccatgcccatggtacattgatttctcactagctaacatcagctaatctcatcccccattctataattcctctagtaggcttatccatctcaggcatttctactcatcagtcatttcacttggttgagcgtggttgcagtggtaacagcatggaaatttcctatagaacgtgggagtggcatgagggttcc

SEQ ID NO: 34841 - DNA, 17286 bp, Oryza sativa
catgctactagtattcctcgtaacaagcgattcattaatatttacatttctcgatgcccatgtagccatccttgtgtggaagaatggagagtcacgcattaaatccgagaaagtcattaagaggataggtggttgtattgaaatatgcctatcaaaggtaaatttttcagatttggaaatatgcctatcaaaagtagatggagtatctagtttgagaattgttccttttaagcttcaattccctctccatatcccaatggtacaatcagctaatacatagtgatagatcggtgtttttctagagaatgtaacatttcaatgataaataactgaaacaaaaatatgccatggtatttttcctctgatggtatgaattatgcaaccaaaagttgtgaaactacaaatcagcaagcagagaacaataacttttctgactatataatcaaatgtatctttgcaacaaccaaataggtaaacattaatttatttgatttgaattgaaataaagtggttcgtaatatacccatcacataagtcctaaactacaatgttcccagcaaaaaaagaaacttgttgccattaaaacaacgatgaataaccacgagaaatgagcacattcccactcatgaattgagaagctaggaattcaaattattaagtactacaacaactaatatgttagaagtggaactgtagatattagcacacctaaacaacaaacaaaaaaaaaacacttgactagatgttccagtagagcatacctttgcttcactaatgaaagaatatcttctgcagctccatcagatatcttcaaaggaaaacatgaatcatacaagtaagacaacaattccagactatcggagtacagcatcatacaaaccagatcctcaagaaattattgaatcggtaattgactgaaatttctgaattctgatatgaagggatagtgaatagtgcatataatacattcatgaaccattgcatcagataattataattgaatagatatatttcatatgattgaattctagttagaattgctactgtacatactcacgcatccatgaatcaaaatggcgatgagtagcgctaatttgaaggcagtactaggatgaaatagtttgccccagagaggagttagaactcattagagctaccatttacagactgggaattagatgttgcggatatggtggatttttcattaaggaaattgcaaatgtatccccctgctagcatgctttgatcgtaggatcaaacttgatcctctacatgaaaaacaaaagtaaaaaagacaatttatctactcactgcctgaagtgcaaaaactaatgaagacctcattatacttcttctcaatggcatcacctttttttcatgagtgtaccacacttacaaatatagaatttgccacaatcctgttatcatgagcagcgattattgtagcctgtgcagcgctgagctgctcacatgccaggcaggctatgcattcatcatttcatgtcagacaataattccaacatcgacatgccattgatgcatatgttaggactttgatattttgcacccaacagaaattaacctacttttgaacaaggctgtcacaggatagctacataggcaacaaccctatctccacaaacctagagcctcctcaatgccacctctcactcttgagcacagaaatacgcactgccctctagcactttgataccactgacaatgaagacagaacaacgtccctacgctcttagagaataaacactgcctcctatctcctagactccctcagtctcattgtcaggattctttcaatggcattaactgttacaataacacaagtatttcggcatggcatgccaaaatgatctgctgcaccaatggaagagtcttttaggcactggaaaattagtttcgtggcagaaagtatttggtataagtatagaagagcagcatggcgtaatgctttatagtttataccttataatctcaaaaggtaatcacgcgtgcttttatatatagtgggaggaaattgatattttaatgtggatgaccattttaacccataaccatggatatgggaccagattaatatttatgctatcgatactagacaatgctgatttgatcgtaaaggaaaggtaggatgacacctacatgaaaaccatctgttcggatgtatgtaattaacccagttgcttcctcagaggaaaggttaatcccctcatagagcttttgggctacctgcaatcacattgaactatgtgagcgaacagatagctatatctaaattgcattactataataggtcagtaggaaatctcatatacgcatttaagatttaactaacaaccttcatggtatacccagcactaaaatgtagtttgtttgctgcgtcctgctgaaggctggatgttatatatggcataggaggattcttgttaattttacttctcttaattcctgttacttcaaattgggatgaataaatcctcttttctatattgtgtgcttcttcttgagagcgtatagaaagctgatccaacttttttgaattaagatgctttatccgggattgaaggttaaggccatttgaagggccagaatgttgggttttgaagtccgtatcaacagtccagtactcctgcggatcaaactgttctatttcagcctctcgatcacacacaagagccaatgccgcagattggactcgtccagctgactggcaaccaggtagcttcctccataacagtggtgatatgccaaacccaatcaaataatcaagggaacggcgtgctagataggcattcactaggtccatatcaatatatcttggagatattaaagcctttttaacagcatcctctgttatttcatgaaagacaactcttgcaacagtaacttttgaacccaatgcgtcttgctgttcgagcatttctttgatgtgccaagcaattgcttcaccttcacggtcaggatcagacgcaagaatcaaattttctgccctgaagaaggaaaaggacaaagcaattataacaacaaaaaaaaagagagagatgcacttaatagtgcagtggcaaggggggtgtggtttcaaccccgaggtcccgtgttcaatccccaatacactcacaagttattcttaaaataatgtttggagggacgtctctccctccaaatctttttttttacaacaaaaaaaaaccattagtttgctaatatcgcatagcaaaagaagtcaatcttgctctagacatattgaactaataagaaaatgtacattttatactgttatctatagtataagcataagacatatataaagagaaaaggtaaagttaagtatggtgatattggtatttggtatttcacgataaaagacattttggagccaaacttctaatataacttatgaagcatacatgcaactgatgttacccgaaaagtatgtgattgcgtgtttctttacctttataacaaggcttagtcaacatctaataattgtgtcccttaatgtgcttcgtgtttgtgaaaatgagtatgtatgaagacattttgagcatggtgactagaacctgaccaactgggtcaaggaacaggaaagcaggacaagggtggtggaaatgtggtgactgaaaatgtggattgtgggggtaagttttattcaggacaattgtttacccggcaagtactgcctgtgtaccaccaatattggcagctactattgattaatgatgtcaattcaagatttcaaggtcacagaacatgacaatgatagacaaccgtagcgacaatggtttggaagcaccttattattaaaagaggcaaacaagcatgtatttcatgttaaaaactgaaaatgctaaccatactgcattatcatacccttttaacgccgttcttatgctcttaagatgtgtccaggcagcagcaggaacctcccacaccatactgaagtcatcatcaggacgaacagattttgatcttccagctaaatctctcacatggccataactaggtaacacttcatacatgtccccgaggtatttttgaattacttttgcttttgttactgattcaacaacaagaactgatttagctgtgggagggtaaagaggaacaagtggcttctgctcactaacagaggtcatcgtacaaatctcagctttagctgtcgcgttagaagcagcagattccttcgcttttgaagatttcttcgacctgcttgatgtcttcttctctttagaactatcggcagccttttttgatttggaaatgtcagacttgctttcttcttggttgaccccaattttcctgctctttgttgctgctgtactagttttaacagatttcctctgtttcttagtagatgccttctcttctttcatatcttcactagcttccttttttctgcttgttggacttttcctccgggtagtagtctttttagtaccagtaccactcttactgcgtttgctagttgatgttgaagcctcatcagtgatggtgccacaagcagccaatgtgcttttccttttctcagatctatgaaacatactgtgtgcaacactcccatcttcctttcgcatatttggattaccaaataagcacttgtttctgatgggaaaagttacctttgtgttgcgcagggtcaaaaaggaccgtgaattacgaatattgttcgccctcaaagaaatcccatgcctatatgcagctctcagacttacaaaattaggattgcccatgagcccagtagtaaaaaaggcaccacttttgagctgcaggggaagacgggagccgattgaagacagctgccttgatgaattattacttaatgaataaggcataaagttgtaagaacatctctgagatacaccaaattgaagctgaaaaggtagcacgtagccaacatttagagaacaagcaaaactctgaatggcataggcataatcacaagtgcgacacagaagcagaattctttgatacgttccaaatagttttatgacaccgatataccgcaactttagtaatataccatggaggaagattccagtgtagctagatgctacctttgttttttaacatatgccgccattaacattttatttcatatttgaccactcgtcttattcaaaaaattcaactagatatatattttgttttgttttgttgtggcttgatttaagcaatacttacattcttaagatttctaaccaaaaaaatttgaataagatgaatggttaaagggtataacataagtcaacggcgtcatcatatatatattaaaaaaacaaaaaaaagggtgtaccattgaacgttgggaaggtctagatatttagcattacatcaattcctgtccttacagccaaaaaatcaaaggggtagaagaggatgggggcacttaccatggccgtaggcgcccccggcggcggcggcagggcgagggaggcggcgtggccggcgtagcggtgcgggatgaggcggcggagctggagcgccatcgggaggggaggagagagcgagaggcggaggcgcggccgcgggcgcacgcactcaggcgaggggggtggcttgggctaatcgactaatggctgtgatttagctagggttttggaggagggggatgaggccgcgcggcctcgcttgggatgggatgggatggacatgggagcccgtcttggggtacaaggtaggcatcagtgggccgggccgagaggatgggcttcggtcggaagccacaggcgtgttgggctgtgggggcaggaattgggctgagaattgggggtttggatttttatttttttcctgctgtttggatattcgtttggaattggagtattatgggctttgtctcccactgaattgagatagagatagggatttaagtgggcagacccgtaaacttaattatagtacaaataattaggttactcgataggctatccgcttgtttgtactattatatataggtttacgggttatccgtttgcacccttagatagacttgtttaactttcgagccaagcctgacatttttgtccacctatctattgtaggacaacccctgatgataactaaaaaaaatcatagttcaccagcttctttcatctatgcactctacctgaggtcctcccatcaaaaccaatcagctagctctctcaaccgccaccctctcacacaagaaacgtactgcatctgccatcaccctctttatctgagtattcttagttccaaaatttcatgatctgaagttgtgattacattaatactatttcagatggatcattttgttctttataggatataaaatgtaaaatttaaaaccactgtaatttaacttacaaacttcaaatccagcacagatttataatttggagtggtacatattactctcatatttcttatagaagccggcctcctccccacctgtcggccagcctgtctagacaagaggagtgagagacagaggaggaaggaagactccaacctcggcgtggcggcctcctttcccgcatcgcggccatcgtagctgccgccgattcctcctctcccgcctcggcatctgttgtccctgcaagtgagcccagcgccgctgctgcaggagaagctcatggcgacattgtacccgtcaatcactgacaggtcgtaaaagtcctggctgccaccgatggtgaactccgccggcgtcatcggtggccgccccggagaggctgcatgacagcgagccaccgtagtcaccggtggcgcaactgcccatgctggcaccgttgaagttgttgccgttgtcgtgtcgccgaccgccagacctcctctcccctctcgccccaatgacctcctccccacctgccggccgccttgcccagagaggagaaaagtgagagagagagagagagattgagagagagagaggaggaggaagagggaggagggggaagaatgagggtgctgacgtggcatcctaacatgtgggtcccacgctgactcagccaccacgtcggacaaaaccgaagtcaaaaccaccaaaggacctaaagtgaataattttgtaagttgagggatgtcatatatctggttttgcggttggggatgattttgtaattcgatgacaagttaagagaccttcagtgtactttttccttttggatattcgtggaatttggaattggagtattatgggctttgtttcccactgaattgggatagaagtgtaagcgggcagacccgcaaactcacttatagtacaaataatcgggttaaccaatgggctacccgcttatttatattataagtaggtttacgggcctaccagtttgcatccttagatctctactattataaaaattgaagatgttttcgtggtccgtcatctgtgtttgagtcggttataaaaattgaagatgtttccgtggtccgtcatccgtttttgagtcggttttaattttatgttttggttttaatctatatctcttctcttctctactattataaaaatgagtaaaatacatggtcggtccttaaagttgagcgcgggtgtcacttaggtctataatcttgtaaattgcacatctaggtccaccatcttgtttaataagtgactcattaaggtccaaacccggtttgaccaaagctgaccatctacattgcattccacgtagacagctcatttgcaaatagccccttcgcgcttcagtagagccctgggcaccaaaaaaatccccaaatccctcagctgcctccgtcgtcacatcgcccaccaccgccgcacgtcatcctcatcgtcagccccttcgccggtcacgtcataccaatggctgagctgatgcggcgcctagtcgcacaccatggttgcgccgcctcgcttgtcacgttctccggcctcgcctcgccaacatcagtgtcctccgtcgctgctatcatggacctcgatgaagcgacacatgattgccaacgacgcagtattagaggggacgaagcgagcggcggacgagctcgaagatcaggacgccgcgctgtcgtggacctcaaatccttcttgacgaatggccggcgggcagaacggtggagggcaagcgcggcggcgggatgcgagcggagcggcgacgagcgaatgcggcagcagttggcgggtggtgcagggaactagaggagagcttgcggagcgccgtcaccgtctttgtagctagcgtgccgatggcactcgtgcctcactgatggccagatcaaccggtctcccttcctgctgatcgttggtgctagaggcgtcggtgagcttggcgcgcgcgggggaggtgtcgccggccacgccctggggaggggtcgcctaccgcggccgcgcgtgcgggggaggcgtcggcgagctcggcgtgagctgggcgggtgcgagctccatggcggcagcggggcggcaaggcgagcttgacttgagcagctgccgcagccacttgccgcatgcacccacggctggctagagcaggggccttccccttcccctgctccttctccttcccatcgacgacggcgagcggctgccggaggggtatgaggcgcgtcaccaggcgcagcgtggttgagacaggtgggtgccgcaggtgtgcatgctggcgcacgtcgccgtcgacgcgttcctgcgtgcgccacgcaaagaagggattggatcagacacggggaatcaaaaaggggggcaaaatgcaaatatgttgtcacgctggaccgccacgtaagccaatcaacccggtcagagatcctttggacctcaatgagtcacttaaacaagatggtggatcgagatgtgcaatttacaaggttatggacctaagtgacacccgcgctcaactttaaggaccggccgtgtattttactctataaaaatggaagatgtttccgcggtccttcatccttgtttgaatcggttataaaaattgaagatgtttttgtggttcgtcatccgtgtttgagttggttttaattttatgttttggttttaatctatatctcttctctgctattataaaaattgaagatgtttttgccggtattttgatacgtcatccatgtataagtcggtttttaagttcgtttgcttttggaaatgcatgtccgtatttgagtcggtttttaagatcattcacttttgataatacagaaggaatcatataagaaatatgtttaaaaatactcgcatgctaacttgagacgatcggacacctaactagctcatgattttctaaaagagcatatatatacatatatatatatatatatatacatatacatacatacatatatatatatatatgtatatatatatatatattcaagcgaactcccacagtgaatttcatcttaactaaaccatataacaataataagattaaaatagacttctcccgttgcaatgcataggtattttttctagttgaattgttaagctttcgagccaggcctaacatttttgtccatccgtccgtctccatagtatggaaacccctgatgataataactaaaaataaataaaaaaagttgtcatcatagttcagcagcttccttcatctactgtccatgaggtcctcccatcaaaaccaatcagctagctctctcaaccgccaacctctcacacaagaaaggtacatcgaccagatcaccctatttgcaactggttcatattttttttcttcatctaagtattcttagaattgtagttccagaattccatgatctgaagctgtgattatattaatactatttcagataaaatataaaattttgaatcactatgatttaacctacaaatttcagatctagcacagatttataatttggagcggtacgtattactctcgtatttcttatagaagcatttacgcttttgtgtggctatcctacctaccatgtgtctccttttgactactccctctgtccaggattataagggagtattccctttttagcactaagtaaagaagataaagaagtacatgtgtggaaataggagtatggaagtagagtagtaggcatcgagctagttaggacagatgcgggtggatgggtggtggggaaacttttcaatgcataggacagagtcagacacatggataaaatggatggctactggtgtactttactcctcgaaaactcaaagtacactacattggaggagaaactgtactacatattcaccaaggctatctagatagaagttggatgtgagagaccaatggctgagagaactcatcaccaaatcaacctcacctcatccacacccaacccatcaatcaaaagatggttcccctttcatgatatatatatcctcaaaccttgcataacatagtatacaatagagtacatttttccttcatgtagaaacaagcaacatacatatatagagcaagtacaaggcagaacagaactatgaacagagcagtggaaggcatgcatagtactacgcaagcaccggtacgtacatatgtaccagctttatttaatacaaacacttgtgatgagtgcatgcttggtgcttcgcctctactcggcaattgagacttgttcatctccatgtgttatcacagcagctacaggtgcccagatcacgctgtccctgctaacgaagtggcacaccgacgcatctcccggcctgagattgtgctcgacgaacaatggagtcttggggtcaaatcgtgacgtgtccaggtggcacacggcgagcgcctccatcttctccggtgtgccgctgccgctgccgctgccatcctcctcgctctccagcaccactgcgtacactcgggtagggttgatcgcgtggcagtagaacacagcgaatgggaacctcatggtgtggcacgtcacggtgtccccccttaagcccgcgactgttcttaccgctaccaccttgtacatgtttcctggcatgatcccctctggggggacatcgggggagaaggcacggaggtcacgtgttccgagcacagacatagcgaactcaaccaccgactcgatagacgtggcacacgcacgttcttctcccttgatcgggcggtggtgctcacaagtgtccaacgccgattgtataccgtcggccatgacgagggatataggcgaaaacattgccagaatgtcggcaaagttctttgtactcactgggattgaatccgcaatgtcccggcgaagaaagggagcacgcgtggctatccccgtgatgtagggagtgattatggatcccggtttcaaggcatcctctaggaaatggaggtttgccttgtgaaaatagccattggaatagccattactgtaggaatgactatatccattaatgtagccgccgtcatatccgttgccataaacttgatcatagccattgccatgaacaccttgattaacatctgcaatgaataatataagcatgtgaatttacccgaaccattaatgtaaaatccactggtatggctggaaaaaaattcatgccattggattatattacagggtaaaatcccataattaatctggcatgagatgatggatttctattgaactccatagttttctctctcccataattaatcttgtactagttttttctctccctaaatcacaacttgtggctgtgaactttgcttgcgtccatactaaatggtctatggagttcaacaaatttatgcatacttattatccatcattaagcttgtttaggctcgatctagaaaatccggtttgtacgtaagtagcatcagggagagagagagagagagagagagagagagagagataccagtaggagggttcaaaagctcgagtatagctgttggcattggagagtggggaagcatcttctgccagtatgctgttaccatagatgcaggatttggcagctctacccgttccactcccaccaaatttctagcctctatcgcaacctgtgcaaatcatccattgctataacagattgtgatatggaacaccctatctgtggaatataatattgcgataattaattttcgcacctcaatgctgtttgtgtactcgcacacatgcacttcaatatattcaattaatgttaggtttaacgaaactaatttagtgttatgagagttactatatttgataagattaaagttacaaaagtttgagttagaaaaaaaagtcaaagcatataggggagggaatggtatgtacagtatatagctagctttgattgacatgatacactcaccagaaggatgaagatcaaaagtgacaaaaaggctgtcatgttgcttagcttcattgtgctatgagctaagctagcttagctaactcaactgaatgtgctggctagctagctgctccgttgcttgctttgctcttggctgccaaggctggtcctatttataagctcggaaacataccttcatttctcaatcttattaattaccatccgatgcaataattgcacttggcatcgatcaaattatcattttgtggcggcatatatatctgcttgtagattccaaattatcagttgtgtaggagaagaagtaactggtctggccattgataaattcaagtcattctatatatatgtcgcaaccttaagggtatgtttgaggagaagggccatcgagatgattgggaagatacgcaaaacgaggtgagctattagctcatgattaattgagtattaactattttaaatttcaaaaatggattaatatgattttttaaagcaactttcctataaaaaatttttacaaaaaacgaaccgtttagtagtttggtagtttaggaaacgtgtgcgcggaaaacgaaacaaacaaactcactctctcaccctctcgaacgctgcctaagtcatcactaagattgttatctattcattcgcgtgtataggttgccaaccgaataaacgccaaaacataaggcgctgtaactctgcatatatagctgaaaaatgtgctgcttcagtatatgcatatctgtagcttatttattttagttcaaatatttattttagcttttttattttaggacccagcaccgcccctccaacctccacttccttctgcccccccccctcccggccacctcccccacctcaccgtagaggagagggggggggggttcaggaggaagcgtcagatcttcctcggcgcggttcagcggtggccgcctcatcccttccccgacacggcggatgtatgatttttgatttttttttattcaatttctgtgactcaatttcttgatttgtggatttgtggtgctatgtgatttgtgtggcagatcgatgatggatgtgtgatctgtgattcaagctctttgatttattttttgtgatgtgggatggatgggtttgaatttctgtgatgtgggactcgtgagctactcaatttaagccgatgcatccaagcctcttttttttattcatggaatctcaaatgtgttggttcctaaaccggcaccggcacctgaaccggtacctatttctcctccacatcagtgttgcctgctggatgctggttgaaaaatctagcaaagaagagggtttcccaccggcaccaatacctttttctatactactgactagatttacttgagtttagctgaatacattgcttgctgctaattaactcaatccttacatgctttctccattgaagaaacgactcctcagggtgtgtttggttcacagtcatatatatatgggatatgttcattcatattttgttggatatggcaatccaattttttgtttggtttgtatgaccaaatttttttgtttggttggagggatatagcatgtatgagtaaagccaaaagttagtgggacccatttgtcatatatttttttctatcaaaatataatcatccaagatcttgttttaaagatttaattgtaacaaatataatggtgtaatcaaatcataaattagataaacggtttaagattatttggagcttgcttaacagaaaatcaaaccaaccacacccaatcagaataggacacattattcagaccaaaactggatggcttcttccagccaaatctgccggatacactcatccaacatattaagagaatattctatattccgggcggccccaaccaccctgccctccaaccaaacggcaccaaaaatcgggcggccatctcccatctaggctcatccacccagccaaacacaccctaaatccacaaagcatgcacacgtctccttgctctctctcccatggaatagagtagggccccgtttggggagcttaagattctgaagccctctttgtttaggcttaggtttattggcctagacttttaagtcagcttattggcttatatgatttataagccggtagatttaatgtcctaagtttagtggttgagtcatacatctacctcacataagccaaaaaagcttctccaacctagcttttggcttaatagtgttagagtggcttatggcttcaaaaaaagccaaacggaaaagctgattgtttgtttaggcttagacttttcgacttataagttggcttataagcctaaacaaagagggcatgagaatctgctggttggtagccagcttctaagaatctggagaagctgggttttccagcttctgggttttgattcatttcctggattctacaactacaaattgtgaactggttgggggagttggagattctgggagaaactgcagcagctaaaaactcctcaaacaggccctagatccttaacaatgtccgcaaggtacggtcattccggctcaccgcaagatgttggcaacccatttctcaaaacattaacactaacactttaattgtgcatgaacgccaaattatctagattgttttgccggccagccaattacacttcaaattagcagttgtgtaagtgaggaagaaactaactacgacattgataaataccagaagtcaaccatacatgacgctccagcagagtggaggaggaaatatatatattccattcccactgattccatatgattttgaaatatctgtatagaaagacctgtaatataaatagccatgaggttatttggaccgtttcatagtatagtggttagagggacccaatgtccaaggggtcaaacagtcttttcccggtaatttgtgagtgaaataaattaaataatgtgagcataataagcttaattggtagttgctctcccatggagttcattggagaactattgaatatttgaatgtatatagaactgacctgacaatgcacagtagagtagttagcattataggaaaatcatttttcttataacatgtagtacaattaaattccattgtccaagagaaccgttgacttctagactgaaccatcaaggagtactagctaaagagcacaataacatgtcaagttagccaagtctttctgaattgagcgtgagatcactctttttcttttcatttttatagtgctcctctggtgcgcgttattgtgttctaggacgtgtttggttgatctagctagatgtggtccaaaatacttaaaaaatgatctttatatacctctcatttattttttcaagtggtaaaaaaaatatgtttgtcaaaagtattagaggtgccttgtaaaggcttgcttgtaaaaattaattttcgtaggttagcctcttaagagagccgaagtgggcctcttaattgcctgcctgtcggtgcacacactacatggcccatgtgatgggagggatgggagggacggatctgcaacctccggtcataggagtggtgacttcgagcgtggcggcctccaaggcgtggatctgccgccaccaagcacgggagtgacaacaacgagtgcggtagcctgaggggtgtgaatctgtctcaatcgggcacatgagcagcgatgaggagcccgatggttccaagagcattgatctatcactgcctaccccgagagcgggtggatttctggccaccgggcacgggagtgggcaactgatgatcgcattggccttgggagtgacaacgaccgctgtggcatcggtggcgtggatttgccgttgcgggccatgggagtagtagacgacgagcaagcatcctcgatagcgccaatctactgccgctggccctgggaagggctaatctgtggccatcatcatgggagcggcgactgacgattgtcggggcctttggagcagcaatgacgatgatcaccgggcacgggagcggcacccacttcatgcggatggcataacgcacccgcttgcaaaaaaaaaaaaaccgtttttgcgtgcagtgggactgcctacctatgaaatttttaatttttacacacctgatagctggcgttgctacaccaccaacgaaaatatatttttgccgtttgtaataaacactgttatgtaacagtggcctagcgtgactttgtatcaccaaacttggcttttgtcctacttcctccgtttcacaatgtaaatcattctaacatttcccacattaatattgatgttaatgaatctagatagatatatatgtctagattcattaacatcaatataaatgtggaaaatactagaatgacctagaattacttacattgtgaaacggagggagcactttgcatgtgattagctattgtgtgtttgactacatgcgtttgcataagcctgctgaagatgatatatgtttgggagcacggtaaaatgtggtttgggagggaaaccacgcaaggaagggaagcaacatcatcgcgttttcgtcacccacgcgcgaggtagacctgcggggaacaaaaactatgaaagggggaacggacgatggagttgtttgtttattctcaattcaacatagttgtgtcctgttttaataggcctgattgacaagcttctaaatttaactccaaagagtagtctgaactctgaagcggagcggcccaaaaacctctctagttcatgttttcaaaatcattatagcatgtttaacttcccttttggataaatcggaaagtggagttaactagtgagatatcagcattttagctagaagaacgtgcaaatttttaagaaattaacgtactcctaggacgtcctagccaaggacaaattgcctgaataggatcttacaactgagtcgtgtggatggcaatataacacgcgcatttgtaaactgtagaagtagcttaaagtaaaaaaaaaaaaaaaactgtacaagtagcaggcctaaatttcattttggatggtgcacacgcgcaaattcatgaaatcgaagtttaatggccgaagctatgtcaagttaacgaactcacttcacttgcatatatagaataagttcactttaact

SEQ ID NO: 34842 - DNA, 14065 bp, Oryza sativa
agagcagttttcgctgacgtggttcattgacctagtctaaccagctgagttagtacggcccatatgttagtgactcctcttctctcctctatcctcttcaactctgaggaggagctcgcccccaattttgccaccgcctgggtctaaggacgccgacaacggaagctggaagccgagccattgctaggtcgtcgccaccttgctacataacacggccacaaacgcgtcttctgcatttgtgatcgtgcgatgtagcggggcggcggcgacctaccctcgccctagctcaaccaagggcggagctagaacgaaatggagggtggtgccacttgcttaatttactttactttagaacaagtttaagcagatagaggtgcctaagtttgtatcgagggaggtgcatacatggtgaagatagatgatgtataactaaaaaattttctttgaccaggttcctgggcgccctcctagtatactctacctctgcccctgagctcaacggcgcacatctctctatgggcaatggtggtgccctgccttgccgatgtctccaaccgttgtccctccgctcaagcatcattggcgttgacgtggtgtcccgtatgttgcaaaaagaaggttgggggcgaaactcccagttggcgattgatcgccaggattgatcggtttcccccctctcctccacgtggtttccttttcttggcaccgcattactttcctattttagtaaatttatacacctaaagtttatacacctcaagtttacacatctaaagtttacacacccaaggtttataaattaaaagtttatatatccgattcaaatttgaatttgaattcaaatatttttttatatatagtatttctatacatctaaagtttatacacctaaagtttatagacccaaagtttataagtcaaaagtttacatacccgattcaaatttgaatttgaattatatttgattcaaatttgaatttgaattcaaatattttttatatatagtatttctatacatctaaagtttatacacctaaagtttatagacccaaagtttataagtcaaaagtttacatacccgattcaaatttgaatttgaattatatccgattcaaatttgaatttgaattcaaatattttatttatatagtatttttatacatctaaagtttatacacctaaagtttatagacccaaagtttaaaagtcaaaagtttacattcacgattcaaatttgaatttgaattcaaatattagtttatagacccaaagtttaaaagtcaaaagtttacatacacgattcaaatttaaatttgaattcaaatatttttatatatagtatttctatacataaatttttccaacttttttttaaaaaatttatagtgtagtaggaagagaagaaggggacgagaggagaggtgtgtacagggggcatggggatcgatcgctcggagcgagcgatcgcccattagccacacccggttgggggtttgggggggggggggtggagaggtaagcaagagaggagaaagagaaggaggtgctgaaatgcaggtttcacatgctgactcagccaatagatcatatcaacgaaccatgtcagtaaaattcaccttcaaaaccactgagaaaaccattatgtatggttttaataattagagataaaaatatattgtattatggttaaatgatacgaatccaattggagactcaaagtagacttatttccatattgacctcaacataattcacttttgggcacatttcagcaagtatttttatcggtccattatttccaacaaaatttaagtccaaacccacgaaatttagttgcagaaaagaatggaaaagtccaagagaatccacgtcgcatcaaagccattgccacagacttctactatcccccgagctcgcgcagctcccgcgccagctcgtccacctcccgccacgagctcccgccttcccgcgtcgccgccgcagcctccccggcgagctccttcacccgcgcgcccacctcgctccactcgctagccgccgccgccgccgcagaggtcgcctcgaacacgcgcgccacctcgtcggcgctcggcggcaccgcgatgccgccccaggagaccggcacggcggcgcggtgctcgtcgacgagcagccgcgcgttcacgaactggtcggccgtcatcggccacgtcagcatggccaccccggcggccaccgcctccagcacggagttccacccgcagtgggtcacgaaccgtcccaccgcccggtgccgcagcacgggcacctgcggcgtccacccgcggatcaccttgcccctgccgcccgccgccgcgcgctcctcgaacccctccgggagcgccgccgccgcgtgcgacccggcggcccagacgaacgccgtacccgtccgctccagcgccgccgccagcgccgccgcgtgaggcggctgcaggaccgccatgctcccgaagctgacgtacacgacggcgccgtcggcgaactggttgagccaggcgcagaggtccgacgcggccacggcggtctcgccgccgcggttgccggacgcgtcgggctccggcgccagcggcccgacggcgcgcacgcgcatgaagcccaggtcggcgagaggcctctcgaggtaccgcccctcgagctgccggaaggtgttcgacacgatgcaggagctccccatgttcgagaggaagttgttcttgacaccctcggacacctcgtcgccggccttgtagaaccggtaaagcaaggacagctgcctccacggatacgacggagagcccgggatatcggggaagctaccgggcactcgtcgtcgtgctcgtcctcgcgcttgggcatcaggcggaacatagagtggagcacggcggtgccgtacacggcggacgaagagaacacgacgcgcggcacgccgagctcgtccgcgagcgcctgcgtccacccgcagaagaagtcggatagcacggcgacgacgcggtcgggggtgtcggccctggcgcgcgcccacgtccccagcgggccgcgcagccccgcgaacgcgacgatgagcttggcgaacagcgccggcccggaccccttggcgttctccacgccggcggggagagccgggtgcgacgggaacggcagggtgagcgcggacacggcgccctggtgcgtggcggcgaggagtggcacgagcagcggcgccgtggccggcgtgcagacgacggtgaggcggagccccctggaggcgaggaggccggcgaggtcgaggagcgggatgaggtggccctgcgccgggaacggcacgaccaggacgtgcgccgcggcggcaccgccgttggccgccggcgccatggcgggcgcggttggtggctactgctctctcgctctagtctgccgcgtggtagcaagtgacgctcgtttgcaagtagcatgtgcacagggatgtagaaaaccactgggcgagggctgcaagatgcaggtagtggactagtggtgcagatgacaagttgagctagaattttgctctataggctccaaaattgaccatccttattttcgtgtggcacccacaatataagtcgataacccaatatataccaaattaaggaagagtaaaaaatacatctgactcatctggtagtgtgaaaagacactcattaacagaagggactgaataaagtgtagaatatactcactccgtcacaaaatataatcacttttaaaatggttctaagtcaaacattttcgactttgaccattaatagtaaaaagttaaaaaagataaattatgtaaaactgatgttactagatttatcatcaaacaaactatcataatatgcaactctttttatttagatcatctcacctttatagatattgttggttaaagtagtatctcgaagactgtgttgaggtcaaaagatacttatattttcggacggagggagtacacatttagaaataaactacatatgtttggcagattgggagctatagagtagtaccactgtacttttctctatatatatataggcccccatcggttggcttttttttctaataagccaaaaaggcttattagggaataaaaataaatttgtaggtaaaacttttatatatgtgttctttgtaacttaaaagccaatgttgaaaaaaaactacgttgaaaatatctcaaaatcaacctcaaaattaactttgaaaattcaaaatttggcttattctttggcttattggatcatgcgatgggagccatattttttacgacagggatggatggtagtactcaatttctgactgctgctagacttcttgtcttgggataacaaatatcatttatattcttggacaaacttagagagcataatactctatattcatagatagagggagtataaaatcttgatagattatttgatagtagacaaaatatttttttaataatgattaatcaagcaaatgtggatactaatggaagatgacaagaaaccctttcaagactacaccaaccaaaaagaaagaaacattagaccaattaaaaaaaatcctttgatgtctacaccaaccaaaaagaaagaaacattagaccaattaaaagctagatttggttctgtgtctgtcacttcgcatggaaaactttggttcccatgggggaagagaacctgcaaactggcaacctgaaaaaaaaaagagagtaaaatacatcgatgatcctcgttatatatatcaactaggtctataactctaaaagtatgatagtatgattctagaatctctaaattgcagacctagttgatgtttaatatgctactatttgatggtaccatcttattcttcatcgaaatagagttgttcctttcttcaccggttgttagcaaactttccaattcactcgctagccctaaccaccaacacgtccagctagacttcctaccgcatttaatttgtttctcgactaatgcattctctttgtcctataaaaaccaagctagtactggatatgatacatcctagtactacgaatttggatatacatatgtccagattactagaatatgtcacatctaattttagattgtcttttttatgtcacattcagttttaggttatcttttttggacgaagggagtatgatggtgaggcgatgcacattgacaaggataggaaaggcaactaataccttcctatagctcactcttcccttcctatgttacatcatccattcatcctgcccagcaagtcagatttttaagctttaagggcgcgacgagcagatccagttaggtagaggagaaagagaaagcttaagtgacggcaagatccagttagatcaaggtttagttcgataaggtttgattaattaagtatgacggagctcgtggctcctcaccgggagaccgcacaggcccccctttgccagttcggccgggggcttagggtgaaatctcaagctctctcggtatgtggaaggatcgcgagccaggaagaaacgcgagacacgggcgatgtatacaggttcgggccgctgggaagcgtaataccctactcctgtgttttggtggatctgtgtatgaacaagtgacaaagtgtcaaccgccccccaatcgctctgggatcggatctggaaaaggcctcgagtcccaaaagtcctctccaaggaaaaagatcaaaaaatcctcctctccctcagtgggcaaggtcctccttttatatctcaaggggataccacatgcacctctccccttccaaactggactgttcttctcttcataaatggacggagaccggtacggttgctgtccgagtgcccttctgacgggacggctcatacctacccccacttccaccggaaacaagtgcgacgtgggattatggctgtctgttgatgatgcgaccagtgtcagaccggtcattcttgtcctccacgcgtcagttcaacaatctgcatgttcgcccttcttcatacaacatataggctgtaatggttgggatgaagcctggcatatatctgaccggggctaacgtgccatctctaagaggtaacacgctaactccggctagagacgagtgcctagaggctttcgtcttgacaggatggggcaaggcgtgcgtcagaccgccagtcgccacctaacccgtgatctgaccggtctgtgactggtcacagaccggataaaggaacgcgctgcactacgctgcatgcggcgtgacacgttcgaccagaccacaataaatgcggttaggtgaggcttaccgtgttcacctaaccccttcatgtggtgctaactccacgaggggtcggggcgcctcggccctcggggccggggcaggggtcaccccccctcggggaaatcaggaggagggcggacacctcaccctcgggcccgacgtcaacgaaggtgccaggccacgtgggcgattgtgtctgcctcaagcctctggtcatgatactcccggtcccatatcaccgacagtagcccccggcattatgccagggcgatcgccctcctcaagggaagcggtcgggcgtgacgccactcctaaagcctggtgacaggtgggaccggtctccatggttgggcagaaacccaacggtttcaaaccatgcacatcggtaatggtaacttggctgtccataatgggcggtctcttcaagactgccacatcacttgagcagcgcacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtagaagcgtgggcacgagaaacgagggagcgagatagtgggaaacgagggagcgagatagtgggcgcgagaaacgaggagccgggcacagcgatggcaagggtataaagatgccgaggaaaggatttgctcccttcctttcgccattattccccttgccttcgctgcttgagccctaactctttctctgctacgccttaccttcgccacacgcgctcgttctcaatcatcctttcctccggcgccatggcacggggctccgctctgctcgacggtagcgtactaccgccttctcgcatcgtgagcgagaggcatgccgggctgccgcgccgcttcatgccggaatctgccaccggccgggagatagtgatgctgggcgagggacgcccggcaccagactacccggggcggtccgtcttcttcctccccttcgcaatggcagggctggttccgccattttcttctttctttatggacgttctggagttctacgatctccagatggcgcacctcacccccaacgcggtgatgacattggccatcttcgcgcacctgtgcgagatgttcattggggtgcgcccaactcttcggttgttccggtggttcttcaccgtgcagtcggtgtcgccgccgtcggtggttggtggctgctatttccagccgcgggggccggtgttgaaccgctacatcccctgcgccctccgcaagaagtgggacgactggaaaagcgactggtgctacacccccctcgccaacgaagcgcgcctccgacttccaagccagcccccggcgcaagtctccagctggcgggcgccggtagatctgggggatggctatgacgccgtccttgatcgcctggcgggcctgcgatcccaggggctcactggggccatggtgtacggcgactacctccgtcgccggattgcgccgctccagcgacgagcccggggcgcctgggagtacttcgggtccgaagactacatgcggacccatcagggagccagatgggattgggctcctgaggacttcaagattgtagtccaacgggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggatcaatctaccccaggagggggtcgtgcttctgggccccgcgtcgggggctcggggagcagccgccctgccgacgcccaggggaagaggaagctgggaggaacacctcccccatctcctccccgagggggcggggcggtgcgtgccagcagtcggcgcccggagggggccgcgccgacatcgcagcccgagggggagcgcaagaagaagcggctccgcaagatgggggagacggaaccatcccggggaaacctgatttcccctcccaagtggtcatttaaccgaccccctcgcaggttcgtcccactcttattgcgaccgtctttcttctatcccaaaagcaagttttctcttacccatcttgtttgtcttctgttttttcttctgcttcagcgatgtcccgtcgcgttcctcccgccatcccaagtccggccagtccgaggccgaagatccagcggccgcagaggcgcggaggcgagaatctgaccggcgagaagccgcagatcgccttcgggaagctgaagaggccgcccgggaggccgcccgggctcgtcaagcggaggataccgctcgggaggaggccgcccgggctcgccaagccgaagaagctgctaaggaggaggccgcccgggttcgccaggctgaggcgatggcgtcttccgaggcagctcacgacaaagctgctggcgcgtcgcttgggcccactccctcgggcgacgctcaggcgacagcctccggggcggctcgcgacgaggccgcgggcgcatcgcctgggcccacttccccgggcgatgcccaggaccaaacgggtccgggggacatccccgagcccagcgcgtcctccggcgggccgagccgcgtcgcattctctccaaggcggctcttctcctcgtcttctgtcgccccgctgagcgccgagccccttctgcaggccttggccgccgcaaatactgcggtgctagatgggttcaacgcccaagtggaggccctgcgagcggagcgagcggagctcgaggccgcatgggcgcgtgtcgaggaggggcggcgctcggtggacgtcatggtggaggtgggccgtaaggctcatcgccgtcacgtctcggagcttgaagcccgcaaagcggcgctggcggagatcgcccgagaggtggaggaggagcggggggccgccctcatcgccaccaccgtgatgatcgaggcgcaggacaccctccgtcttcaacacgggagctgggaggcggagctgaagaaaaagctcgacgccgcccagggggtccttgacgccgccgccgcccgagagcggttggcaacggagatcgaagcggcgtcacggcggcgcgaggaggcccttgaggcccgagccatggcgctgaaagaacacgccggcgccgtggagaagggcttgacggtccgcgaggccgccgctgctatccgggaggcaacgctggcggtgcacgaggccgcctgcgccgaagaggagtccgcactccgcctccacgaggacgcactcgctgagcgggagcgagctctcgaggaggccgaggccgcggcgcaacggctggcggacagcctgtccctccgcgaggcggcgcaggaggagcaggcgcgccgcaatctggaatgcgtccgcgccgagagagccgcactggagcagcgggctgctgacctcgaggcgcgggaaaaagagttggacgcgagggcgcgcatcggtggggcggctgcgggcgaaagcgacttagccgcccgcctcgcagctgccgaacacaccgtcgccgacatgcagcgcgccctagactcatccgccggggaggccgaggccctccgtttggcgggcgagatagggcccggcatgctttgggatgcggtctcccgcctggatcgcgccggtcggcaagcgggcctctggaaaggccagacaatgacgcatcccaccaacctggaaggcctcgctccgcacctcacgaagatggcctgggctctccaacaactccccgaggagctcgagaagaccatcaagtcatcctcgagggacctcgcccaagaagcggtcgaactcgtactagcgagttaccaggccagggaccccaacttctctccatggatggcgctggatgagttccttcccgggaccgaggacgacgcgcgcgcgcgggtccgggatgccgccgaccacatcgtccacagcttcgagggctcggcccctcggctcgcgttcgcccccaactccgacgaggagggcgacgccagcggtgcagacgacggtgacgacgaggccggcgacccgggcgcatcggaatgagcccccaggcccccgccaatctccagtttttttctttttctttcttctaaggccttcatgcctcttttttgtatagatcaacttaatctgcaatcaaaaatgatgaaaaaattctttgtgttaattttattctgctatgcgtatgagatgaggatgatctgtgccgtagcccttttgcatcttagcttgatttaagggctcatgctcaagtcccagccctcaaatggttcgggtcggggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcgcaagtgaccttaattcaagtcaagattcttcaaaaggaaaaaacggcatagacacagcctttaggaaattgaaaccgcttttattgaaatgctgaaataagagaaataagaatgtgcatgtgtggtagcccccggccaaccctgcacacccgaggggggtgcggggttggcccgagccgaaacctgacacccgacccccccctctcaggggtagaagcgacgaaggtgttcgatattccacgggttaggcagctccgtgccgtcgcccgtggccagccgtatggagcccggccgggggacaccgatcactcgatacggaccctcccacattggtgagagtttgctcaatccagcacgcgtttggacgcggcgtaagacgagatcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcttcacagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccatgaatcgccgtgcttcttgagaatattgaaggtcttggttttaaggcctttgaggatttctgcgttggcgcgctccacttggccattgcttctggggtgggcaggtgaggcgaagcagagcttgatgcccatgtcttcacagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggccctcttaaacggtcccaggatatcgagcccccagacagcaaatggccacgaaagtggtatgatctgcagggcctgggccggctgatggatttgcttggcgtgaaactgacacgctctgcatcgccggaccagatcgactgcatcattgagagctgtcggccaatagaatccttgacgataggccttgccaaccaaggtgcgcgaggcggaatgggctccgcactcgccctcatggatgtcggcaagaagctcaacgccttgttcctgaggaatgcacttcaggaggattccgttagccgcgcgccgatagagggtcccttctatcagcacgtagcgtttggaaatgcgttggacgcgttcactcccttcgcggtcctcaggtagagtcttatctgcgaggtatgcttggatctcagagatccaagcaatcaatctaagggggcttggagcgctcccttcgggtcccgaggcctggactccgacgggcctcgggggccggtcaggcgcatccgtctcccctaaggggtcgggtcgcgccgacggctgggtaagcctttcttcaaaggcgcccggcggggtctgggctcgcgaggacgcgagccgtgagagttcgtcggcaaccatgttatcccgtctgggtacatgccgaagctctatcccgtcaaaatggcgctccatacgccgcacctggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattggtcgctcgaaagtcgagacggaccaagtatctgaggacgtctccgttcggagaggtcaacgtgacccccgcgccggcgccctggagagacagagaaccatcgaactgcatcacccagtgggcggtgtgaggcagctgtgaggagtccgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattacgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgtatccccggggcgctcttcgtccaagtggcctctcggggcgcactcgtcttctgtgctgatgacctcggggtcggaggatgacaggagcggccttcccacagtggcctcggggccgtcttgggggtcaggagctcctggcgtcgtcggacaagcgggcaaagggccaattccggtcgtcaggggcctcaggcctccgttcggctcgggggcctcttctccctgctctctcccgggtcgagtcagcacagggttagcctcggggccaaagggcgacaggtgcggccttcccgcagtggcctcggggccttcctgagggtcgggggcacccagcaccgtctgacaagcgggcagagggccgactccggtcgtcaagggccttaggccaccgttcgactcgggggcctctcctccctgcttgctcccgggccaagtcagcacagggttagcctcggggccaaagggcgataggtgcggccttcccgcagtggcctcggggccttcctgagggtcggaggcacccagcaccgtctgacaagcgggcagagggccgacaccggtcgtcaggggccttaggccaccgttcgactcgggggcctctcctccctgcttgctcccgggccaagtcggcacagggtgggggtgcgcggaatgaggattgtcctcatcgcgctccacaaccaacgctgcactaaccacttggggggtcgccgctaagtaaagtagcaggggctcatttggctccggggtgactagaaccgaggagagctgagatatgccttcaactgagcgagggcacgttcagcttcctccgtccaagtaaacggcccagagcgtttgaggagcttaaataagggtagcgccttctctcccagcctcgatatgaaacgacttagggcggccatgcaaccg

SEQ ID NO: 34843 - DNA, 17291 bp, Oryza sativa
gtggcacccgagaaatagaaggaaagggggaaggcgaacggcggtcttcggctcaccccaacacggcgaaggcggtggaaacggcggacggagcggaggaagacggcggcgcggctcgggatgacgatgacgacggtgctccggcggtcggcgggcgaagcggagcggcggacggggtcggcaaccactcggcgaagccgaaggaggtggcgcccagtcgggaggaggaccggagcgacgacggcggcgaaacggagttcggcggcgacggcggagggagaggagaacgtcgcgggcacgaaaccgacggcgagagcaagcggcgaacggcggaaacggaggagagaggcacggggagcaattatatagcgccgagagggggagagcgcggccggagagagaggaaaccgcgcgcggagatctcggctccattgaaagcgccggcgaactttgcgggaacgattccaaacggatccgagggagagagagaggggaaagagggggaatcgggagagggaaacgcggggagtaattcccctctctttaatgcgcgcggggacggcgggatgcggcgcaatctgcggcggcggcggcgctagggcacgggcgcggcggcggcgcggcgggaggtaggcgatgacaggtgggtcccacccgtcagcgagagtggcggccgggcccgcctgtcagcggcgcgcgcgcgcgcggggagccgatgggccgcgggagaggagagagagggagagggaagtgggccgagccggcccaagaagggaagggggggaaagaagacttcttttagggtttttctttttataaaatcttttcaactttgtttatttcttctcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagaacgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgtcaggacctctcccccctcgccgttgccgtcgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctcccagaagtcgccccgcccctcgccgtcgctgacgccactgccaggacctctcccccctcgccgtcgccgtcgccgccgccaggtcgccgtcgccgccgcacggacctctcccccctcgccgttgccatcgccgccgccaggtcatcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatcttctctggtagaagaagtgcacataccagatggtactacatccgaaccaaagtctaatactttggaacctcgtcgtataattccaaagttgatatcgacatacgacccaaaggagattgacaaggacaaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatctctcaataatttcatattaattacgaatcaccaaaatgctagaataaatattattttagctattcggaaattgaatttcgcatgcggtctacttaagacgcccgcatgcgaaaatagatcttcgcataccatcttcttaggtcgaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgcgagatgcactatgcactatgttatataccacagagatttctgaccaaatttgttccggcgtacaactatgttgtcttcctaacacgtcgacaccatcattgaaatgctggatgggattagcttcggctgagcggcgttggcgtggtcggggcgcaagacgtggccgctagcgctgcgtgcgtggcgcattgcaacgactgcgaacatagaaaaaataattaatagggacccaatacttaactcaccacccgtgcatgtaaaacggaccgatgtattttcttataactaattaagtatttattttttaaaaaaaatagattaacatgatttttaaaattaagcaactttcatatagaaaatttttaaaaaaaacgcatcgtttaatagtttgaaaaacgtgctcttatataagaagagaatgagttggaaaatgttgaggaaagaacgccaagccctattcgatctctcaggtgagagtattttttcagcatacgcaaaacgtgaaaactcattcgtatataatttattattaataaagtattaattatttaaaatttaatttttaaacaactcccatatagaaacactttaggtaaaaacaaattatttaacaatttgaaaagtgtgcttgaaattgagagtacgaggaaaagaactgaacctaatatgtatacgagatagttagctaggatttaatagtttcccaggaatcgtgggatccgatcgaggaaacatagggtgtgtttggatcctcgcatccctttatcctggctcatctctttcatctaggctgagtttagtctggctgagaggatacatatataggtgtttgtttatttgtattgatttaaccagggtagcatgagatattggtttggtttactgtaccggacggttcaaaagagatcttgtttgattgattgtatgaatgatgaattgatttttttttctttcagggtgagattcctacctagaactcactatttccaccgctaaattcatatgataatttttagagaaatttatgacggagcaaaagtacaataaaaatatcacagtgcttattactgtgtaaccaatggacgaaggaataaacataattcctcaatgcattcgtcggttcctcgtggtgcttattactgtcgatggagaaagaaagaaaaaaaaatcctcgatgcattcagaccctgcttggatacaggcactaatttttacccccgtcggatggaatatttggatactaattaaaagtattaaacataaactaataataaaatatatttcataaccctggactaattcacgagaaaaatgtgttgagcctaattaatccatgattagtccatgtgatgctacagtaaacatatgctaattatagattaattagacttaaaaaatttgtctcacgaataagctctcatttatgtaattattttttattattaatctacatttaatacttctaattaatatccaaacatccgatatgacagggactaaattttagtccggatctaaacaccacctcaatcggctcctcgcggaagaaaactcgccacttaggcggagtaatctcgccggctgttgcgccaggaaactcgacgcccaccacccaacgctccttcaccctcgctgctcaccaaggaatgtcgctcgctgctcgctagtcctcctcccacgtcgctcactgcccaaattgacgccgccgccccaacactctatctgctcctttgtggctggtggagcagagctcggagccactggatctggggccagcgagctcactgccgccggatttggcggtggcgcctcttgcagccgtggaagaaagagaggagcagcggtggccggggaaagtggaggccatcactcatcgcccctcgtcttcctgccgccctattatttgctgcagtcgtcggacctcgtggccaacatatccagttcgttggagttcaagaaggagggcggcagtggcaggcgaggaaggatggcggcggcagcgtcagagagtagaggaagacgatggcatggttgagcctcaccaaaccctcgtttttgctctttgagaaagtaatgacgaggggcgaaccgaccccgacgcccgtccgttgcacgtgtgggtgcagcctgttgcacgcgcctggccaggctgagttgtgaagctcgatttgagcgtttccgctcagcctggctgagttgctctttcactagctagtacttaaatgatttttctggacggggacacttataaacgattggaagatctgcatgcgaaaatcgattttgaccgcataagaaaatcgctatttatgcgtgcgggtggtacgcgaaaaatctgattttcacgtgcggggtggttatggccctgtttctttcagcttgggattattataatccagattattggaagtaagttgaaagaaacagacaacttattgaagtagcttattataatctggagcccagcttattataatctgataagctcatttaggtgagctttttccagattattgggtgaaaaattacccaccatgccaccccactctctctttagacttgcaaacccaataatctaggctctaataatctaggaaagaaacaactaactgcttattctactacagattataacaatctagcttatagtaatctaactcaataatctagattataataatcttaagctgaaagaaacaggccaatgtcgccgcatgcaaaaataaaaaaccaaaaaaaatccaaaaaaaccccttactcgcagtcgccgtcgtcgtcgccgtcacggtctctgtcgtcgctgtcgcggtcgtcgtcatcatcgcggtctccatcgtcgtcgccgttgctgtctccgtcgtcatcgccgtcgcggtctccgtcttcgccgtcaccttcgccgtcgtggtctccgccggatccgggcaggctactcgtgtttttgcatgggtggagccaggctgggaaggccgtgggacagctccattgtcgtcgtcgtctttcgtcatcaagcagcagaatagaccaatctcatcgtcggcctcttgcttcagcggcgccacggcctccttcggtgtcacctcgcgctccagccgtccgcgtggagacgagacctgcagcccttgccgctgcctgcgccaccccacacgaccccgtgtgggcgtgtggcatcgcgtcgactctccagacggtaccatcgcgaggcgacctgaccaaggcctacagcctgatcggatgggcaacgaagatgcatggttttgattcgtgtgcctccatggcgtgcatgcatggcttcatccaattagcgcgtcaggagacacgaaggagctgggacagtgctgctgccgttttttcttttttccctcttccgatgagagatcggtttgcgtcgcccacgccgccgttcggtttcaccgagatcaaggatgttgctgttttgctacaacgacattgtccgacatcactgtctaccggcatcaccaacgtcttcgcgccgtgatcaccatagtgtttttatttaagttctttttctttattttttttcttttggtcgtcgtgttttgttggcttttcgcatgcacccgcgcactctcgcacctggcaccacgatccctgccatgaaccgcaaccgcacactattatgtgacttgtgctgcatcgagatctgcaacgagtggctactacaactacgacaacttcatctccactacatcgactatggcacgtagggctatcatcgtgttgagtacccttaccagttttttctccagttcaactgaccgcgttgctcacgcttggactgtgggggatgttagagtatatggtagttagagtcatattaggataggattagtttatgtggactccttccatatctataatcctaccttatctcctcctcatatactcctatatataccagcccctgaggctcaatacaatctatccacgttatgcagtatatctctcctccctgtactatccaacacgactaacctttataaaaagtggtatcagagactagctagtccaacatctctggcctgaggaacatagtgtgtgaaggcttaatggaccgtggctgactgcgggaaacggtgaaggggcggtgagcagctaagggacaccaatgtatgaagggggatatatctcttgttgaatagtcccacattgattgtagaagggtaatggacctaatatataagtggggagcccctcacctcattggctagcttttgggatgggaaaggccctttacgatcctacaaattggtaccagagcctggctagtaccgatggttttggttctactaaggaagtacgtggagtagcacgatgcacagcacgatgcactgccccacgacgttgacgacgacacgcagcatccgaacgtaaaggagggatgagccatgatggacgaacagttagcagtcacacgaagcgcttcccgaaaactttattagcgcgttgttctggtgcggaacatcataagctagcgaaggttccgaagaactactctcccgatcagcggtgtactggatggcacacaaattatgcagcaaaacaaagccgtaaatgtaagccgtgtcatttgcaattttaaactgtttatgattttttttaaaaaaaatagaacttttatattggtatttcttttatgtttcccaattttatattttaaacaacaatataaaattttcagaaaaattaaaataaaatctcacagataggaaggtagtattagaacgatataaaagttctcaaaaacattttaaaaatctcagaaatagatgagataatattaaacaaccatgcaaagttctacgaataaacttaacttccatcactataaaagggtttttgcagacggctagatccagttttcgcatgtggttgacctgcccgtgtacgagaaaaggtctgaaaaaatcactattttcatatacgggtgcttatgtgagccgcatgcaaaaataaaaatccaaaataaaaaaatataatcagaaaaaaaatcacgccgtctactcccaccgccagccgcccgtatggggccgggctcctcccgccgctgccgccggatccgtgcggggccgggtgagggagaaccgccgcccgccgtcgtgcccacccctgcggccacccgccggctgaagaggagaagagaggagaggaggtggagaggagaagaggtgagagagagagagagggggggagaaggtaaggttgagtttgaaaatttttgaagtgttgagagggaaataggacacaagttagtcttctaggcggctccttaagaggtccgtttgcgaaattgatttctgcatgcggatctcttaacgagctgcatgtccgcgtgcaaaaatcgatttttgcaagcgggcctcttaagaagtcgtatgtgaaaatggaagtcaatttttgcagacgcggtcagttatgatttatctacaatctaacaaggggctcgtctggaaaaatcattttttatagtgttcatttgtgagacataaaattgagaaacattaaaaaaataaaaataggagtattgttatttgttaattctatatcttattaacaaagttgattttgtttatacaattttatggggttatttatttacatattaccaacaagtgtgagttttttcagattttttgctaacttctgtacaaaaaaagttctcatgttttcacctaaggtatcatttacatcgtatatatacattcccagtatatagttacactcaagttacaatatcaaaagttatacatctcccatctatccccgccattaaccccacctatcagcacatcaggataacagcacaataatcaataatgcaaggtcacaacagtcaagactttaggaaggagacgagaatgacagttgtccaatctgtcacatgttcatttggtggatgcggtcgcgcatagtgcttcaatgtagatgctatcaagaatagcatccacaactcttcaatgtagatgctatcaactggatgctaagtacaacgacatccaccttattttcacaccttacaaatcactatatatcttaaaactcaacatgtaaacatacaacatcatctttcatcttaaaactcaacatgtaaactcaattactcttttcgtaaaaataacattttttacatgttttccaaaatatctacatggaaatctatgtatgttttgaaaagctggtagaaagcattaaattttggaactgaaggagtattatattttaaatataatacaatcatatcatatcatcttaaatttattatattatagagcttaaaagtgacggggctagacttttgactatggggtttagaggctttcaacttaagtagaacagttggtaaacattgacaatcattgatcaactaacaaactatggtaagtatttattgaagttcaaatataataaaactagaaaataccatgcgcgttgcggcaggatatttgggaaacaatcgtagctagtttgttgaatgacactttggggaaagaaaaataaaaaagcaaaggcaacctagaaggattaatatttttttacacatcagcacctctatatactaattaaggatgaacttctgcaaaatgattaactcacatgtgaaactactacccaagccaaagtttgtactactgtacatattgagttttctgcgattttctcaataggaacaaagaaatatgaaattaatatggaattgagccttaaaaaatagcaaaacttcatgggaatttcgagaaatttagaaggtctcactcaaatatttattggcaacagacccatgtaaattacaattagcacgttcattgcatactataaaattacagaggaggatcgtcttttttttttaaggatctgatgactgcaaagcctcggtacctcgcggtaccgcgtctccggagaggaggtaccgagagattttcgatggtgggagggtataactgtactttcgcatatcaaattggaggggaaacgccacctccatccaccgtgctaggcgctgtccccgctgcaaatcaagcaagaaactgatgcggtagatgcggcggcctcccaggcggttcgtggtccaatccctatcgctggctcgagtactacccgatctcctccctcctcctcgatgctagtacagtggaggcggcagccgtggtggcaggcgtcggctgcggagacctcttggatggcgggggcggtggtcaggtgacggcgtctacttcagggcaacctcagggaattgttgtggttatgcaaggaagagaggaggcggtcactgccctgccctgcatcatggtacgaagttgaggccaacagaagacaatagctccacgtctaggatgaggcgatggagagatgaatgttctgaatgattgaaaattcttgttgagactggagaggtgacactggtggagaaaccatctttcgtcggtcggccgatttccacaatagtcccggatgcaataaaaaccggggctaaagatgatctttagtcccggttcaaaagggtaacgggcgtatttgatctttagtcccggtttgtgttaccaaccgggactaaagatcatctttagtcccggttcgaatgctgtcagggcctgtcaggcccccccgggatctttagtcccggttggtaacaccaaccgggactaaagatcccggtgatctttagccccggttggtattaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcttccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaagtttttataaaatagttgagaagaaaaactctagtgaaagttaatattaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtttgttggatttgaaggaaatcaaacgggcgaggaggaaatagctgctgatggtaacgacgttgcagatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaat

SEQ ID NO: 34844 - DNA, 3038 bp, Oryza sativa
atttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagctgtggaagaaggaaggtatccccgtgtgggacgaggacaaacaggaggagtttaacctacgagcgctgctgttcgtaaccatcaacgattggcctgcacttagcaacctatccggacagtccaacaaggggtacaaggcttgcactcactgtatggaggaaacagaaagtacgtatcttaagcactgtaggaaggttgtatacatgggtcaccgtcgattccttgcagcaaaccacccggtacggaagaaaggcaagcacttcgaacataaggccgaccaccgtacaaagcctaaacatcgcagcgggaaaacagtgtttgctatggttaaagatcttaaagtagtgtttggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagtaatagaagttcacaaacctaaagtctcatgactgtcacgtgttgatgacacaactgctaccagttgtaataaggggtatccttccagacaatgtccgggcaacaataacaaagcaatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcggtcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacttgaatcacgccatgaagggagactacggggaaagggaactctcggaaggaaagcaattatgacggtagacaacaatttattcggtaaagcccatttcactgttctgcaacactcttcattggtagctccttacatcgaggagcacttggctttagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataatggactagaggatttttaaaagttttaaaccacgcaagtggcaatttcatatgttaattacagttttttaacatttaatttactatcattcatatgctaattataattgactggagaatttctaatgtattaaatttaatatatatttaaaactatcattcatatattagagtttttcacaatttaatttactatctttcatatgctacttatatatatatgactattcgaatttttaaaaggtttaaatcatgcatgtggcatttgcatatgttaattagagtttttagcatttaatttaatataattcctacgctaagtatatatgatgattacaatttttattaattttaaatcatgcagtatgtacatacatatcttaattagagtttgtaccaatataataatatcattcatatatatgctaagtgtatatatatattggaatttttattaattataagtcatatatttgcttattacgatttatccacttaatttattacagacaaaaataatttttcgaagtaattgtcattaatctttgtactttaaatgttaatgc

SEQ ID NO: 34845 - DNA, 1018 bp, Oryza sativa
aaccacctccaccatcatcatcgccgcctaagtttaggtttggggatttctagtgtttgtgggagaagcgacgagtttgactgggtctagttcatctggaactagtcggggttaaatggtgtgacgccaatggcacttccgtcattttgaaatttctctctcctcttttttcctggaaataataaaatattgtctcggatatcctacagccaattatacaacttttatagtgtccatcggcagtgtcacgttctttacggtgtctcccagccaattacacgatttttggatatcctatagcaaattctgcctaccaattttagctctggaaagcatgccagatgctagtagtatttttctacgcctatacttgtcaagcactaaaaaaaattcttgggttatttaaaaggcaaccaagtaaactagccatttttctgtagtataccagagcttaaaagatgacggcaactcgatctactgtacgagtaaaagttcacctcctattcattttacatgacatggaagtatgaatataatgggaaattagatctacaatagaattcaattcgaattataaaaataaataacttgcaaagaaaaccaacaatataggttgcttcaactccatgtagtcaagaaatatcaacttccaaactaaaatctctttattttccatcatgcgggcacgttgttttagaagcacaacacaagactttggtactcgcggtagcatcttgaatgggaagacttatgtatgtctactaagttacaaatcacaccataaattcaagtcattatctaaagaaaactttaggttcacgtaccaaacgaaaactgaagatcaggtctgaactccaatacgtattcaagggtacacctcaattattgatagaaaacctaatattggcatgattttgtaggcactaaatccagctttggaaaatatattttcccattctttttcctctctctcaaccccatctatgtacatcatgtagagatcaaacaatacttgcgt

SEQ ID NO: 34846 - DNA, 14482 bp, Oryza sativa
aaaaatggaggtagcatatagccacatactcaatacgattttccctaaaaaatatacttcctccatttcaggttataagattttataactttgattaaagttaaactgatttaagtttgactaagtttataaacaaatatagtagtatttacattaccaaattagttttaaactaataattaaatatatttttataataattttatattggttaaaaatattattattttttataaacttgatcaaatttaaaatagtttgacttttatcaaagtcaaaatatcttacgacttgaaatactaaataaagatgcgacacaccttgagtagtacggcatctgccggcgggacgtactcaaacatgtcgccggcgacgaaccgcacgtcgccggcgtccggtggcgccttcctgaccacttgcgggaggtccagcacgctgcacttgacatgggggaacgccgcggcgacggccgccgcggccgcgccatggccgccgccgacgtcgacgagggagccaatcccgcggaacacgtcgccgccgccctccctgaacacgacctccatgacgaagcggctgtccgcggccatggcgtcgttcaggacggcgccgtacgcggcgtcccttccggtcatctcccacctggggaagccgtgcgccatctcgaacagcgacatcgccgcgccgccgccggcggcgacaggctcctcctcttcctcctcgtcgtcgaccctgaaccacgcgtgcaggctgaagaacggggtgagagccgtggggtgcacgagaaaccttagcatgggagacatgtcgtgcccgccgccggcgccggcgacgaggaggcgggacgccggggtgagcgtgtacacggcctcgccggaggaggccggctgctgctgcttcatggcgaagatgccggagacggtgagcacgcgcatgaggcgccgaaggtgcgggaccttagcctggcggagcgcgacgtcggcgacgatgtcccggagcgtggcggcgccgccgcggcggtggatggcggcggggatgccgagctcggcggcgcacttgagcgccatggacttgatgtaggagaagaagtggtggtagagctggaggtggccctggagcaactcctcggtgctcatctcgtagctatgttgtgttgtgtgttcatgcatgcatcgctagctatgcaaacaagcgtatttataaggacagacagctctctagattagattagtagtattatgatttgtttaattcagttttagattgttatattttaagatggatggagtcgtatatcatgatagtcgaaaatagcgtgggacttatgatcaggtagtagtaccgagctgtgatcattggttcgaaattttggaaattttgaatttttggaccccaccggtaagcacatatcttccccgaagattttgttttttaaaatatttgtggatttgactgataatatattcaaatttaatcaaaatatgttaaaatttccccaaaaaaatcggttagaaaatatcaaaattcatgaattttaaaaattttggcagccacataaattttggtgactaccgaaattgcaaacactctctgtgattgaaacagacaaaaaaagtagctatcgccaaacaccctaattcatttttttaagggtaaattggaaccatgccattataattttgcaaagtttgagatatgccatcggtatctcaatgacatgtaacaccctaattcgtttttttaagggtaaattggaaccatgccattataattttgtaaagtttgcttgttgccggcagcgacacttaacctagtacctgttattatcagctacccaacgtgtatgacctggtaaaagaatattgtattgtatttgttgtttcttacaggctttcctcccacattatggtagcactaagaggacaattaacatgggtatggtcatcgtctcccaccaatttttaatttaagacaacatcatattttctgctgtgtacctgctcattgaccatgaactttaactttgacctggttccaaaacaccgtttaatttgttataagaatcatcgacagcaacaggtggttaacaaattttatcgaaattaaaaagtataaattaaactaacactttaaatttggcctgcatgattggttgaaacaaactactcatgaattaaatttgaagtatatggatttatatcattccggctagctagtaataaaatttattcgaatgaaatttgacctgcataatcggttcacatctctgtatttggaacctttgcttccagcttcgacatttctaattaacgccgtcacttctactgtataccgtcaacattcacgcgccgccaccttcatcaaggcttcagtagttcagttatgcccggaagttgttataaaaatccattcccaatcatgcgccgtgtacttaaaaaaaactaagttttagacattgacaaagcctcaaaatgcacattgttattattactttcttgatctatatatttataaaatataaaagagtagtaaaagtacaattgcagagaaaaatcgatgttaactctacatggataaatttcacgtattaataattaatgatctaaggtatgaaaaatcctgaccggatcagctaacgtttatgtgttgtactgaactttattacaatatttagggataaagaaattactccctccatctctgaataattatagttttagttagtaaagggcatgtcaagaataagactaaaagaccattatacatttcattaatatggaggaaaaataaggagggagagaaaacgaggaggagaaatgagtactattggtttactggataaaaatgaggagcaaaagatgcagtagtcttctctgaaattccaatttgaagacaagttctcatcctaaaactacacttatttatacaatgactagaatagtaaccatagaattaaatgagttatcacgtaggataaaatataacatgtcaagtcagtaattgaagaaagaggagtaaagcgtgtcttacattagatatggtttctacacaatattcacaatatattgacagagtagtagtattaaattcgaatataatcagcagtactatttgtgttggaaaagtagtagtttcttaataatttggaggatataaaaatcatggctagtttctttttattgtgattgtccttagagactgaggaagtggtaatctataatggattaaatacataatagtagtatgaatttataaaagattgtttagtttcgtaataatagaatatgcatatataatcctataatatttaatagttgaggacggagtaaataattatggcaagtagcagccatcttgaccacatcgtcacctgaattcaagattatgtcgatgtccatttaactacgcctttttaattttcttcatgtccatgtgtcgacatctctgttttggaaccttgcttccagcattgacatttctaacgccgtcatttccactgcataccgtcaacattcaagcgcagccaccttcgtcaagggtccagttatgccagatggtcattataaaaatccattcccaatcttgtgccttggatttaaaaaaataacattttgaacattaacctagtctccaatgcatatttttattattactttctcaatgtgaacggaatttaagaaatagaagtttttactgtaaagctatatacacagagaatagatcaaaactattcctattctacgactatcatatactctcttttattcattctaatttattataccaatcaaaataaaatttagccctaaaatatcttgtggcatgtaacagatgggccacttcggcctatgtgttgcatgtacgtaacctaaacagccatctacccccgcaccttatgacctaacaaacttctcttctcgctagtgttgttgggtctcacgtgtcaagttggtggtggtggtggcagactcactaccaccattgttattggcttttaaagtagtatagataataatatcaaaaatataatttggtaaaatagtttcacatattaaattctaatatattttattaatcaatgatgtaagattttaagttttgattgcatgaattctaggttgtcctttagagaacaaagataaagggtggagcattgggtaggtcgatgttaggcgcgagccatataaaaatcgctgggagtactctcacctgtccagcattgccaagagcccgaaagcccaagaaaccatcaccatggacatgacgcaaacaaccgagtgggacaagagcataagctgtcaagggggagaaatcacctccttgcctcacccgcctctctgccactgtgccgaagaagccgagaggattcagatcctggtcattttaaaaaaaattattttacaaaatgaccactgaaaaactaattctaaaaaaaattcttttttgcgcatcggagtgcctggtaccgtcgtttaataaggcggtgccatcacctctcacgctgtccacatgccaacgtggcaccatgggggccaaccgacgttgatatggcggaaggagggcgccacgttagcatcggctggcccccgtattgtcacggtagcacgcagaggacactagaggtgatggcgccgctatgttggacgatggtgccaggcactccggcaaaaaaaaaaatcatttctagaataagtttttctagaggtttttttataaaataagttttaaaaaggactaaaatttaaaaaaatccagcgggatctagttgtgttgttcgggaaattagaaggggctctttgcagaattattcttgcatcagagtccgcacctaatcgtcaccacgctatatcagcactcagatcatgtcgtggttggtgtggattagtaagaccctatttaaatgggacttagatgggacttttaagtccctatcacatcggatgtttggacactaattataaatattaaacatagactattaataaaattcatccataattttggactaattcgcgagacgaatctattgagcctaattaatccatgattagcctatgtgatgctatagtaaacattctctaattatggattaattaggtttaaaaaatttatctcgcaaattaactttcatttatgtaattagttttgtatgtagtctatatttaatactctaaattagtgtctaaatacagagactaaagttaagtccctagatccaaacaccacctaatggatactgaatcgagtttaggggtttaagagttcaagcacttagatgacccatttacataaatatagaatttgtgtgtgcacttcactcttattatgacaccattgactttttacacaatatttaaccgttcgtattattaaaaaatatagtatgaatatgtaaaggtatgggttaatattatattttatttgatggtaaaacaagtgacccccaaaataaattatatttataattttttaaataaaatgaataatcaaacgttaggtaaaagtcaacaatatcgtacattttaaaaatagaggatgtattattttttttaaacgttgacttgttggatctcactagcatcccataatatcataatattaagagaacattattgtgtacttgtgtactcggtcccgccatgaacaccctcctcctttttcgttcttccttcgctactaatatagataagcgaaaacaattttaatcatctcatatggttccaacttcaaaactgtatgaaagatcctgattattgtttatgttttctgtaccgatcgttttattctaatattctaatatctctatccaaggcaagtagcagccttctagtgcttaaccatattagagtaagttttgttgaggtgatggtcacctctaattttatccatatcattttctagtagcatatacaacacattgcctctaatacacttatcccattatttatttttacttaatctattggtcactttctcttatcatctatctaggagcagtttgtgtaaaggttgctcattgcatgatcagtggctctttttctttctccccattgctctcttttccacattatcatatattatcctatttctttcatcctaaaatattagacataactattttttctcatatctcaaaatataacataagacgtgcatgcatacatacaaacattaacttaactatcacctcttgatattttaaatttagtttattttaaatcctctacgatcaaaccctcaatctcattgcttgcatctatggacatgatccaactgaggaggtgattaagttttttcttagttttttattatcagttactccctctgtcccaaaatataagcatttttagctatgaatctggacagccatgtgtccagatttatagccaaaagttgttatattttgggacggaggtagtattaagctttataatttgggatggagagagtatatggcatttggaccaagagctctctcatcacctgaatattctctccctctcaatataaataaatgtagttttagaagtaaggggagaaattaagagggagagaaaattacctaggtccccctagtgaacgagaagggtaggtagcgagtggatagttgatgtatgtatgtatgtatgaagagaaatttaaattagatatgattgatgggataaatagtactacatgatttacttattttgaaacaaaatttgaatataagaaatatatacttatttttggactttggggaagaggtagtatttttaaaaaaaaaaaaaaagtggatgtcatttgatacgctttttaattttcttcacgtgtacagagtacagactacagtgcacggcggccttaggacgttcgtcagttgtatccaatatttatttcgccgatcgtgacaaatacattgttttgcacaacaagataacgtttcaaatttagttttgatcactaattttaaacagtggtctgcatggcggctttcccatgtttgttgggaataaaagcatcatcatgccaaacattggcagccaaagttgggcttaaaaattaaaacatgtagtagtacatcacccaacaggtttattactactcgctcctcggtttgatttctcccgagttgattattcaaagctcccaaatactcgctcctcggtttgatttctcccagagttgattaccgattcaaagctcccaaatgttgcgttcatatttaacttctttttctgccttcggcttgcatgtcaaatcccattactcactcatattaactcggactcgctcacatcatcaggttgtttatcagacaacaggagccattgtgttaacacataattcagacaatacaacaggagggagccaaacgccaagataaataaacagatgatactataactcgaagaaaaccaattattcttttttttagttacttgctactatgccccctggctacagagtaaggtatacatttgcgaacaagcaaaatttgtggttaacacatactgctttgtaacgacattagcatgcagcttgagttcacttgccactgaaagaaaaaaaaaagctatgggtgtatgatctggcaagtttttttgtgctctatacaactgcagaaaatatttaataaaagaatcaaaaatgaaaattgatgggagccgtgaccgtgatcatggcagcaagatgccacctcttgctcaaaatggagattccagtggctgtaccaagacagatgatgcatacaaaaaggtttcctgcacctgtcgacgagctgcgttgtcacaccccggatcctcggctctgatcagaaacaattgctggccatgtatggattggcaattttgcgcacagaacaaacatcaacttctcatcaagcttgatcctgatccatgatgaattttgttgtagatggatataaaggcaaatgctcttactgtttgcccgcagtgtgcaagttgtagtttggttttgggaacaggtgctcagttaatgccattcaaggggttctgcctctttcttcgtttttcccttaggacgaccaaacattctcacgtttttaccagtcaagagcttcagtgcacgctcgagggtaatcttctttgggtcagcactctgtcatatacaattttcaagaaattctcaaattgaccctgccatatacatttttttaagaacttctcaaatttaccaaaacaaggaagcacacaaactcaatttgaaaaaaataatatgcaagtctaaagattttttttttttaaaagcaagtcagtaattgcaattgttttcaattagaatttatgaaaacaaaacaatagaacgagcataaaagaatgaacaatgcattgttcgtttctatgctcgttattatggtgtctgatatcaacattcaacagatacaatattcaacaaatacctttggcaaggaagcaagagttctcctgtgtctgatactaaatccagctttagaatgtgtgataagtacaggaagatcatcatcagggtgttttccctgttagacaacaaaaacatcatgggacaactcatcaacgtgtactaatgaacagctaaaatgttagacataccagaattttgggatactgcaatagctcgattgcatctttcagagtgatagagtcaatatctttcacctgaaataaagggtagccatagctaaggttgagttcttgaaaaggtcaataagatagatcattgctaaggacagggttgcactgtgtttaaaaccagataaagtggaagttacctcagaaagaggagctcttttcggtgatactccctttctatcctctccaacctggacgtagtggccataaggaccttgtttcaaaaacacctgtaaaataagcaacaaaagtatatcataaatatttgttacatgcaaaattacaaagcaggatagccgtagtaaatataccttttcatcagaatcaggtagcgctccaagtaacctaggtgtgaaagtcctttgagtttcatcagatgcttcagtttcatcgtcatcgtctgataacgtgcgagcaatgtacctacaagtttaattacacaatgtgtactcaattataattgagaaatgctggaattagtttataaacagcgctaaaatggataatagcagtgattatactcaatgaattgataatttctaagagaggaacagagggtcatacttgcatttcggatgtcgatcacagcctatgaaatagccctcaccatacctactaactttgaatcttagggttccttcagaacaactgcagatattgcaatcattttaagcacacgttatgcataaggattaaagatggcattgtagttatcggttaacaatgccatattaatatgtagtactccttccgtcccaaaaagagttgatttctggctattttccaggtgcatagctagaaatcaattctttgggacggaagaatatatagtatgaacatgtagatttcacaatatgataaatattaactctctactagaaaatagcttctagagagcgatgacatgaattacctagggcatatcctactatcattgtctaggtcagaaaagaggatggaaccgaatttttcttcaagcattctttctacctgcaacaaagtggatagctcaaatattgttctcaatactcaagggattgcacatctatatgtcaacagtttcatttgctaataactagaataaagatgcatcaaaatgattattacaggctgactaatttgtctcatttctcatttcgtagcccaacatttctcatttcttatgccaaagaagaaacattgagatttgcaagtttcaagaaacctaaggcaatgattacatgttacaaatcctacccatagaaaccagaatccttgtatttaataactacaaagatcatttgatggaatcaacaccggatcagcagaggcaacggatcatacgatcttgcacgagaacaggagtttgttcatgcacgaggtcctcgcagaagcactgcacgagcttcaggcatggagagccgcagggtcattaggtttaaaactttccaagatgatgaccagggcctgcatgcccaatccactcccttaccagctggctatctcgtgtatgacgacgatgtacaactttctatctctaatggaaatacatgcatagcttttgaatgttccccccaaaaatagaagggtctggtatcttaattcagttgctatgacttgacaaaagccaatgtgatcatgtggcaaaaataaacttatatgcatcatatggtaactagagcaagctgtaatactgttgctctaggatatattactctcctgttcatttttagagacgcagtttaactttgacttggtaaatatctcaaaattaaaatacaacaccaagatcaaatgaaagtgatttgaaatatgaatttaacgacacaacttttgactctgtaaacttataaagagagaaccatcgtcacttcaaaattacaaaatttgaacctttaaaggcaattgcaccttatgagaaatcaggagtgatttgcgttctacctgtaagggtaaacaaaattatactaggtatctaatgaataaagcagtacctttctgacgtcaaggcgactagcatcgccgcaatatttattgaatcgttcccaaaagtctttcagaaggcccttccattcagttgatccagcagagacattatctagctattaaagcagcaggaaaggagtattaatatgattattataccaataacaacattatcacattaggtggctagctcttcacaagaataggaaaagaagtttatatggtttcacacagatcaacccatgtcagtggaagtttgagtgataggaaaagttacaagaatcctaccgtttacatccatatatactggcatacctcattcaaaatgacaagaaaaaaacatcatcagtggaaacaacaggcctgacctatgatattgaccaacctctttttgtgtttatatatttcaagctaagcaattctaattttagcatattgacccacatctgtgggagtaactagccagcttaggctgtgttcaggtgttggtgttgggaactaatccctcgcgaacgcaaaacggagtgactcgttagcgcatgattaattaagtaataagtaatagcttttttaaaaaaaatggattaatatgatttttaaaagcaactttcgtatagacctttttgcaaaaaatgcaccattagcagtttggaaagcgtgcgcgtggaaaatgaggtatgtgagttgggaaaataggataaagaacacagccttatgctggtttccgaactcaaaaaataggaaagaagatgcatatataaactacaaactgaaatttgtttactacctcagtctccatgttagcagtaaagctgagatctgcaacttcagagaaatgatgcataagaaacgccgagacctgaggaagatggtaccgaacatttgtcaaaaatagaagaaatgaaataatttaattaattaaagttatcagaagaaacattgatgtgggaactgaaagaatggaatcacatacaaaaggaaaacataaactatggaatgcacaagttactcatcttgagaaaaatgacataggaagagaaaatagagaaaaatatccatgtggcgattgcatcactgaattacaaatgcctattttgcatccttgattgatcaaaatagataaaacatcccttacaacctaatccacccaggctttgtttgacatggcactgcttttgagattgagattgtgtggttacgtgtatgtttcatcacacgtgacatgcaaatcatccttcacttgtgggaccaaccatgttaagaaaataaaagcagcgaaatgggggatgtaaagggtcgttgtcagccaggtggcagcaaagagctcacagaacagtgacagccagatgaggcagcagagtcctgagtctagcatgctgctgcgggtgtttaaaagggacccatcacctgcagcagcagtgtgtcactatcagggaatctccgtagatggcaactttacttgttattagtcctgggtagcgcctacgctcacaagcgcagctctcactatagaactactaccagtgctcctacacatccatgtgaggcatcatgaagaaaaggcacgagacagtgcaggtagttgaacaggatgaagcggaagccacaagggtgaggattggccattggaaatgtgcagatatggtttctgctacaagctggtcttgtggatagttacgaaggcagaagcacaagcacaagcagaaagacattgtaaggtgatgtttgggctctattcaattcatataattgctagctagaatgctagatgccacataaatgcaccattgcctactataacaacatgattggggattgaagtttgaacagtttaactattgaagtttagaaaacttgacaagtttaggggctaatatgtaatttccttacaaaaattacacttctgcgtaatggattatatgatataaggacatattgtctttatttaaaccaatataatgaaaaataaatgtgataaggattatagatttattgccaaataaggctaaaaggaaggttaacatcaggaactataccatccgaccacgaaattcagggtgtagaacccgactttttattgtcacatatttacgatcctgaaaagcaacaggtaaacactgttatccatgtggcttgaatcattgctaattataataatgatgcaagatcctggaactttgcaactgtttattttgtccatgtgttctacaaaaacacaaaataattttcatcatctcacaaatagcaaagtaggcctgcttgatccattgctaacatttgaccccaataaaagacaaacatttgtgcatgtacgcttgacaaaatctgtatgtttgctaccttgcccaggaatgggatgggatgggattggatcccattcaatccctgtcaatccaagttggatgatggattcttggggctgagatgtttccttagccttaccttatttacggccatatattagatgacctagcacccatgtaacaccttagctacagtacctccttgatttctagattcagatcttatcttatgttacaatgaactctaaagcccgatcaacaatttacatggcagtgaactacaattgacatcaacattccagtcccagagcttaatgcccaggatgaccaacatataaactgaccccaataccccacgttagagaccatgaaaaaaaaaaacttccaatggattcgaaaggtccagggtgatgtacgtccattaaagtcctacagttaccagatggtctgtattgcatttcatggtttatgcatcactacaggagtagctacatgagcaacccagaaaaaacatgctgtatgcgcatattagtgtgttcaatgagatatagttctggagataacagagtagatcttagcaatatggcacctgcaatactttcattatagatgcatatgtggatggccttccaattccaagttcttctagctttttaatctgcaaataccaaggaaaaaatgatacattcttaaatatatctgataaaaaggaaatatatttctataccaagcatggaaatgcccagaatgaacagataaaaaaccaacatataggttattactgaccaatgcactctcagaataacgtgatggaggtttagtaaagtgctgtgaaagatgaacgttaactggagacaccaagtccttaacctgagaaaaagaaatgcaacagtaacatgcttatatagttgaaagacagacaacagtgcacattagcataaaaaataggtcatataggaagtgcatagttcaggtaatttgacagctgctgacctctaatttggacaaggcctcaaagttatcctggtgaacagcatcaacctcagaattgtaactggaaggacttgcttcagtgtcctaaaaggatagcaaattttcccgttactgagttaagcaagctaaactgaacactaggcacagagttcttaatagaaacgtaagtactgatcgttagatctccaaaggtaacatattttcttaatagaatattaaacataatgataatcaggacagatccatgcatctcagtgaagatagaatgctcaaatagaagctctctagataattaaaatggaggtagcaccatggcacaatctcgtatgttctacaaaattggcaatttcatgtatcaattactcataatagaattaggatttaggaaacataaaaatggcagaatcaaaagaaaatataggatcacctagtcagatactcagatgtgtgtatccaattctagcttagcagcgcatatgacagataatataactctttttttaaaaaaagaaaaaactagggtccacatcagcctaagcctaggacttatccaagttgtcccaggatgtcacatggtccatataggcatacatataaaaagaaacaatactgcaa

SEQ ID NO: 34847 - DNA, 768 bp, Oryza sativa
gaacgagagcgagaacgaacacgtcaacgggcgttgccgcgagaacgtgaacgagaacgagaacgatcgaacgaacgagagcgagaacgaacacgtcaatgtacgttgccgcgagaacgtgaacgagaacgagaacgatcgaacgaacgagagcgagaacgaacacggcaacgtacgttgccgcgagaacgtgaacgagaacgagaacgatcgaacgaacgagagcgataacgagaacgatcgaaccaagacaagtgagaacgagggaacgaacgtgaatgagaacaagcgaacgagaacgagcgaacgagaacgaggacgaacgttaacgtgaaatgcaatatatatatatatatatatatatatatatatatatatatatatatatgtatatgtatatgtatatgttacttcgcatttatcctaatacatctttttgtatcttgcagaaaaaacgtgttgtgggagtcgtccgtcaagcctgagtggaagagctagccctagaaggaattggcgcaggcaagtgacgtaataatataaatgattgttatatttgtaatgcaattaattaagattattagacctgtaattagacttatcatataagattgtgtaggtgttctaatattatttgagttttaatataagattactttatttgtaattagacttagtatgtaattattgactaccgaagtggtgcgacaagtagcaattgactattgtagtcttaattagacttagcatatacgcccgaaacacttagca

SEQ ID NO: 34848 - DNA, 4143 bp, Oryza sativa
  unsure (1)..(4143): unsure at all n locations
nnnnnnnnnnnnnnnnnnnnnnnnnnnnnnnnnnnnnnnnnnnnnaattgacaatgttgatatccatgtgattgtatagtgcaaatttagttaccaatatgcactatggtaccaacagtgagatcccatctcaaaaaataaagtgagatctgagagaaccatggttgtgttaatgcaagccatttgctgattttgcttctaccttaatttaatttattgccctaaagtgaggtatagtattattctgagacactagggtgcatctctatacagtgtacttgtgttcaacatccatgaaattggcaaattgctcctacacatgtcctcgtagtgcttgactttgttgaccctgtttaatatgaaagttcaaagtgtagaattggtgcattttcccccctttagacctaatgctcctggattatttcatgacattgtctaattgctgcatataagacttgaatccttagtactattttattaaactttgacgtcttgattttttttcaaaatgttgacagtctttgctgtcatgagcaaatgagtacgtacaaaagacaaataagaaaatattagctaactagtgataggaaatttaacttgaaattatatatattgataatcatcaggtattatatcttctggtaattgcaggcaattgatgatgattgcaaccaaacaggacaaatgctagctgggttgcttaattggccacaaggaacctttgcctcaaaggtgtgttttttgttactccttccattgctttttactgctgtcatgattgccctcgcatgcaagtggggcgccaagagcatggcacagcaggctgggctgggcttgtcattttaagttcattacttgaagatttgttctccccttctcatcacttccccccgtgcctgttaatcctctcctcaaacacagctcctggctggggagatccagggccaaaacccccagttacccaagggttgtcccattgatatttaaacctagacaaccattacctttaatttgattaccaaatgagttcttaacaatgtatttgctccttcaatttttttctgcatttaaatgatctgctcctagaccctaaaccgtatgaagctcgtgttgaactttggtatagtttctcccacaattgtggaattggccacataggaccttacagtttttttggtttgctcatttttgtccttctgccatgtggcgtcccgtgtggacttgtccagtcagcgccttctttccaatttagactatgcaagtgactgaaatgcgtgctttgcatcacctgaaaaaacaaataatgaactacatagggtcatcctacatcgatggtaagaaaaattagggcaattcagttactttatatagtttgtagcatttgaaggccctgaatattgcctgcccgaaccctggatattgcctgcctgagaccatctgtgatgtcataagaggcattaccattaaaacaagccaactaacgaagctcagggcgctaacataccaattcacagttgaatgaccaatttgagcaagaagcaagggaccaaatgaactattaatctttcagattgtggaaggaatttctgagcactgatggaagtttgctgttccgtttttttaatcccattttaggaacattaattttttcttctttcaagatatctgatttccttttgttggccgaacatagtagagcaaccaaaaaaaatcactgtaatggcgttttctatgggttcacattgaccaagtgtttattggttttctcttatcatggtgtttccaattcaagtttgtgttacacaggcagttgtattcaaagatgctgtttgattctggcaggttatattgaacaaggaaaaggctactgtggagagagaggtcgatggcggaatcgagaccattagcttggatttgcctgcagttatcacgtatgttccatgaaacatttattttctttcttttagttttatttaacaaggctagtacttcgattcttcataagcattgcgatcatttagtgatctctgtcacatagctggatctttgtattgcattgtggttttgagccaatttcagaaattgcctaaactattgtttgatttttgtgacagcacggatttgagactgaaccaaccaaggtatgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatagggaaataaagtgtagttataaatggtcatcgtatgcaaataaaaatgtggcgttcccgtatagcaccagtatacctgctaatggtcatcgaaatgctagtgtgtgtgtgtgattttaagaagccatgtaagcagaagtgttcactaaaatcaatcaatctttactcattcagaaaaaaagataattctatttatagaaataaagatctaggcatctagcacacgtatgatgtggtaaaattagtttcgtctccactagatatgccttgagctctacaactatttacgtttcaacctcgttgctgttgtttcgtgggatgtagtgctggcttggtaaaggtaatttggttcaaagctgaaatattttcaagttaataaatcgagaggacaaaaacattgagctaggaaagtgttcataaatgggaagtgtctgatttttcttttaactgaaggagctcatgggttgtacttggaagcagcttctcactaaagtcagagatataggtccaaacaggagggactcgtcctcatggacccatacatcaaaaacacacatcccaacttatataggccgtgtttatgtcccccttcaaacttccgaaaatttcgtcacatcaaatatttgaacgtatgcatggagtattaaatgtggataaaaaaaacaattgcacagtttacatgtaaattgcgagacgaatctttagagcctaattactccatgatttgacaatgtgatgctatagtaaacatttgctaatgatgaattaattaggcttaataaattcgtcttgtagtttacaggcgaaaaatgtataatttgttttattattagtctacgttaaacactttaaatgtgtatccgtatacttaaaaaaatttttgccaagtaactaaacacaaccatagtatattacattacatgagtcttatcaggttgtattatcagatcgtactaagtacatgaataaatgggagtgacatacagtttgagccgatctatacatactctcttcgtcccaaaaaaagataaatcctgggtttccgtgtccaacgtttgactgtccgtcttatataaaattttttttataattagtatttttattgttgttagatgataaaacatgattaatactttatgcgtgacttatctttttttttcatatttttttcaaataagacggtcaaacgttggacacggaaactcagggtttgtcttttttttttgggacagagggagtacaaaatatcactgaccccctggtggaagcagatcgtctgacgttaggcgcacaacgtcagagggacgtccagcgtcgatccatcgtccgatcgacatctcacggtgctgctgcttccttcgttccgcatcgcacgagcacggcgaggacggcccattcagcccatttacgagcaaccgcggagggacaaaaacgaacgagactgctcgtcattcgtcaatctgccatcgcgcaaaaaaaaagaaaagaaaaggcaacccccggcatggctgcccaccgctccgctgtggctcgcgcctttctcgacgcgggcgtgagaggagcggactgccgagaaagactgcttggacctcgccctcttctccatccctcggccccatgtcttcccccacgcgagagcttccaggcattgccgtcctcgacaacgacggcttccacagcggcggcggcggtcgcgnnnnnnnnnnnnnnnnnnnnnnnnnnnnnnnnnnnnnnnnnnnnnnnnnnnnnnnnnnnnnnnnnn

SEQ ID NO: 34849 - DNA, 9547 bp, Oryza sativa
  unsure (1)..(9547): unsure at all n locations
atctgccatcgcgcaaaaaaaaagaaaagaaaaggcaaccccgggcatggttgcccaccgctccgctgtggctcgcgcttttctcaacgcgggcgtgagaggaccggacttccaaggaagactgcttggacctcgccctccttttccatccctgggccccatgtcctcccccacgcgagagcttccaggcattgccgtcctcgacaacgacggcttccacaacgccgacgacggtcgcgcgagcgcaacgaataaggcggtcaaacgggctcgcggtcagcccatgccagtgaaaatggcccacaaacatcctcaatgtcgtgcgccgccgttcgttgctctgtttctggaggggaaaaagggcgccattatactcggatggagggaaaaaaaagaccattcggctgctgttcttacggcgatgaagatggtgagcgagcaacaagaagcttttctccacttgatcgtaagtctgcactagttacctatcttcttctatatccttcattaatagcttcttagaattcatcaaactccccttattaggttgccccccttgccatcaaagaaacatcagactaaagatacaaatcaagttctgccatctaactcgtgagatggaaggagataggtttgtaatacatctccatgctcgtgtattcttttcctttttgtcatatgtatgcactagtctcatatttttttatagagaaatgctagtaccatgttctgtacctcacattggaatggaattcaaaagtccagatgaggcttggatattttggcatcactatggaggtcaaaaaggctttgaggtcaggaaaaggtacacaaacaaaagacaatcggatgacaaagttacatcatttagatatgtttgtggaaatgagggtcatcgaggacaagacaagagggatcatctaacaaagtgtccctgagctgaaacccgcactgattgtcaagtccgcatgggtgtagtattggacaaaaagacggaaaagtataaagtgactaacctagttttggaacacaatcactccttgcacttgcctgaaaccttgcactttatggtttcacaaaggaaaatttcagatttacaagcttttgaaattgaaacagctgatgatgcaggaattgggccaaaggcagcacaagagttggctagtagctaagtcggtggatcacatagtcttagctatagccttcgtgatcgcaagaattatttgtggagcaagcggcaaagagagatggcatatggtcaggcaggtagcatgcttatgtatttccaggacaaaattgctgagaacccatcattccaatatgcattgcaaatggacagtgaagaacagatagcaaatattttctgggctgatgctaagatgataagtgactatgtacattttggggatgttgttagttttgatactacttttggaacaaacaatgagagcaggccttttggtgtctttgttggattcaatcattttagagaaacagtagttttttgtgctgctctcatgtatgatgaaacattcgactctttcaagtggctctttgagacttttctaaaagcacataatgggaagcatcccaaaacaatatatacagatcaagatatagcaatgggaaaggccattgaggaagtatttcctgcagcatggcatggattgtgcaccttccatatttcacaaaatgctgcaaaacatctatcgcaagggaataatggagaatcaagtattctttcagatttaagcgcatgcatgtatgagtatgaggatgtgacaaaatttgaatatgaatttaacatcatgagggaaaaggtgagcaagcaaacttggctagatagtatatacaagttgaaagaaaaatgggctaaatcttatatgaggaatgttttcacattgggaatgagaagtacgcaattgagtgagagtttcaacaatgacctgaaaattcatttcaaatctgattttgatatcattcgttttttcaagcattttgaaagagtggtgcaaggaaaaagaaatacggaactagcttccgaatttgattcaaggaaaaaattgcctagaatcaaaatgagggcacctatgctgctgcaagctagcaaggtgtacacccctattatatttgaagcttttcaaggggaatatgagagatcaatggcagcatgcactaaagcattggatggcgataatgaatttctagtatcaattaggagttttgagggagatctaacatttgaggaggagtacagagttgttggtgatccttcagagcagacatctatttgcagctgtgggcaatttaataggattggaatattgtgtgggcatgctctaaaggttcttgatttgatgaacatcgagtcacttccagcacaatatatattaaagcgatggacacgggaagcaaggagtggaatagtaacggacagcaagggaataaatataattgagaacccaatgatggaagcttcccttcgctacaaatttctatcccacaggtttctcactttggcccaacaagctgctagctatcctgagtgcacattgttagtaaataatacacttgacattcttagcaagcaaattgaagagcacctcagtggatgtgctagtacttcagatcaaagtgcaacccacaaggaggttatgcccccaaataacttgttgagtaatgcacgcctaaagaaaaaggaggttcgtgttagaggttcaaagcgaaaaagaatttggcttgacaaaaaacgagacactacacaaaaacgacaaagtaaaaaagggtaaaagtccaaaggtatgttctaagaagatattgcaataccatgttactattcagtcatgtgttcacttcatccttttacattatttggttcgaaggaacaaaagactaggcaaaatgcactccatgttggtgcagcaacacaagtggcagaagatagttttgctatggacaaggaggagcctggagaatacatgcacctaaatagcttcactcagcttttgacggtaatacatgcacctaaatagctatgaaaatatataataaaacaaccaatgattaatctttttctttgtaggggcagataaatgatgatcttttagttgacgatgcattttagtgatgaagtcatgttctggaggataacccaagtttggttgcaatactgtgataatacaagtatgatggagctggggaaaaaacatgagaacttttgtgtctatggttaattttgttttggcagatcctagtgaagcacttctgttctgttttggggttatcctatccaagacatactcttatattggcagcactcaatgatgtatatatgtctagctttcatttgctatcttgaaagcaaaactttagggacaaaatatgttcagtcattagatgtccaatgcagcaacaagtatcacattttaatgttcagtgttcactgtccaagactttctgccattgctatctgaaactctcaatctgattttgtcacaaataaaatgacccaattaacttcttcacattctcaaatgctcacaaaaatcagagtatcaaattgacattattatcacattcaatactgaatcacagtttcaattgacatcgattttcaatctcaattcagatattcccaaattctaaaacagagattttcgccctcttcagaaagctatggtggtgctgccatgcttgtcgcctccttcccatgcctgtccgggcttggcagcaacggtcgccctttctcccgtttttgttcggctcttgcgattccttcgacgtgggtggtggtgaagagcttggcgccgccgccgctgtggaagccgtcgttgtcaaggacggcaacgcctagaagctctcgcgtgggggaggacatggggccgagggatggagaagagggcgaggtcgaagcagtcttcctcggtagtccggtcctctcacgcccgcgtcgaggaatgcggcgagccgcagcggagcggcgggcagccatgccggggattgctttttcttttcttttttttttttgcgcgatggcagattgacgaatgacgagcagtctcgttcatttttgtccctccgtggttgctcgtaaatgggctgatgggccgtcctcgccgcgctcgtgcgatgcggaacgaaggaagcagcagcgccgtgagatgccgatcggatgatggatcgacgctggacgtccctctgacgttgtgcgcctaacgtcagacgatctgcttcccccgctggtagatttcaattatggctgtgtttagttcagcgtaaagtttgaattttggttgaaattagagatgatgtaactgaaaaattacgtgtgtatgacaagttgatgtgatggaaaaggactgtagtttgaatccaaactttggatctaaacacagcctatgactaaccattatttgcctgcgtaatattttactactactatgaggtatttactattttaaaaagtctaaccctccgatttagattataaatcgttttgaatttaatcaatcaaattgcttcaagtttaaccaagcttgtagaaaatggtttgacttcgaccaaagttaaaaccacttataatctaaaacataccaaagttaaaaccacttataatctaagggagtacttaataccagtttaccggaaatcgcaacactcaccattaccgttttcttatcagtcactaatatttcacattcaagaaccagcgaccaggggttatcggccaaaaaattctggcatgattattatacatttttttttacaaatccagacaaatacatcgcaaatatattgcaaatatgttaaacgatgaaaatgcaatcaaaggaatgagaaaggcaaaggaaaaggaaagaacaaagaaagcaaagaaggaaagaacaaagaaaatagctgtcaatggaataaattgaattattgtggtaaaatttttattttttggttctcgcaagattgactcccggctagggttccagcggttaccgctaaggatccaagattaacgttgcataaatgcaaaggtaagttattttggggtaacttatccttatctattgagagctacaaacataaataaatcatcatattctacaaaattctcacgttccataacttccggaaagtttacaagataacccacaaagccgcctccagaaaaacccttttactccaagattcttgccactaattatcatggcattttgtaaagagtccaggtatcgctgacaaaatgaaccgggaaaaacaggaaagggaaaaaaagaaccaagcaacgttttctaagcactactctacaattgaattagcaagggtcactattacttacacaatgtacaacagatctgacctgttccacctgtacactcaaaacaagacttaaacctaagcctaagaactccagaaatctagtttactcaaaataccaaggctattctaaccacgatcaaaatgtatgctaatgcatatctaactttaatatatctgcactagtctggaatactcctagaaattggaggaaaagttgcaggtttagatcactaggctgcctctcaaattcagaatgtggctgaccaaccatgagataaaaggtggcttgtcagcaccaagcatttcagtgcccttctaagcctannnnnnnnnnnnnnnnnnnnaatctatcagggtcagggctaaagagcgaataatcttgtatctccagatttgctaaatgccaattgacgaatccagcttgcaatgatttgacaacaaagaggataataggcagtatccaccattcattgtcttccctactcttaaagctgcacaagattccagagaaagaagagaccagcatatcagtaaagcagatatggcaaggtgcaggtttttccctaacatagctaaaagaacaattaagtcctgtgaattgccattgagaagacagttaaaagaaagtgtagaatatataatctagatatatatttaaacagtttttttaagagttcttttaacagattagacagaagacatactaaatccaaaattaaaaaaaaaaactacggattgagcttccatattcctttatcaaggtgcagaatatatgactaccacatattacatcacagatagagacaaaatcagatgtccccaatttataaaagattttggttaatgaatccaatttgaagaatgctatttattgtacaaaacaaaaggtttcaagttgttcaatttaaataaagacaattcaaataaacatactccctccgtttcaaaatgtttgacaccattgactttttagcacatgtttgaccgttcgttttattcaaaaaattttgtgaaatatgtaaaactatatgtgtacatgaaagtatatttaacaatgaatcaaatgatatgaaaagaataaataattacttaatttttttgaataagacgaatggtcaaacacgtaaaagtcaacggtgtcaaacattttgaaacggagggagtactattttaggctggtcactcattcaggttttcgataaagtgagtatgccaaagatataggaaaatgttgttggctattacccccaggaccaaaaacacacacaatcgtacatacaggaaatgaacattggagactagtcaacatgaactcatattacatcaattatctttctgttattccatgcaataactcttgggtgatttaaattcaatgactacgggtaactcacagcagcctatatatgataatcaggttcatgaaccacgaatccaagtatatggacatggtcacatctcctaatcaccgagagcatgcacccaacatccaaactaatcattcaactaatgcaaaaacaatgtgaaccttattatcatcacatgtatggctcatgcactcatagagaggaactgatatgctttccatggtccatcactactaaatgcatgcaggaagagacttgtgcacaaaagaacatgaacaagttaactcctaacagggactttcttaacctaaattatattaatttagatttggatataaatatatattctgttataaatgtattttgcaaactcttattattgcaaccaacagtggaaaattttggaaaggttggtagatctgtagcatgtagtctttcccaactagacatgccttgaacccacgatatgcagccacatgggcatccctaaatccccagaaatactgcctaatctcttatgttagttttgatgtgcaaagtcataggataatctggttgggaacatatcatgtgcacacaagcttcccgtgcacaccaactagcaaatgtcacagaaaattctacaaaaaattagacacatagtttcaatagtactacacctacatgtgcaatcttatcttcaaattcattatattttagccgtaacaaaaaagacaaaatcctgacagatttttacccttaaaactgtcagatttttcacttttttattacgactaaaatataatgaatttgaatatgagactttgcatatatgtgtaatactattaggagtaaatgtccattttgtagaatttttcgtgacatttcctagttggtgtgcacaggaaagttgtatgcataaggatatgttcccaagctagtttcctgaacattggaagtcaccttttctttatttggagaatgaattctggaattcaaaagaaatattagaactacaaaccttttagtgtttagtgcatgaggaacggaagacactgataaagaagacagcccagagtacaaagctccataaatgattgctacaatctgcatagaataaaaattgcatataaaatctccaccgcctgttatgaataattaagccataaaattgagtatatgaacattacttaagtaacaggatgcaaaccaactcttgttaggctattctgaaatagaactttgtaacaaagcataacagatcatgctactcatgcaataccacaaataaaggggttcttagacaaaccatgagaggaaaggcttacaatgtttatgacagaagtagtattccaaagtgcaaaaatacgggtcacggaagatctctttggtcctcggctgaaaagtgcattgagaccagcaagaaagggagacagcaaagcaaggggaggaataagaagtacagcaaggaatgctccaacagatatccaatagtactgcacaagcataagcagggtgacggaaaaatcacccagtagtataatacatataagcagctgcaaagtttcctgaaatattatagcatggttccagtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcggatgttcccttgccgtactgtcctcaactgagcattcaagcccgcaaccaatctgttccagatcgcagttgacacatactagagaaagggaatgaagtcaatggaaatgattggataataattttgcacttctacatagaggcttcagatatctagaatatcatatctagactgttcattatctaaatacagcatctgcatgctttactaggtcccaaaaactatgcaccaaacatatcttggtcagtggcaccaataatgtggaacaaagtgaactgtcctatgtgatgatataattggaagtttggaacaccaggaatgtcattaacatccctattaagttaatcttatttttacctggccaagaaggttagataacaatgtatcactgtgtaggtagtatggagacatatagcttccatcaccaccaaaaattaagcacatgggaaacctcttctggattgtggatgtaacatcaagtcgtttctcatcacccccgagaaagaaatcaatgtacgcgaccatcaagtctggtgtagaaccaacctgtaatgctcaaaaattagccatgtgctctcgttataggctaatggtctgtaacaaaaggtgatgcacctgctgttttgaaacacatccattcctaccactttttttttctctaaaatgcaggacgaatattcctaacacttcactactcatagccagaacatataggatgttgagttactacctccgtcccaaaatgtagctacctagtac

SEQ ID NO: 34850 - DNA, 30551 bp, Oryza sativa
  unsure (1)..(30551): unsure at all n locations
gtattagcaaataacatcattcaaggtattagtatttattggttatttaagctaagttcagatacatctttaatgtatcattaaaatgaaactctgctgaaattggctagtaagttagttcatactaataagttctggcaaaaatgctgctacatccacgtggggtataacttgattgattttaaacagcctacatattgtataaaaccaagaacgattactgttcattatggtgcaaaactggaccagacagttcttgttttgaaagttatcaccactgctggctctagcaccacataacattattgaattacaattactgaccttcaagcctttatagagtgctcgtgatctgcaagagcgaagacatgaatggtcatattcagatttaacgtactcttgaagacgatggattttctttcttctgcgccattgcttccaagaccaggcacaaggatatgcaagtactgaaagtatactatgtatagatccttcccaccactcgtatgcagccaccaaattgatctcatcgataaaacggttaaaagcatcttcatatctggcaaaaaaaaagtaacaagatatcacctatggcaaggaatacaaacaaaatactgatggagacatgaacattcttcggaaatatatatgacatagttgggatggtgcaagtaaaatatatgggactttacggaagatcgttattcttacaaattgcatgagatgggatggtgcagccgtgcaggtacattgtttggttggttatatagcatggtaggagactatctttggtaggtcatttggtagttttttaaatgatatgcattatattgcctgtagcttagttttttaacatgattacatgaatattcatttctgccaataagttcatgaaaatgaccaaaagattatttggatctttaaaggtatgtttttatatcgagtttcatctgtaacatcagtactaagcatgacattttgatctgagtctaatcattataattccaacttccaatcgctcataaagaacaatgcaattcttatgcaggtagtaaggtatgatgctagtagtaggatgcaatgtagaatgagccagctattaagaaatttaaatagtgtatgttttccctgttcaacattagtaaatagtaacacgtaaagtagctttttactatagaaaatgtatttacattgtgaatcattatgagatgaaataactataagtgatactctgctaatgtagattcttagaaaatcttacacgattccgattatagcatcagggggtgagtaaggaaggtgccaaggttcccggaaggtgttaggtcccatgaagtacattctgtgggcatggctttgtgtttcttctgccctgctagccccaggtacctacagaacaaatcagtgccaccatttatcgaaacaaatacaagcagaaagatttctttaacaacctgagatagaaagcataagtggtttctggacatcctttaaaatccaactgcactttgaatcagaaactattggagaaattatgaatttgtaaaaatcatggattgagcatttgactattgtgagttgacgtgcagatgccagatctagtgatttcacaatggggaaatatccagtgaaaaccatcaaataagtgaaaacccatgaaagccatgcccataagttctctaaatttagacatagatataggcattaaatacttttctaccaaatcgcaagtccaaatacagcttcatttgagaaataagacaaatttcaggtgaatagcgtcatgttactgttcacctgaaatttgtcttttttttacgcctaaataaagtttgagattcggtgggaatgtatttcatgcctacacctatctctagtaatcttttcataaatttacagaacttttaggtccagtttcacgggtttttacttatttgatggttttcatcgtatatgtcccctttcacaatagctctacattaatatttaatcgatcctaagattatgttgtatgaattgatacatacctcagccaatgaaagcaaaaaggggaaagaagcacagccatcattgtggattgcatttgttgaccggtatgtgatgtcactctcaccaatcttgactctgagagcacttaagacaagtgccaaaagaataatggtaaaagataggataattgcaaaagaccaaggaccaccaaaagtataaataagttcctcaagtggtgtgtaacagtttggcatcttgtacttagaagatatgcacttatatgggcaggacggctcggtaacaccacctagcatgtaaaaagttaatggttagtttctccaatttaacatcataaattttggagttacaaggcaattaaataattatagttccacataagaccatgtctttccaaggacctacctcttacatatatgaagtcagcgcggttaggaagactatccagagaacaaggcatacacagagatgaatcggacccaacaacatttttgtatgtaccgattgggcattcctggaatataatttaatcattactggttgcgaacaaactaataaaaagcatttgctagttaccaaaacaatagtacataaaaagaaactacctagttgcaaagtattgaccatatcaatataggatgttttattagctcatggatacagatagaaaacccggagtacacaatgaaatcctacatagttcagttaaaattaaaagcgtgtctgaatttgcaagtgacacagatcaacctggccattatgaactgttaaaagcataatataaacagaggtctgtgttcaactaactgttggttaagaactctgagcatcaagcagtagttattttggcaaaatgttgcttaagattatagcagtggcacagttatttgcagttttgcaccctctggggggcaaacagtttacgtagtagctgccatgcatcaccacaaaaaccattatttataaggaacaaataaccaccccatcctggtatttctggataagggcgagaaaccagtgtggcaacccaagttcaaaatagtttatctacgagtggtggtgatatcagaggacataaaatctcctctataacccctataattttcctctattcacatggagagaccaaattttggctcctattgcacacatctagcatgaggttaaccaacaggacagaaggacacaactatattctccctcttacatataagccttatatgaaataaagagattaaatttcttgaatacacacatttaaaataataatattatttcctatggattaggttattatcataacaggaacatgaagcaataaaggcacaatgagagaagtgctcatacggtgcaaaatgttccatatagtccaacaggacacttttttcctgttactgttccagtttctccaaaatgtccatcatcattaccagatcctccactatgcaaaaataaaaacaacaataaattttcagaatatttttttctaaattctagtactcaaatactttttgttctagctttgtcctaagtcaagcatgtatatctttgaccatcaatttttagaaatccgtatagttcaaaatatgagttgtatttattaaagtatttgtcagtgaatctaaaaaaaaatcatatgatgttaaaccatatgagtttttaaaaattgatggtcaaagatatacatgtttaaggacaaagctagaacgacaagtaatttgaaatgaagggagtaatacttttcaggatcaaagcaacacgcaaatttaattccatgacaaataaataatgggccatgcaacagcaatactagtaaaagcaggactatatcctgaaggtccacgaggatggtaataatagttgcattcatgaagtaagcatgcatttcgaaaaaagatgcacaaggttgctcaggatcactgatcatgtagcatactatctgtaggtccctgaacacaaaaactcaactggcaggacactaagcttgtagcgtagtgccacttgcaccattttgagtacagctaaaatgcagagattacactgaaataaagggataaccatgattttgagcattaattcattatgggaagccaaattgccacattgatcatccagcttaatagttgacatttttcttttgcaatagctttatgattgacattagtttggaacagctcatcagtggacatgtcactgtatctagttttgagacatgcatctacattagaaggcagaaactgattttatgatgacaaccaagcaacctcttttactatatgcagttatcaaatagccatagtttgcataccttgatgctactaagccgttgacagaagcaatctgaacatactcatccccagtagcaatatttgaccaatggaaatggattctaccaccaccaccacctcctccaccaattaaacctccattgccaccagaagctgatagtgatgagtttctctctagcagaagcccttgaagaaataacaggattgtccctccagaaccaccaccaatccctcctttatatgtcccattcgaattttttttagtgcctctatggctttcaccatcagagctcaaggagccataaattagcaattttgatagtggccatttcatggatccaacaactggattacgaaattgtcagatattagaacataaaaggaatacaaaaaacattgcaaagtaaatgcaattagtttcagaaaagaaaaggtgaattacatcaaagggtaaaatcagtataatatgcttatttgcaatgcattacatatgtcaagaatagaagaatggaaagcaaattgcattaactgtatatggggactcatatgatcaaattaaaaagcttgaaagaatacaaaaattcgcatggaaacatctaatatgagggtacaaaggatataaaagactgcaatataggattacaaacaaaagatggtacctaccaattaatcccccaccagcagtgttatcagttgactcagaggaaccactgccactccctagctcacacggaagatcagcactgccatattgtggacctccttcacttctcatcccattgtaaatccctatgccaccccggcccccatgcccagcaccaccaccagctccatatttgagaaacttccctttcccaatgccttccttgcaacctatcaaagaatccgaattgatgagtgcacaaagttataacattgataaataatgcattccagttgctttactgattacatcaagagaacacaagaatcacctaactctgaagcacttattgtgccattatttgtaacagtgacagttcttgctcgatgaatgtgaattataatccccctgactatgccactgacagttatgtcttcaacacggcaaatctgcaaaatgtgattttattaccaagaaggcagaagcttaaacacaatcagcacgcctcttactgctgcaacttgtcgagattcacatttacattaatataaacacaaatataacaataagtatagcactaatgtactatcgtttctatcagcacaattgttcacaaggaaatacataaatattagtgaaacaatcaatatacacgaacataagggtgtattttcattcagaagatgtccctccatattaaggctttgttcagcatcctgtgttggaaacacatctcttgcgcacggaaaacggagtggtccattagcgcgtgattaattaagtattagctattttgttttatttttttgaaaaatgccatgtgggcccatgatgttagtgtccactatatgaagacaaaatcccttctatgaccctaaaagtttagctaatcccttctacacccctgaattttgcttacttccttgtatacccctaaaatttgattttgatcccttccatgccccttccatcagttgactgtctaatttctataaaaataaccattttaccctttggatgaacataaaaatttacgaattacattattggaaatgtaaaagtttgtcgcatgagactattatagttatgagtttgatgtgtgacacattatttatgacaaaatatttttagataatgaaataaaaaatacgtatttattttatttttaaaagtcataaaaatgaggagcatacatacaaagataggactgcgaatgctcaccatattttttttatgaatgctcccgataaaaaaaatctattgttctattaaattttaaataaaaatttttatttattacatttgttttattttcaaaatttatgttaaaattttccgcactaattatttagtcccattttctacataaaatgcacatattctgcactcaagcaaaattttcaatcgttttcaagcttatattcaaacctaaatcatcaagggcattaaagacatttgccaccaacttaacggtgaaatgaaggaaaatgtgacggcaagggcatggaagggatcaagttaaatatcaggggtataaaagggattgagtgatttttcaggggtatacaggaaatttactcctataaatcaaatacaatgtgtataatttatatcaattgttcatcactatgagcaattgtgtagctcgacatacatgtacaagattgtaccaaatatgatatgatgattagagtgggaataattttattttgctttttgggctttcatgtgatcctgttgcaacatacgggtatttagctagtttgtacaaatatatgcaactattagtgtttgaactttgaaatctgatatttgccatttaatactcgtgtgttacagataatgttgtatgagaaaaaatgaataagttcaatgaaattcagaaaactggcataggctgcgttcttttctcagttcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggactagaactgagaaaagaacgcagccatagaatggagaaggttcatgttattgtatgaccatgaaatttgtagtgcatatgtcaattgacgtgatatgcaggtaaaacacttccataatcaagtagaccgtctataagacctatcatgttggacactgggatggaaatgattatgaaatacacaagtgtaatttaaagtccatttgtcacaaccctccactcagagagcgtctctgattaatcctctgttatcacttaaaatataaagctaataaaataaatgagctccagaagaaaagaatatcatagtgttaatgaactatccttacttgtagtgtgaatgatagagagttgttaacatggcaatcatcaggaggtgtgattagctcactggggcaagttttactttcacagcgtgaaagggcatccctgataaacacaaaagttattccacggcattatttaaaaagaaataaagataattagtttcacagtgacatgagatatcttacaagctgctttgaacagcatcatctagtggtgcctgaacaaatgaaccaggaccaacctgctcatagtcatataaagggaggttgttagtttcgaaaacaatcaaatggagaaaattttaatgaacacaagatggttcggtatgggcagctgaaaataaaaatgcaatgaataaactccaaaaaaatataatggcatagaattgagaatacatcaagttgatttacttgctagttcctagtatccaaagtaattgattcatcgctctaatgcagaatacgacagaagaaaattataccagtgtcattggcaccgaggacctatttgtaagaaaaaatatttacattttaacccttttcagaacttctttacaaataagtcctcgcaccagtgtcatcggcaccaacccccttcacatcagtggcttagcttccagggggggtgagggtatcggagccagcatcgttagcgagacgttggacctcggcaccagtaagtttgttttttcaggggtctatttgtaaaataagtttccaaaaaggactaaatgtaaaaaaatccagctacatctactgtctaattccatgttcttaaaccccaatctccttcaaagggcactgcgagttcaaaagaacagcgaaccaagcttacagaacgataaaaggcacctagttctagctaatcacattcttaataataggagatgtctaatcgtaatactaggttaatatattttgggatggagggagtagattatattaagaaacagctttaaaaatgcccctctggtgcagacagtctgaaactctgaatgcaacccagctcaaacatttactttgtaagttatagggtctttaagaaattataagaaactaatatatttgtgatggaatatagtatatcaattgtcccagcataatatgacttagtggatacctagtggaaagtgcatataaaatagaggtattatctagcatatacaaaaggtaatgtatagcataaagatacactgtaccacaaatgttacaaaaggatgcaattaatcttacttcaatgttgtaaaacagagagagaaaaagtcggcgtgcttttattccatcaccagggccagtcaagttaagaagtccttgcccatagactcccaaagcagcattcgaagatatgactgacccatgctgtagtagttacattaaaaaaaaattaaaattccacaactaacaaaaagttgacagtgagttttttttttcaaacaacataccctgagtacaacaaggtttctggcctcaagcatagatgcaagaacaacatccttacccccaccatctatctgaatctcagaatcccacatcaagagcactttcacatacattctgaaagcaccatagacctttaacaagaggtggaagttagaactacagaaaatactaacaatgtttgaatggagttgccatacactaaacttaaaatgctctatatagcagaggtgacagatccaaaagaacccatatggcaataccacataaggttcaactaataatacctacatttgatcaaaaataaaccttagctaatttatttatttttaatttaactccactgtatcaaatagcactttcatgtctgaaattgctgaacgtagggcacttcaccaacacttgtggagcaagtgggtgaaccacgtgaagtatctgatgctccctcacgtgtcaaagccatgttgggtaacacactcgcatggtaggatattgctactccgctttcaggagttgacgattctactgatagtgtgtaacagcaatgccacaagaagtcctaaataaaaaccccccctgtattgctgtgggaatttgcagggaacaattttggacaaaagatgataaactttgtacaatctgacagcatcgtgatgaatcgaattgcagttccgttcacaagtgggctctaatgcagcccaaacaggcctgtgcatttggctggcctggtaggtttagcagcaggaactactaaaaaccaaagtatccaagaacgccaagataaaatctaatagctcgcgtattcttgctgtggctcacctaagagtttctttatagcattaattgcagctagtgggtcacaactcacaaactcaattatatagaaatatagggaaaagattaaataaaattaactataaaattcatgccatagggtgtggagcaaatcagaagagtagcatgaactaacaaggtccagaatggtatttctataaaaaaatatgtgaaatgaaatccacagattactagtccctccacccacaaataaaggcattttaggttgtttatacaaaaattaggttaaggagaaaagactttggtgccccttattaaatgagggatggttggggatgggagggctgattgggggtgcgatgggaagaaattttaatgagatgtgattgatggtacaggtagtactctaggaatgcttatatttgtggacaaaagtcaaacacatggaatgcttgtatttgtggatatagggagtactatacatatatatttactgcaaacagaacgggacaatttgataggtgaaatttgggtacaaaattatgaattattccatgttatggccactgaaaatacagccagacgcaacagcataatccttgctctacaaagatgccacagttgcatccaaggcataggtcatactgtcatagagtatcaccacaaggcagaaatcctacagctcagatcaaatggtgttaaatatgtagttatgcaccacatataatttccatttgtcaattttacatattagcccgtcgagtcacttgacccctcatgtttcacatctctcaacaacttataaacactattttataattttcaacaacaaatatttacatacttcatttgaggtatcattgttgtttcaaaacaatataaagaaatttcatatctctttcaaaatttaaagatgtaacataacatttattagaaaccaagtacgagaatgttttttttgttgacataatttaaagtgtttcaggtaaatagcataattatatgttatttatactatcccgtagccggggtgatagcagtgccctgccccggcactaaagatgatatctcatagcacactataaaatatataccgagttggttaattacgtggggcttatgaatcattttggcaccatcaatgattgaaaagacatacctttataactgagtcactcattaaaagctcttctgcaaccagctcaaattctgatattggattttcagacaacccaaagctgatgctacccttgctaagtagtctaatttggcctgtgacctgataaatagaaaaaaggagagaatgtattagtggacaggcaggtacgcataagtggagatggtaatacaggaaacaataaaaagcagcacctcgcaaaataaaaataaaaagagcaggtaaaagggaacagatatgtgttttaagaactactcatttactggtgcttgctggatttcatagtttcattgtattctgaacttatacagatcactctgttgattcatttcctcatccatggttttcagatagaatagaaaagctggcttttgttaggttattgttcggttgtttgctaccccttgtcacattaaacagactagccccacgttatcaaagatcatacagcatgaaaatcaggcacaactgcgcatcaacttctttcatggttttatatgtatcaataatttctgtaaaaataattgtctgatggcccgtgtaatggaaaagttataattaacgacataaatataataagctaacctgaaagatagaaaggaaaaggcacataaggaatgaaaaaacataacagtagagtgagaagaattgccaaaaacaattattacatgtattgatactcttatgacattgcactatatgacaacagagggccaccacaagccaattcaaatagtgctactcccaggcacccatgtcacaacctagtcagagcatagcagcatttcaaatggtggcgtcaaaccaactcaaacatctggcaccacagtacaaccacattagcttgttactagagtgaaatggattggattagaccaatgggtatcctaacccacatttttttcccaaatttagaaatgggtacaattaagcataataaaattaaggtaggtcggagttcagaaatcggacaatcaggacaggtacatgaccacttcagataggaagcaaacaagtaaagcaagatggatggcatatgcacatatagagcaggatatgttgaactaaccagaacaccatgttttcaagccttcaactattaatcatgcgtatgtaagtaacatgtatcagcagcctgcacaacaaagtgacaaaccacacagcaatatgactcatggctaggtggcttaaccctcagcccggtgatctcattttcgactcctcaaagccgcaatactacttttggtatgagcaaaggaaatggaaatgagctcgaccgagctgattgaaaggtagtgatgggctggaataactaaaaagctcaatataggatatctgcacggattcagattcaggaaattgctatccagaggttttcttttttctcgaaaacgcaggagggctgcatttcatatcattaagaaggaagagtaaagtaaatttcagaaaactccatcttttatggttaaagttgcagaaaccacatgtattatggcttgtggcacataaccacaggtttatggtttaagtgtttcatataaccccacacttattcaaatcatattaaatttatcatatctgaaacattattctatactacttaaaatgttagtagtggtggtgtccgttcagccacaccacctcctaccactgatatttagaccccacaatctatagtattacaccaccctccaatgagttctctcccgcttcattgctggtttatcttaaacttcgaaatcacctacttattcaataaggaaaatcataaaagcattactttgactaaatatgtgcttaattgacttaataagctataaactgaatttgttccagagcaaagcacgggctcttagctagttttttaaagtagtgaagaatcgaaccaataaccttagtcaagaaatcaacaattaaaattttcatatagacatattttcaaattttatgtaaatcttcactcaaatttcaaattttgtgaaactttagaaccataataactgaggttatgtgccacaagccataatacatgtggttttctacaactttgaccataaaaggtggggtttactgaaatttactcaaaaacatatatacagagaagaaaaacagggagaaaaaaagggggaaacaacccctcctctcccaccaccaagacaaaaccaaacaagaaaacagcctccgtatcataagttggactatatgttctcatatccaagtccaattagttgcaataactggatatggtgtcagatcagaaggggactatctaaccactttaacccctccttgttacagacaacatggtttcatattttgttgtgctaatatttagaatcagattggcacaggccttataatttattgccaaatgtctttaaagggatacagggagaaactttaaaaatggatgttaatgtggtttacaagcaatagtaaagaacctcagcggacaagacatcataggacttttttagagggttagaatatcccaagggattgagcataactgcctaagctccttgcatcccaacaacacattaagtatgtatgttgctgtgcagatgcaatacaaaagaacatagagacatgtaaacaaaagcataagtgatcttcaaatcgatattaatgtcatcatgtgcagacctgtactctggaccacagcaatgggaccaagactttagcattacactccacaagcacattggaccaaagtctagtcatcgggaaacccagcaatggagtttctgtatgtgtggtgtagttcccattgctgacctttagagtctgcaaagaactttcatatattgtacctgctgcacctgcattctgagggcacccaaaactttgtccacctgatgaatgtgaaaaggaatattttccattacaggaaataacaggaggaatgcattacaaaaatgttatagaaggacaaagtacatgttaaatatatacaaaattcagcaccatgaatgggcgcaaaaggtgagaaactgagaactgtgtcagcttaaagagatgcacaaaattttcaaaagtggaaaaaggtcctaaccatggtgaattcacaatggaagaataatcaacaaaaaagttatagaattcgtattaagtaataaaattatggaaaatgaggcaaataaaaatctagttgagtaaattaagctattcaaatcatggaagtcgacatttctagataacgaccaactgaccatgattattcaaaatttccatttcaattgttcttttactttgctctacaatttccccaccctgctactaaactttatattgttttcactctacattctaaaagcgctgctaagctacaaaacacttactgacgcgaatataatgtagagttcacatgcaacgactctaaggcccatgtgctcaattcattcatatctagctcaagcactattctaaaacatggccacctagccctcctaagtgatgtatttcaacagaaacacatttctgtgatgtcttgtggcaaataccacaattttggagtgccttctggcaacttttcccaataaaaatacagaaaagcttttacttgcaatgcagctaataaagtgcactaattgagtgagttctgcaaatggcatactagcatcagcacgtcccaatgacaataactttggtggaaaaaataactaatgctagagacaaattaaccaatacgtgacccacatttctgtgatgtcttgtggcaaataccacaattttggagtgccttctggcaacttttcccaataaaaacacagaaatgcttttatttgcaatgcagctaagccaataaagtgcactaattatgtgagttctgcaaacggcatactagcatcagcatgtcccaatgaaaataactttggtggaaataataactaatgctagagacaaattaaccaatacatgacccaaaagaaaaaagaaagaaagtctgtagacagcaatgtatatcaattgcacctatgtcattctgtattctatagtttggccaattatgttcttctggggagaaacaacagtaacagatatcaaaagagctgcataaaaacaaatgccaaaaagtactcaccatgaactgtaatctccagatcttgctgaatgctgtaacagtccagagatatcctcccaccaccacctccaccccatccattaccaccagcagcacttatcgtaccatttccatatctaagaatggcattagaataaggagttggatctcacagatcaccacagaaagcatagaacagaagtatggggtttgattcagtaaaactcctaggggaaggtttacaaacagttaataaggataactttgtatttagaacaattgttaactaacagttaatcaagttgaggatgagtaataaacctattctggtcctatagggctattcaataccaagtgctgttgaaacctaaaccagcaatctcatgtggacagagcaatatcactggaaagcagatgagcatttttcatgttgctggaggtgcacagaagtcaatgagggtgggggagcgcagaggtggttgccatggaagaaggtaatgggatgcatggggataggagcataggagcacagagttggacgaaatctgaatcatgttataggggaaaatgacattaataatgcaatttggattaacaacaacttggattcaactttgagtgggtttcagttttctaaggaacaatattgtaaaagcctgtctgatagagcaaaatattgtgtaagataacattcaagtcacaagcagctgagcaaagcaattgaaccaaattgtatacggaatgaaagagaccatcaaacctacagaatacggctttccaattccttttaaaaataattccaactaaaacttctagatgcggatcaatccaatgctttatatagggaaatggcatggtaaatcatcaaaatgctctaaacatttctgagatagcactacctaataatgttcataagaaaacaactaagttgtcagtcggagtgttcagtttatttatctatatatcactcatattctaacattaagttatgtataaagttcaggttgttatgtggtaaagcaattcatagtagaacaggcgaaattcaaataaatgcagttcttacagcttgaaagcatatatcataatgcttcctccagacccgccgcctcctttgagactgcccacaccaccttcagcaagtacatcgccgtcgacattcatgaactcacttgccctgagcatgacacggcctccaccatctcccccaaactgatgatcagcagccatgctaccacccttgctgccgtaactccatggccacgccaacgtggaccaagcatacacatcacctccccagttggtgtcattggagaccttacacgacgcgccacgcccaccgtgcccccctccggcaccttcaaggctatgaggcgtcccactcgtctgcggagggggctctccggcaagcccggtggtgttgacagtggagcgttgatccagcgacacgtttgtcgcgtagagactaacggagcccgcaatcaaatccacgtgctcgccgatggtgatgctcccggagacattgatggcgatgtagcagccggcgacggggcagatgatcttcacatggggcgaaatcaccacgctcccgtcgccgtacacgcagaggtcgccgtccagcgaggagctggagccgatgacgcaggtggtgtcgaacgacccggacccgttcatctcttcgcacgacctcgacctcgccgtgtggctcccgcacgggaactccccccgcaccgctccgccatcgaaggagcgacctccggctccgcctccaccgccacccttgtcagcgaggaccagccccgacgcgggggacgcgccaaccaaccccgccaccgccgcggcgaccacgagcaccaccacccacaatcccacccgcctcatctccgcggatcgccccaaaacatagctcaacggcggcgggattcgcccgggggtggaggcgaggcgaggcgagggtacggatctcgcggcggatcgatccccgagccctagagcggcgaggcggtggaggagagagagagagagagagagagagagagtggagacgaagcagcggagtgttacgctacgctgcggctgcggctcgcgaggaggtgggggaaggaggagagagaaagaagagagagagagaatgaagggggatggtggccagctggcgtgatttgtgtgggtggggtcagtaatcagtccacgctgtgctgtttgcttgcttgatcacctctcttaccatcgtcgtcaagtgggaggattagaattaagcaaaagcgattagtggttagtagtcgtagtagtactagcgagcgacggggagggagggagaagagagacggtcgctgtcgcgtcatggtacatggcaccggtgtcttccatccgttccgtccgctgtcacaggatggagccgcggggccgacgctgccgtacgtggatcaccgcccatcggtttttttttctttttctttttctttttctgcggggcggttttttttctaagggttacgtatgataatgccacaaatcaaaccaccaaatgatcatatatatttctttatatttctttttagaccagcataaaaatatagtatatttaaaattcagataacacatgtacaaacggcctgatcagccatcagataacacatatacagagttaaagagtgtttgtttgagccgtttatttgaactggacagcttggtttaatggacacacgcaaatgtgatggatgattagctcatgagtcatgatcaattacgtgttaaatattaaaaaaatagatttatttcattttaaaaagacttctatataaaacaattttacataaaataattgttttgcggtatagaaagagtgtcattggaaaactagaaagttatcgttttgggttgctgaaaagaaatcggtctaaaagttatggtgaagtaaaaaccttacaccgtttctcaaaaggaaaaaaaagagaacctagcccaagaacccataagagaataatacgtgataagtgattttgtactctttgtcgaccaacaatattttaattcattgtgttgaaaaataacctaaagtaatatttttaaaatcggaaatgctagataccaggatatctttattagcgttcaagatgggatcctctcccacactcatgcgactatggataaaaatgacgtggagaacaccatatttcatgacggtcgttgcggcgcagagacaaccagatttcgcacaaggttgcggcatggtggcgcggtgggtccgttgccacaggtcatgggccttgccgacacgctgcacagctacctatgctggccgagggtagtggcgccagcgcgccgcgcagggcttggtcatcgtcgttaaaccaataggagaggtcccgcgcctgagaacatgtgagcttgggcatcagagccgatggacatgggttgtggtggcggttaggatggagctgtcattgaagtggatagacgcgaaacgaggaggacgtggccgccagtgacgagctccaacgtggggtgtggacagtggaagacctactcgcggaggatgcggccaccggtgacgagcttcggcgtggtgcctaggcagaggaggacctgctcaatgcgaaggatgtggccactggcgacgagctccggcatggtgcgttgacagtggaggaggacctacctctcgtcaaatacattgtcgcccatagggagtatcgtttgatacctcataagtatcacctaacagttcacaggaatcatttgatacctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatctagttcccaggatgtgcaatagattcacactttcatctcaagcatgattatacatagcaaacacaaataagatgaaagcgattataaactacatctactttagttacattagccgaccggccaaataaatatatagaacagcggaagcttgtctacccaatccacaagcacaccgactaggggtttaccccattaagttcaagtcctagaagaagcagtcgattacccgcatcactcaaagactaagactaaaacatgcaagcaaaagattaattcaatagcaagagtcagtacattattagaaataatgtactggcaagcaccaagacaagcctaacaccctacttgcaaggcatataatcaaggaaggcatgatatggttctttttagcataaagcaggttttatttgcataaaacattttcaaatcagatttgctttcaaataaatttcagcaagcaagcacttgacatattgggcatcaaagtagtcattaatcatgtataaatgtacacctcattgccatccatggcagcaaggagatcattctcaaatcttatcacaatttgaaggtaaatttcagcatttagaagaataaacacaagtttatactcaatacatatccacatgccgctcatgaccgcgagcacggctaatcgattagttttaactctgcagagtttgtacactttacccacatgatacgaaataataatcatgcaagagcatggcatgcgatacataagtacctgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagtttctcttagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaacctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgtcaatgtaactcatattccaagtagtattaggatatgattcctaaggttaggaatgagggagatggatatatgtggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgccttgaaactggaaaaagtcagcacctaaatcacttcttcaccgtttaagcaatcatctatacaatgtacacgttatgcaattaaaaacactgaaatatgcgaaaaatccaaaatgctctaaaatgcatgatttgtgcacagtggataggtactggtctaaaatgaatttatgtgaaagaatttctattttatctcatttcatttgagagttatgaattttagaagtttcgtcggtatagtgtaggatttacttaggtactattatgaagtgttgtcgtaaggtgattcttgttaagttcatgtttgttggggtgaagatatgtgtttttctaaaactaacacatttggtttcataatctttagagttaatatgaattctttatgtattttacatgttttaacgtgttctaggaatatagtctctatgtgtacatggcttgggagatttaggtccagaacttgctctaacttgctagtgatgtataaaatgagtattttagttatctaatctaatcttagttcataattttagagtttatattgttttactacatatttataaatagggatggtctatattagttacttataccaacctagaaattgttacacgagttaagtttgctaagtatttgggaattaatgctgcaactatgacctctctgatctaacaagttttattttggtttattcatagctaatgtgcattttaaatacctctatacatatattttgcttaaccatcacttggtgattaactcctaggttatctatttaaagattagagctataatttgtacaaaaggtgtcatattttattttactatgatgaaactcactatttgctggttctaaagaaacttagttcatttcatttggactaaaaatgaattttctaaaaattttacaaattaaaggctgctctatgttggttattccttacacgaatatttagaggcttttattacaaagtaggtatataattttattttataacttggaagtatatgctttggtgattcttcagaacttgggtttactcaaaaaggatctaagatgaattttatataaacttctaaagttcagtctatgtaaaactagttattttaaagataacaattttagaggcatttggtacaaagtaagtaattacttttattttacctaatcagagagtgcatgatgatgaatctgtataatttgagtttgtttcaaaataagttaaattgaattttctatgcattttataagtttgtatatgctttacgtatgacctaacttagataaattttagagacaaagtttgtacagtgagtgtcaagttttatattcctggaataaaggtcataactttgtgactctaaagcaactggaatcacttcaaaatgagctatatttgattttatatggattttacaactttggatgttttcctgttgaaattataatgcttagatgattttctttatattttccaatttttaaaagggatgggtgcactggtcagccctggccaatatgcaaaaaggtccctagggctttaggcaatcaacccgcagtcctgtgattgttctgtgtgtgaggtaggttttacaaaatagcacccagagttttgattcttctcaagtgaggtccttggtttgagctgatacagagcttgccatggccgagctcgttctcgagctcgccggcggtgaatggtggaaaatctcggcatgaaacctaaacagaagatgtagaggagttttgggcgaagctaatggtggtcttattgtgagcaatgttcaccggaatcaacggctacggcagcgcgagcggcggtggttcttgggtgtagagtccagatcctagcaattagtgtgcatgcatgtggtctcctagtttccagggtgctcaccgagggctcagacgaggtcgttaaggtcttggtggctgcgacggcttgcggatcattctagtggcggcgtttctccggggttgaacgacgtcggctcgaatggctcaaggacctgccatgcatgtgtgtccaagagtttcgtgaggtcccaaagatggtgtgtacacaaagaatcggactatagctcaccggagtggaaggaattgacaatggcgatggcgacgggttcagatcggcgacgaggaagaaaaggatgtgttctccgtgttcctagtgtctctggtggtgattcttggggtgtcttgaggaggaagcctaggcaatctttgcggaacagcggcttggctcgagatgaacgaggatggccagacgacgatgatgccgaagcggcggcgctccggtgcgtgctccagggcatcgtcggcgtggcttgcgttccggtggctgtgatgcacaaaacgaatggtggtcaacagagaaaatgctcggcgttgtgtggaaagatgggaacacgaaaaagatggaggtgaccttgactcaatcggcaattgcgatggtcgtctctcccgcggccggtgatgaagatgagagcagcggagaggcagaggacctactccctcggttccttcagcctcagagtgatgtgtggagttgggcgactcggtctggaggagatggaggcttgacttgaaggcgtcgacacgtcgtcaccacgcgtcgacacgctcgatctctccctctgtgttcttggtcagctgagggtgagggacagagaaaagggcaagcccaggtcactgccaagtgggtctaggacgaagtgctctaggtggaagggagaggtgtgggtaagattctgggcgaacacggttttggacgaattttcaggattatttctcttctccatctttgttaattcatatattaatttgtagtgcagaaaagctcatgtggattttactggagttatatgaatgtacctagttttcattttttttggttgtacttaaaaattatggatagattactcacagaaattagaagaaattgggccctttggatactagtttgaatttttaggagacctaaacagagaagataaattctgaaaaaaaatatatttattcatgataattaacctagtatttgaataaattattttccttatacacttccacgcaggtaaatgtacttttagacaaggtgtggttttagccaattgagaattataattaatctaatatttgactggtttgactgatttattcgaggtatcaaatttagttattaaattgtaccaaaattacagtgatatgtatttgttgagtagaacctacatgaatttttccatgattttatcttgcacaaattattttagataattagcaagacttatctcttgtatgcaaatgtatgtaaacatttatagaagttatatttggacctaaggtgatgttgatatgttagaattacagtttaccttacacatgtcataagcttcttacctatttatccataagtttactttagcattaaattaagaggatgctcataaaggtaattaagatagaatattttctatataagttaatttatttactaacttccatattcatgacatgctttcagatgaatagccaaattagtttagtgaggcttgacattagccatgttgatatattttaaggtgtatggcttctatttcgactctcctctatcccctagcactaggccctaatggtttagttgtttatctagatcttagttaatattgatgagacctattatgaaatgcaaatcgaaaatccaaatgcacatgaaggactcaagtcaaaacatgttttatgcgagtatgtatgcttacacataagtttacatttttgttctaggttataaatgaaaaagttttaattttccctccaattttattcatgcaagagttaaatcaatttcacctaggtttaaaaatggaaatttttggttcacaaaattgaagaactttgctttcaactagttttgattgaaattcaggtatgttacagatatcaacggatatcatatgctaccaacaggtatcagtcaatacctataggtctctcaagtatcactcgatacctggtaggaatcgcctaatacggagtacatgattggtatcacctgataccggttaggtatcaggacatgatacagcttagaggtatttggacttgatacctaacaggtatcattccgtccgaacgggattctgttgtatagcatccccttttagttggatgtatttgtaaaaaaaattctaaaaggttaaaatgtaattttttatttgtaagatagtaggaggaggacctatttgtaatacaaaatatttacattttgtagcccttttaaataaagaaaactattgtacaaataggtccttgtcgcaggtatgtttggtgatgacctctctacatgttggctacgaggggaatggtaaggtggtcggtgtcaacgtcattgatgccgaggaaagggttcacttctaaaataagtttttacaaagatttatttgaaaaataagtttttaaaaagaccaaaactaggagatgaatgaatgctctatccatcgatcgaacatgtgtcaattaggaagcgtgcgcggtccttccatctaggtccattctaagggcctatttagattggtgccaaaataaaccttatcaaaaaatttagcaatgccaaagttttggcaaattaataacattgtcaaaattttggtagaactggtttaataatgttaccaaaattcaatacacattgccaatatttagtaacaaactaaacatagccacatactacctctgtttcatattacaagactttctagcattacccacatacatacatacatacatacatacatacatacatacatatatacatacatacatacatatatatgtgtgtagattcattaatatctatgtgaatgtgggcaatgctagaaaatcttataatataaaacggagagagtaattattaattttaccaaataataatatggttgaaaatgtcatcaagaacatgccctaattttaccaaacctatgcagctttcactgtgactgtctctaaatatggaaaaaatttggtggagaccgggtgtaaccgatctcatctacagccctgctccggatggatgccacgtggatgacctagggattgaacggttagctcggccctgctcccggcactgcacgacgaggacacaagcggcttggctccatgagcacccgtgtctttcaggctctccgtcggctcgattttacgcacatcgcgtctcctttgcctggtgcgcagcgacctgcgtcttcctggggtcgtcctcttcctcctcctccagcaccgcggacgtcctgagactgacatatgggagcaccatggccaatgtgttgagctccaccactgacatcacttttgatgtgctctttgtactggtgttttttttttttttggcgatcggcttctagagtcaggtgctgtcgccggctgcttgtccatggcatgagaagaaaacacgcaaattaaaagtgtcataggatttgcatcagggagaagaactggaggcagcagggtcatcgtcgaagccgtaatcgatcaagtgttgcgtttcgtccgtggcggcctccaggaattggaagacgggtaccgtcgcagccagcagccaaacgcgccgcgggatcgatcgcctggcgctgcggctcgccaggcgaggagacgtggtctgcgttgaatcgagccgtcggcgaggctgaaagcgtctgcgcctggagccaactagccaagccatctgcatcctcctcgcacagcgcctggggccgagccacgtgatccattcgattctttggtagtccacgtggcaatcatccagtgcggagctgctcagctgctgatgaggccgattacacccggtctccaccaaatttttttcccctaaatatagacaggtccctcactccctctgccatgctggtcagcttcaaacgctcatggcctcttaagcgcgccattaaaactaacactacactgtctacacaccaccgcgtaccacttctcccccttcaccgccaccatgcgctccccgatccgacctcttctcctcctcctccccaccatcctctccgccctcgatctcaccgccgccgccgcggacgatgacgacaccctcaggacgtacctggtggtcgtctgccggatgaatggccccaaggaaggcggcgagccgctgcgcgcgtggcacgcctcgctgctcgcctccgtgctcaacagcacaaccgacgcgatcctctacggcgctggcgccggcggcaacaggggcgcgccggtgatcggcggggagagactggtctactcctaccagcacgtcgtcagcgggttcaccgcccggctcaggccgcgcgaggcggcggccatggcgaggctgcagtggtgcgtcgacgccgtcccggactccacgtacaccctcaccaccacggacacgccgcggctgctcggcatgagcaccccgcggaccggggcgtggagcgtggccgggaacatgggcgacggcgtcatcgtcggcgtcctcgacaacggcgtcgacccgcgccacgtctcgttcggggacgaggggatgcggccgccgccggccaagtggcgcggcaagtgcgacttcggcggcgcgccgtgcaacaacaagctcatcggcgggcgggccaagacgctggaggaccacggcacgcacacgtcgggcaccgccgtgggcgccttcgtcagggacgtcatggtggaggggtccaacctcgggatggcctccggcatggcgccccgcgcgcacctggcgatgtacgaggtgtgcctcgccgacatgtgctccgccacggagatgctcaccgccacggagaggggcgccttcctagacggcgtcgacgtgctctccatctccgcctccgacaacaagcagaagcccttctacgacgacctcatcgccgtcgggagcttctccgccgtcatggcgggcgtcttcttcagcaccagcgccgggaacgccggcccgaccgccgagacagtcaccaactgcgcgccgtggcagctcaccgtcggcgcgagcaccatgggacggcgcgtaatctccaaggtccagctcggcaacgggctggtgatctacggcgaggcttccaggaggtacaaacgcgtccagaacaagccgatcgtctacgtcggcggcaggttcgccgacggcgcgctgaaggcggtcgacgtccgggacaagatcgtgctctgcaatcgcgtcgaaagtgcagccatgctcgagaagatggtcgccgacgccggcggcgtgggcatgatcgccatctccacccagatgcagttcctcgcgacaacaccactcggcgccaacttcatgcccctgtcgcgcgtcagctaccccgacggcgagacgatcaaggcgtacatcaactccacggcgaaccccatggcgagcctccgcttcgccggcgttgtgctgaacgcgtccgcgctgccggccatcgccgagtactcctcgagagggccatgcgacctgcccaacatcggcgtgctcaagccggacatcaccggccccggcacgaacatcgtcgcggccgtcccggacaagagccccggcgcgaacgccaccgcggcgcccacccgcaccttcagcgcgaagagcggcacgtccatgtcagcgccgcacctcgccgggatcgcggccgtgataaagaaggctcacccggagtggtcaccggccgtgatcaagtcggcgatgatgacgacggccgacgtgacgcaccgtgacggcacgccggtgatcgacctgtcgacgggcgcgccggcgagctacttcgccatgggcgccgggctggtgaacccgaccaaggcgctggacccggggctcgtctacgacctcaccgccgacgacttggtcccctacatctgcggcctcggctacaacgacagcttcgtcaacgacatgatcgcgcagccgctgaagaacgtcacttgcgccaagtccaagaagatccaaggcaaggacctcaactacccgtccttcttggtgacgctcaccgcggcggcgccggtggccacggcgaggcgcacggcgaccaacatcgggaagcagccgctcgaggtgtacagagcggaggtcgtcgcgccgccgggcgtcgccgtcgaggtggtgccgaacaggctggagttcggcggcgccgcgctccagaggagggagttcaccgtcaagttcacgagaggccgcaacgccgccgtcaatggcgcggcggagggcagcttgcggtgggtctcaggcaagcattccgttcgaagcccgctcgccgttctcttgaagccatgaatggatcatcggttgtagggttagcgatgatcgattctaaataggatcattagtggaagaaaattagatcaaagtatgcggttaataagatcgccttgtctaagctctctgtttggtgtttgctatataaaatcagtttcagtaggcaacttttgtgtgtgattttcattttaaaatccacaaatccatggactagttaacaaggggtatgtgagttgcattatcctaatttcagtttttgcttcacaaaatttaggcagttcagaaactattgtcgtaataattaaacgctaaagcacacaaggcattctgaagaaaactataaaaggagtaaagcattgtcagttgttttcagaagaagtaatataatgtaccaaatattcagaatctcaatccttgaaacgttgtcagatgttttcatagtatgaagtatcaagaacaacatgaactgtaatctgagctggtaaaaatatttgaatgttacaacatattgagagatctctgtgagggtttcagatttcagcttcactctttgagagtttcaggaacaccgcagctagcgtgtacttgtccaagagcaagataatatgttgtttcagctcaaattgcctgattaaatatccaaaactttcatgaacacgtcataccagcccattataacatacaataccttcatgaacacaatgaaatcaaccgtcaacttctgcttgaaattgttaaggtttttagtccatcagaggccaaacaaattggagacaaagcactaaccatcataaaaaagtagtaatgacaacaaggttgctgcaacctaaaaacttacaatataaatcacaagaactgggcagtgttggaaattaatcttgttgtttacatttttagttattttttgtatttgcattttgggacaaggcagaagtgtagtatgtgtagcatcattttagataatggaagctttatttagactcagttaattacatcaagatgataaaatcaaactgagtcacccacggcccctgcataaaatgcacacagccaaaaaagaagaaagaaacaaccagaacatttcccaagtacaaaagtttgatagaaacatatatcttagtggctatcaatccatagactagacagctacccatgctcctgggtaaaaaactcttgcgccacctggtccaactgtcgtgataccaccgcaatagtatcccacagtcccggttggtggaggatagcccaggtacggagccaccgagtaactaaagtgataacctgcaaaggagaagacaccatcttgttattaaaaattactccattcctgcttagccaaatagaccaacacagagttgttgcacccataaaaagcagattcctcatgtctttggggacacaagatagccaactcctaaacatatgacaaatattgcgaggaggttttaaattagaagccaaatgaactacagaccacaccaagcgagataagcaacactgaaagaacaaatgttggatggtttcatccttgtgacaaaaacaacatgtcttgctacctttacaatttctcttagcatggttgtccttggtgagaaatacgcctcgacgcaacnnnnnnnnnnnnnnnnnnnnnnnnnnnnnnnnnnnnnnnnnnnn

SEQ ID NO: 34851 - DNA, 7082 bp, Oryza sativa
  unsure (1)..(7082): unsure at all n locations
nnnnnnnnnnnnnnnnnnnnnnnnnnnnnnnnnnnnnnnnnnnnnnnnnnnnntctctgtgagggtttcagatttcagcttcactctttgagagtttcaggaacaccgcagctagcgtgtacttgtccaagagcaagataatatgttgtttcagctcaaattgcctgattaaatatccaaaactttcatgaacacgtcataccagcccattataacatacaataccttcatgaacacaatgaaatcaaccgtcaacttctgcttgaaattgttaaggtttttagtccatcagaggccaaacaaattggagacaaagcactaaccatcataaaaaagtagtaatgacaacaaggttgctgcaacctaaaaacttacaatataaatcacaagaactgggcagtgttggaaattaatcttgttgtttacatttttagttattttttgtatttgcattttgggacaaggcagaagtgtagtatgtgtagcatcattttagataatggaagctttatttagactcagttaattacatcaagatgataaaatcaaactgagtcacccacggcctctgcataaaatgcacacagccaaaaaagaagaaagaaacaaccagaacatttcccaagtacaaaagtttgatagaaacatatatcttagtggctatcaatccatagactagacagctacccatgctcctgggtaaaaaactcttgcgccacctggtccaactgtcgtgataccaccgcaatagtatcccacagtcccggttggtggaggatagcccaggtacggagccaccgagtaactaaagtgataacctgcaaaggagaagacaccatcttgttattaaaaattactccattcctgcttagccaaatagaccaacacagagttgttgcacccataaaaagcagattcctcatgtctttggggacacaagatagccaactcctaaacatatgacaaatattgcgaggaggttttaaattagaagccaaatgaactacagaccacaccaagcgagataagcaacactgaaagaacaaatgttggatggtttcatccttgtgacaaaaacaacatgtcttgctacctttacaatttctcttagcatggttgtccttggtgagaaatacgcctcgacgcaactaccaaatgaagattttaacttttaggggcactttctccttccaaatccgtctattgataatcggaaatgtgtaggatcatggcatagcaatttgattagcagaagcatgtgtagtgcggagtgggcagatcaacagctaggagttgagtgtctactcatacatgtgtaggtggactagattagccatgcatgtaggtgattagcagccatgcatggtgattagccaacaggggcggatctatcatggggggcgcagggtctcaatccttcactactggcgtaaggaccatgggtgccgccatgaagccccctctaaatttttgtgctataagtagatgggatgggggatgtagctttgtctagcttcttcagaccatcctgttatttcttcatagatccgccactgttagccaagtattaggatatgcacgtttggagcaagaagcggtccaggtagtacgcatgcatgcagagttagttagctttggattcatgtgtgtggttgcatgcattagcaatgtgctcctgcttatggcgtccacggctgtatcgtgtgagcgagagtagttgggttgttggccaaaaggctcggggcccaacggcctggcccacaacacggcgttttggtccggcccaagcatggcatggctcgactgctgtcgggccatgctggcccagcccgattggtgttgggccatgcttgggcctctgcctcgacatggtgggctagcccgacctagcacagtccaatgaccaaggaggcaaaataaacttatttcagccatataaggcatggaccaaagagatgaggcacgtaaaatagacttattccagccatataggacacgacccaaagaaatgaaggaggcaaatagacttattccaaggaggagcacggtgggctttcgtgccttcagggcggtctggcacggcccgagtcttattgggccgtgcctgggccgttggtgcagcccgtgggtgggcccgacccggcccgatgtaggtcgggccatgtcggtccgactgattcagacagaataaattgaacagaaactcaaagaaatctaaccaaaaacatatgcgaggctgcaccaagaaagctaccagaacagagattaactaagttgaaacttcacgcgcccaaatcaagaacagatagacaccccaaaaaatcatgtgatggtcattccctataccaaaatcttcagaatttctgtttgttacagggggtaacatgagtcacatctctggaccaaaaaataatcacaatgataaactacaagagtcacaagaatgaactaatgcaacactaggagctaacaaactcggtggggtcaccgtgtattagacatctgacggttctgggatgtggatcagagatcggacggtggatcagttgccacgacggatcacgtcgattgcttaggttcttgaaaccaatcttagtgttagtagcttcttggagattccgttatgttctttggatagagtttgtactttgggttggctgactttttgatggagctatgtgaatatttgtgcaatgacaggcaccaatttttgtcagttcttgtgattcctacaatatctgaatattgtaaatatctgaataaatgtggaatgatagtcatccatttctgtcagttcttgtgattcctacgaatctgaatattctcaatgtctaaataaatgtagaatgacaatcatgcaattttatcagttgttgtgattcctgtgatatctgaatactccgaatatctgaatgttgttactgttatgatgatcagtgcttgtttccaaaaacctgaatgtttgtgttagttcctgaaggaaattgttgggattggtgtttgtcagtcagtcactgttctggtgcttgatagatttggtgatgaattttcagttctttcgacattttactactgtactaataattcagatgtaatctttagtttaaggttgtcttgaatgtgttgagctccttcaatgtacttgatcttgtgagcacttcttagattcttatgccatgttttgtctgattcacagttaaatcttcaaattgctactctctgatgttccctgctgtttagttagagcttcagaagtagggcagtaactatgattcaggtttagtattacctagtagtcggtgttattttaatgtagatctttttgttgagttgatttgagtacatgctattgccaattttaattttgtaagttgttagtatgctttgatattgccaacagtgaagaatgtggttttgtaggacataagaaataagtcccatatccaagttcgtccctcaattgcaaaaccatgcaaactccattcttcagatctcaaaatcaggcaacaccatccctgtttgattgtaattttgacaccactgtcaaacaaagtggaggtctgggttttgtttggttttgagagcaaggaacagatttatccaattttgcacttgacacaaaaatgaaactgagtaagagctcaggtatgggtaagtatctttattcaggagatctctttattcaatggcataacaatacatagcatgatagcagtactccttacaaacaagggtggatccacagctccttgtgtaattgtttgaaactatacttccattctgttgtctacagcatacatgccaagtacatcatctctctggagtagtcatacacactgtccctatctctatctttactgatttcaagtacatgatacaattcacaccggtacatcatagactttctttaccaatctataaccggaattcagaaagagtagtcttgaacttgccatctagcccaacggagtagtaacgcgcggtgtaatctctgacgagtgcctccctgtacaaaggcgggttctcatcagacaacagctccttgatcgggccatacatcctcgtggaaatcggatgaaaatgggtgctgaagaaacaggcaatcgagactctcggttcagtgttcttcgccaccactctatgctccacactcttgtaattgtcattggagatcaactgaacatatgatcaaatggaaagaataagctccgaacaatcaagaacatgtttctagactattttctgaattcaagtttggttggtcttgactctgagcatggtacctgcaggagatcggcaacattgacgatgaacgctccaggagttggcgtgacatcgacccatcggtcctcatggaggatctggaggcccccaatgtcatcctggagaagtatggtgaggaagccggagtccgaatgccggcttgtcccgatggcgagctcaggctgggggcagggagggtagtagtggcatagtatgatttgcccctggttgcattctatgtctgtcaggtagctcggtttgagcccaaggccctccgagagcagctcgaacagtgtgttccccaaattctttacttgtttggcatattcaaacagtgcatccctgcatattaatgcaagctacatatgttacccttaaacaccaaaagagacctgatggtacgactaagtctcagcaatccaatttatagtctagaaacactatatgctaaaaaaaagggggcatctataagtacaggtaaaattctgatttcgtcaaagcagtgccccttttactgacagtacaggataaacacagggctcacttttttagataatataaaggaggtcccactctgagtaatttcattgtacaattagtttttttttgataaccatgtgatgtgagtttgaataaaaaaggctactaattatattgatatcctggaaactattcttgtatcttatttttggggcaccggacatgaaagtatgtgacccagcaatcatcttttccttctctgccctactactacgcagcttaatttgtcatttcggatactattcgaaaatttccagattcaagatgcatgatcctttcacacaaaaaagcacagcaacaacaacaacaaaaaggctgtactagttgttcttcccaataacaacaataagcttaactgggattgttaaattagtcagcaaatgactcagatcttggatctaatcaagctgatctcactacagatttcactaatgagcttaattaactcgtacaaaggccatcatattctaaagatttaccagcaatatcctaattgaagtgtgatacttgcaagatctaacagtattctagggaagaagtatacagtgaggctgtgagaggaagcggcttattaccggcagatctccggcaagtcggcggcgggcggcgggtcgggcgccatgcggaggtagagcgtgtcgcgccagttggccaccggcgactggtacaggtcgaagttgcagtggtacttgacggctctcccgggctcgcgcgagtagagccgcgccttgtcgctgccctcgccgcctccggactcgtggaacgcgcgcgccgcgcccgccgcggcgtccatcgcggcgaggggaaccccgtgccccgtcacctggaagaacccccactccgccgccgcccgccggacggcgtcgaccacggccgcgcggctcccgctgatgtcgatcaccgggacggtcgtcgtggtcgtggccgcggacgatggcgccgtcgcctccggtggttcttgatcaccatggacgacgttgtggaagatgcgggggaggtgggtggcgcccgacgcgacgaggccgcggacgccggagagggtggcgtcgagcgcgcggagctcggcggtgcggtcgtaggcggcagcggcggcggcgggggcggggtcggaggccggcatggtggctgcgcggtggattgccggtgcttggtgtatatatcggcgcaaagcgaagcgattgagcgaagcgtggcgagacgcgcgtgctcggtgctcctacggcgcgcgttttttttttctctttattctttttgagagggagtgcttctaccggcgcttgatgagtttgaccgtattaaacaccattactacgatgatatgagcatctcacgtatacccatcttatttctaagtacctcacactatgttttatattaaaaaaatagccgtaaataccagaacgagcgttaactttagaatttaaatttcagtggacaaaatttaccacagaaaaactaatcaattaataagtttcgctcacttctaatgaattaaatttgaatatatattatttattttttaagaaatatccgggatataatttttgttggtacaaatataccgccgtcgctgtatgggagtgtgaaatcaacacgatatcgctgaagcgttacacgaaaatgacgataacatgacggcgcgggcggtctggcaggaccaaacaacgacaccgcttggaaatgattaattatatcgattaattactaataatgctaagtaaagaaataacaataattaattaatttctaatgaagctaattactctattaatcgcgctagttcagatgcgaagacgcgtctcgcgcactcgtcatgcgaggtagatctgtctcgcgccctcgctctgtgagactctggcgagtgcatctcgtggcactgtcctgcgacaatggtatacgtctgcaaatttcttataaacgtgtatacttttgtaaaaccagtaaaaaaaatgttttcatatttttcccgcttctgactccctctgtttactcactccataaataagagtaaaaatttgttctaaaagattcttggtggtagagtgatctactagtcctgaatgaatataatctcttctcatcgttacgtattaataaacgataagtagtttttaatcattttcaaaatatatttagattagctaaaacacttatagttatttagagatggatgaagtaactttcgaagaatggctgctgccggtcgaaaaaaaatcggccggtcctttctatccagacgtctctctcaactctacgcattctgcacatgtactgattag

SEQ ID NO: 34852 - DNA, 2044 bp, Oryza sativa
cggggtcgggctcgacatcctgacggcgctcgaggcgtaggaggaggaggaggcgcacaagcccgcggtgttggcgtcgtccttcgccgccacgaccacccaacaccgcatatcagacgctggaaggaggggatagagagagaggagagataggagagctgacatgtgggcctaagggcatttttgatacttcacacgttttctctctcctctccaaccggaaattattgttctaatcagcgcgatgtctattggcaaattaccacgtttatggagtgtctttccccaaaagtgagttcgggcggtatcctacggctaaaaccacgaaatcgcagtgtcctgtagtaaaatttgacttttaagaacgagtataataaggtgatgtaaatgggctgtacaagttgccacatcacatttatgcttatagaggaaaaactaagttagagggcagtagcccgtcgatccgccatccatcaagcatcgaacgctcgctactcgctcagagaaaaatgggtgccgccgatgcactactcgctcgctgtcgttcaccgcaccgctggcttcagctgttgttaagttaagtatgccgcttgtgaagttgatggctgggtagcatttatctgtgtccaagctgtttggccagaggagcaagaagcagagcaggaagccaaggtcctaggggtagggatcgagcaaccccgccgtgatctttagcttggtcggctggaatactagtccgtcctcaccgttgaggagctagacgaggaacaaattgaagaaaaaaaacactcgttttctcttcatttcatggccgcaaatttcttttcttggttaacacattacactctcttgatgtcttctttaacaaatggaaagaaagcgtcatcttcgattggttctactctgccctcgccggaggtgacatcgcgtgccccacgcacggggaacatcgacggccgacgcgctccaccagctcgagaggaactcgaggaggttgagcggcggttccggcggccggagctccctagcgacgtgggttgaacgactgggcgatgcgcttctgggacaaacgacaaaggacgaactgcagtggagcgaatgctgccgtgccgttagatacgggattctggagtcggacctccacgtagccagagtgcagcgaggctcccgcgcgcacgacggcactagggaggacgcggaggcgtgggacggggtcaaggaagagggtggtggcagagggggcttcatcgggaagcacgggttgtggccgtgtggcgacggcagcataggcctcccctccctcacttgtggcagcggcgcggcgcaccaccggctgcactgcagcggctcgtggtggcgtcaacgcgaagatgtgggccgttttttatttgccgtgggccgagcctgtctgctgtgcgtgtttaactccgttggatgctgaacggatggtcgagcgctgccggacgtccctctgacgtagcgagtgcgggcagtctcgcacaaccaaaaaaggacaacgctgggaaaagattaatgattactagtgattaagtatcttaattaattactaataatgctaattaaagaaataataataaataattaattgctaaggacgctaattagcctattaattgcgctagttcggatgcgaagtcatgtctcgcgcactcgtcacgtgaggttgagcggtctcgcgccctcgctctgcgagacagttgcgagtctcgaatctcctggcatcgtcctacgacaacggtataattatgcaaattttttataaacgtgtatattcatgtaaaaccagtaaaaagagatatatttttaaattttttcccacttatgacttcctctgtttactcactctataaataaagtaaaattttgttctaaaaagagattcttggtggtagagtgatctactagtcctgaatgaatataattaatctcttctcatcgtttcttttttctcgttttctgtacgtattaataaacgataagtagtttttattcatttgcataatatatttatattagctaaaac

SEQ ID NO: 34853 - DNA, 541 bp, Oryza sativa
gtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcgg

SEQ ID NO: 34854 - DNA, 198 bp, Oryza sativa
agagtccttggatagaccatgtgaggccggtttggctgttcaatggagcatcctgtttaggtaggacttggatttagggcctgatcgaaactgctatctgctgctgccgctatggctgtggctgtttttcagcagctgccgctgcagccatttttagctcttgcagccacagttgctgcagcagcaagcagtatcgat

SEQ ID NO: 34855 - DNA, 335 bp, Oryza sativa
ctttcgtgcatacaggcatggaggttgtgggaacagggcaaccttatggacctccttgacccggcaatggcgaggcctgcacccgacgatgcagagctcctgtacgatctagaacggtgcatccacatcgggcttctttgcatccaggacatggcggacgataggccgaccatgtccgaaatcgtcgccatgctgacgagcaggacgtcgcagatggagcagcccaagagaccgacacttgacagcagagccgccatgcgtccgcttcgtcagagtgatgtccaaggctcaaccacaaccgatctcacctaatgcatgcagactgcctggattgg

SEQ ID NO: 34856 - DNA, 676 bp, Oryza sativa
accccccacgtctcctcctcctccacgtcaaaccacaatccaaccaaagcaaagcaaaggagagagatcccggagaagaagtttgcgtgcaaggcgatcgatccatgagcctgaggcacatgacccgagtgggcgcgcgcgcggcgcaggccgtgcgggagggcgcggggaggtctgtgaaggacaaggcgcagtcggcgacgacgtcgacgtcgtcggcggcggcgaggagcagcggcggcggcagcagggcacccgccgcggggtcggtggaaaagggcagggtgagcgcggcggcggcggctagggcggcggaagagaagcggaggcgggcggagcagtcgctgcgcaccgtcatgttcctctccgtctggggtcccaacacctgatgaagactagtactagtagatgtgtaggctagcgatagcttatctgcatacggtggtgtgaaggttttgttctgcgtctgtgaaaatctcagatgtgaatgaagatgtaattaagtatgtgaatcatcgtctatggatgccgaaaatactgtttattcttggatctcgcttgtgttgttaatccttctttgttgacttcttgttaatactgtctgtctgttcatctatggtacagaaaatactagtactgtttattcttgtacctcggttgtgttgttaagcctctt

SEQ ID NO: 34857 - DNA, 534 bp, Oryza sativa
cttgttgtaatgagtacctccgactattgttgtactagtagtattgcgaactattccgtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaactgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactcc

SEQ ID NO: 34858 - DNA, 618 bp, Oryza sativa
  unsure (1)..(618): unsure at all n locations
nnnnnnnnnnnnnnnnnnnnnnnnnnnnnnnnnnnnnnnnnnnnnnnnnnnnnnntgtactctgcatcaaagaaatgcatcacaacattcagcataaacaaaatgaaatgtgccacaagacttgccctacagaaacgagaagaacctgatttgttagctggttcttgaacttctcgggatttctcttcctctcagagtgaaattcgtaagacacttgtgcatccatccctgcagtatgtgaagtcatgatgaccatgtttctattactgccttattaatcatgatatgcttaaaagatactaaaatatgttctacgataatattgttaacaagtcctgattaaaaggtactggataacaacggtgactgtttgatatctgttagagcaagaactagcataaaccaaaaaaaaaaaaaaacatcatgctgtgccttggataccagaggaactcttacccatactaaagtaattccaaaatcctccacggtatgtgtggtagccctcctgaacaaaaatataaaagaaaaaactgctaagcaagcttaaagatctatatattcagttctcagcctgtccaattgnnnnnnnnnnnnnnnnnnnnnnnnnnnnnnnnnnnn

SEQ ID NO: 34859 - DNA, 452 bp, Oryza sativa
cccccagctatgatcaatgattcaaacgagtacactttgtccgatccacaggtctgaatatttcatccgcagagaattctgagacgacgacgacgaagaagctagatggaacttgcagagtcttgagcgccgtggtctcctcctcctcctccgcggcagcggcggcgggctgcctcgagctcccgtccacgtgcggctgcgactcggcgggcggcggagccaagcggagggcgccagcctcgtcgtcgtcgtcttccggcacgaagccggcggggcggggcggagcggggggcggatggcagcgcgaagccgacgggatggactggggcagcgacgggcggacgcgcgggcggagtcttcttgaggtcgtcgtccccggcgccgccgtgaccgtggccggagaggggagatggggagaggggaggaagaagaggtaggggtgagtgacatgc

SEQ ID NO: 34860 - DNA, 1163 bp, Oryza sativa
tgccgccctgggggagggcgattttgtactgtgctctatatttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatacatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcttgctggacaaggaccatcagtttcgtacaggtatttaacagtattaataaaaagtaaagtaccgtgtgggcgagggaacgacgctccgtgagggga

SEQ ID NO: 34861 - DNA, 666 bp, Oryza sativa
atgcatgcatatatcaataccatttgcatcagtaatctggtccataacatttttgtctgctttacatttgttgtctacttttcttgtccagctctgactgcaagattgactgctgaggctgagcacccaagagttgttgttggtgagatcagtgatcctcatgtgccaagtggttcacaccaacaacagagctcttacatggacaaactgcagcagctgcttacacagaggcaaccatcacaaacccaacaaaatcagccacaataatatgtggaacttttagggtgatttctcattagagacttttgaaaggcttattgattttttttttgctaaatgttgagtaatacatgtgtggagactttcaatgtacaactagaagataccccgtgcgttgctgcaggattacagaaggtttattcagaaaaagaagtatagtttataaactatattcagttattcaccagcaagaagtgtgttaccttcagtattttaggttcagaattaggcttgattggaaaacggaaatctaacatagcctacatttcatagtagaaaacgatcatgccaataaggaccaggccagtattcccatgtgtggaatttgttcttggtcaacacaaacaaaaaactctacactggaagacaaggacagtggcaaggtat

SEQ ID NO: 34862 - DNA, 614 bp, Oryza sativa
  unsure (1)..(614): unsure at all n locations
ggcaatacaagtcctttggtagcctcccctgtttttgagttggttgtaaaaagtacttctgaaactctttttagtggttaaataattctttttcttctttccatgcaccttttatactgttgagaatcttgaatacaattgttcatacctgcaggtttagtgaatttgggactgatggtggaccagcagcaaaggccttgaagccaaaattcaatctatttacgcagcaagtgtccaagagcttaggaatggcagtgccacatattgatgtatgaatatttatttgatttggctgccccattctacctaatattgtttcatttacttataccattctacctctttttctacagataaagactgtcattgctgctaccatgtttcttaaaggctttggtggtcttctgttcatcatcagcagctcatttggagcattcctacnnnnnnnnnnnnnnnnnnnnnnnnnnnnnnnncacctaatgtgttttctttatgcattctgcaccatgcctacccaaagtaaaatattatgtgtatttactattgtatgatatatgtagttcttattgttttaccatataaattggcaattttagctttatttctgatttggc

SEQ ID NO: 34863 - DNA, 711 bp, Oryza sativa
  unsure (1)..(711): unsure at all n locations
nnnnnnnnnnnnnnnnnnnnnnnnnnnnnnnnnnnnnnnnnnnnnnnnnnnnnnnnnnnnnnnnnccattgctacgttgtactagttcgagaaccagcgagcgagtagaattatctctcgaacaccaatggaagttgcggtgcgagagattgctacgtactggttcgaggaccagcgagcgagtagaattatctctcaaacaccagtggaagttgcggtgtgagagattgctacatactggttcgagaaccagtgagcgagtagaatcatctctcgaacaccaatggaggttgcggtgcgagagcttgctacgcactggttcgaggaccagcgaacgtgtagagttatctctcgaacaccaatggaagttgcggtgcgagagattgctacatactggttcgaggacaagcgagcgagtagaatcatctctcgaacaccaatggaggttgcggtgcgagatattgctacatactggttcgagaaccagcgagcgagtagaattatctctcgaacaccaatggaagtttgcggtgcgagagattgctacgtactggttttcgagaaccagcgagcgagtagagttatctctcgaacaccaatggaagtttgcggtgcgagaggttgctatgtactggttcgagaaccagcgaacgtgtggagttatctctcgaacaccaatggagggtgcggtgcgagagattgctacccact

SEQ ID NO: 34864 - DNA, 2394 bp, Oryza sativa
agaggatccccagcgttaaaccgtagttgatttaacatcggggacacttgcacagtagatattgtataaaaaacatatctaggtagatataataaactaatgatctgacaatactgtatgatctgaatatgtacggtaaattgcatataagatattgcgtacctttgtagatatatgccggatatatctacgaaattagtagatcaatttaaaaattaatcttactaactaccttgggagacatggagtatgtgtcatggaaacacatataagagctctgtacggccaatatgcatgcacgtgcgcacatgggtgttggcccggtacagggacatgcagagtgacgtcgggctgtcgactgactagaaatcgtgttctagttagaaaactgtagtactaatccagcggtagatttttagctcctcgacgcgcttgcttggttggtagggatcggtgtcgggttcgacttggactcggcccgccgatgcctcacaccagttgatgtcgcacacgtcgacggatcaagctgccgccgacatcatggttctccacggcggtgattagtctcgatcttgtcggaagatatgctccgttcgggttagatctcccacggccgaagtcgtcgagtagcttgttgttggaaaatccatcttttaaacccttctcgtcgaaatcctgaaacaccaaaatctctctacctggcgcgccactgtcgacgtttgatgtctcgactacggtatttgcatagcatggggatcgttggtactaggatatacacgagactgagataaaagagatggagacaaggatttttatactggttcgggcccctgaattgtcaggtaataaccctacatcttgttggccaagccggtattgctcttattcatgataatcacaacagtacaatatttggggtagcctatcttactgttgtcgacatggcggtctgacgatctgactcatagtcgacaacagggtagccttcctcctcgaatccgtgcccggcgagatcagagatagcgcttttgtctctcctgacagtatccggagacaccgtagggtactagccgtgcttatccctgaagtcaatatccggcggcgtgtcttgccgtatgtaggcttctatattatggcttctgtgtcgattatgttgggtgttgatcctcccccctctccttctaggggggtttgtatttatacccataggtgtcaccttgtctaagtagaactagggaaaccaatatggatacaattcgagtagtcctttttcgtctccatgtagaactctggttgtctttccttatccggaactcctatatccgaaggttgcttccgtataggacatggtatgtagtgggtcctgccgagatttagtcaactactattaggtatatgggtatctataaccctgacagatctctgtccaggaaaattgtttgtgtagtagtggatgatagtcctgctttatccagagaaacagtacttgtcaacttagcacattactattctgttgggtaaggtaaaaaaaggctataccgttatgaattgaggagaaggaaatattaaatttcagaaaacaattctggaagaagtgtgtaagtttggatcctgttaatacaggtagtatcatttgctatacatgatatgttttgtaacttcttagcttaggatcttatctttttcgtttttgcttatacttatcagttaaaatttaaattttcaaccttaaatttgaagctgattttaaggttttttcatcgaagtttacttttcatcatttatttttagattgctgagaacacgtatataaaaattttatacacagatcgcttttggttttgtaaatatgccgagatggggctgttagtatgcctcgacctttcgtgaggctgtatatgtaacatgtgtacgaatctcccgacaatgtgaatatcatgataatatctcatttgacagttgaaagtttattttattttggtgcacttcctatgaaaagtttcgttttgtatgcttatttctttggcggttagctctttagagcaattttaatgatatagccaactactaactccaaaaattaaaacatcatctataactaatatagcagggtattgtatagtttgttgtagatatatacttcattactaatacctaacatatctatctctctcacatagtttattagagctcgtgctgcacatagtttcttctctcatctcctctctctcctctggaaatataaatatgatcactgggggagaagtggtttttactcccggttcgtaacccccctttagtcccggtttttcaaccgggactacgaatccgggactaaagatcgctatctttagtcccgggtgaaataaccgggagtaaaaaacgatctctagt

SEQ ID NO: 34865 - DNA, 7673 bp, Oryza sativa
ttaaagatagcgatctttagttccggaatcttagtcccgctttgcaacccgggattaaagggggttgcaaaccggggttaaagagggtttccgcagcagtgacatgactagtatataggggtaaaaatggagcagattcggatggatagtggtcataccatatcctaaaccatattttctaaacggattcagagcggctgagcggattgtttcagatgttggaaatggtgcggactcggttcagaaacggattaaatttgttggatgttatgtgtgtatgcaagcaatataccatcgagttaacaatgcaagggacaacaatgcaacaatcaatgaacgacccattgtaataattatgtgcttaagtactaaacaaacatcatgaatacatgatatccataatataaaaatatagctaagcaagtgtgagatagacggtgaaagcctcggactaaggaatctaggttaattgatgaattgggccattagatgtgctagctcatgttatatgtaacagattgagtggttgcatgggttgataattttggattatccaacaaacgacttataggataatttgacagaaatgtcggataatctgcatccgccagattttagagagaccatattcgctagatttttagaaacccataccatatccttctttcggacggatttggaatggagcagagtggataatatccgatctgttttcacccctactagcgtatccagtgataattatttgaaaccagagaaaatacaacactgggccatctttgtagcacaggtgttaaaagataaattatgttgagaacacgaatatgaattttgtttgaagatacattaataggaattagatactgaaggttgagaaacatgtatactccccaatcagccaagaattcttcagggcgaatctttaggccctgctgccatgcatgcatatatcaataccatttgcatcagtaatctggtccataacatttttgtctgctttacatttgttgtctacttttcttgtccagctctgactgcaagattgactgctgaggctgagcacccaagagttgttgttggtgagatcagtgatcctcatgtgccaagtggttcacaccaacaacagagctcttacatggacaaactgcagcagctgcttacacagaggcaaccatcacaaacccaacaaaatcagccacaataatatgtggaacttttagggtgatttctcattagagacttttgaaaggcttattgattttttttttgctaaatgttgagtaatacatgtgtggagactttcaatgtacaactagaagataccccgtgcgttgctgcaggattacagaaggtttattcagaaaaagaagtatagtttataaactatattcagttattcaccagcaagaagtgtgttaccttcagtattttaggttcagaattaggcttgattggaaaacggaaatctaacatagcctacatttcatagtagaaaacgatcatgccaataaggaccaggccagtattcccatgtgtggaatttgttcttggtcaacacaaacaaaaaactctacactggaagacaaggacagtggcaaggtatcctctatactacttctattatttgtctgcagacaagatcatcaaattgcgcacatccccatagttgatagttgcgtaccttagaaaatcaaacttcgcagaaagtggatcatcaaagtctttaacatggccggttttatttgtatgcatagagaaaagttcaggcatgcaatcaatgctaatttttgcaaggaatcactatatacaattactaccaagaaaatttaaacattatttacccattattcacgcaccaagctagggacaaagaaagccagttgggatcactacgggtcccacaccgcagtgttagtggcaggcgtcatcacacagaggaacaataaacaagtgtaccgtttgagagtcaaaacagagaaaatttggcatattacccgttttctctctccgtatttaccctcttactacgccgtcccatcaaagggtagttggcttgccttgttgtcgaacccgagaaaggcaacatggggcagcgagagaagtgacgggtggcagaaagtgtgatgatggctgtaaaggtgaagaaagttaaggatagaagaaagcacagaagagttgagacatacatgataaacatctaagaagaaagagaagatcgtagagacgtatatctccaaagaagaatagggacacgtgcccagctcgtagccgtccgtaggccggttgcctgagaggtgataggtggcaagccacctcgggtggagtaggcctagcataagtagttgggcattgatgtgtggcagtgtgatcagctcaggaccatccaccgcctcactcccagcaggtgacaaatggcggcccttgaggtcatcgccgttatcaacccgattacgtactagacatggcatttgttaccctccaagccataggcaggggagagcttaggaggccccgtgcactgacctctaacctatacgacatgctaaggagagtagagttgcaactatggtatatgaaatcgtcatgattaattgtttgcagtgtccctattgcttgtctctctagaagtccattaagctttggagagtatataagcaggagggggttccccagtgtgggggtggaaaaattttcaaaggatccaagacacatcggagttggagtgtgagttgtacatttttttgcttgatattccaaaaagggcagcagtagggtcatttcggattaggtcatatccctaaacccaccaagaaacaccgggttcgctggatttggttctgttgggcatcgcccgtcaacaccatgtaaaaaaataaggcatgccacacataaactagatggagaaattgatggatgcacaaaacagatacatagatacaatgtttgcaaaggaacgtgcgatgtggaaaataagccaaaatcgccaaagaaaaagagcatacaaaaccaaacgttttatagggagtgcaccgaaataataaaaactttgaactatcaaataggatattatcatgatagtcacatcgttgggagattcatacacatgttacatatacaatcatcatgaaaggtcaaggcataataagctaagaagttacaaaactcataatgtatagcaaatgatactacctgtatcaacagggtccaaacagacacttcttccagaattgttttctgaaagtaattatcttttctactctattcataaccgaaaatcatttatagcctttttgggacctaacccgatagagtagtaatgttctacataatctttgactagtgtttctctatacaaagcaggactatcatcggacagtagctccttgatcgggccgaacatccttgttgacgctagattgttgggaaaacacgcgatggatactcttggccttgaactttgtgccaccaccctatgttccacgcttctgaacttgtcatttgagattatctggacattggttatatatattcagaaatgaaatgacgcacatgcgttttgtgggttatcaaaaatatatgtccaacaatataaggtaaatcaagttgagttttcatgttctctcaaaataaaaaaatgttgatatttttatgtccattatgtgttgtgaagattcttgttacaaaaccgacccaaaatcaccatcgataaccaaacgtggaagagacaccattggagatccaacttccaaggacattgaggcataatatttgttaacgaggttccgctgaagcctgtgtccctgggacacggattacggtagatccccggccgaacaccaccggaagccattccctctcgcctatgctaagtcatcatacggttacaataggcatgcctctctaactaagagagcctaggatagagtctgactcttattttattcctatacctagtacaacttcaagtgctaaactgtaaccgactttgtacacatattcgaccgtaactgacaattatgaacatgatacctgtaagaggccgcctaaattcattgtgttatgtggattctaaacatgataccagcaagagacaccctaatttcattatgtgttgtggattatggcaatgatatctgcttgattcattgtatttttgtggattctgaacatgatatatgaaaaacactgtttaatttcattatgtgttttatgaacactgaacatgatactgttaacagtgaaatttggtaatcggcaaagacgtcatcggcttagaatcagtatcggctgcagcatctcggaattagccgattggagttatcaagtcgccaatagtcggattcttgctatattcggttaaggaaatcaatctactaaaggaagcttatccctaagtgaccgagtttaaagaggatgtggcatggcagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacagccggggtctatgtaatctatcgctacgatcaatacaattcggcgcatcaccagtcctccacaacaaccggtgggtcgatatcacgccattacctggagcattcatcatcaatataggcgatctcatgcaggtacctgttgacgaaaaaatcaaacacaccggcctaggagatcttcttagctccagtgcaggtccaaatatgatgagatgcgggcatgctagtcagtttgatcctgcaactgacaagatatgcaaatagtagatcaaaacagtcaatcggctgacaagccgatggagtagttccagccgatagccgataatagccgatgccgataccagccgatagcgatagggtttaagcaatcggctatctgtccaatgtagataatgatataaaggcaatcggctgatgatgatgtaataaaataacaatataatccaatataagccaatcggctagcaatgatatgataaataagcatcgatccgaaggttaaagcacacatcggctggaggtccgatgtcatgaaatccacaagattagattaaacaatgaaacctttgttgtcatcggctaaatccaacttatatgtatatgcaatcctcatgaaccgatgcaacgtccagataactcaacggctgaaaccccgatgaaacccttattggcaatcaataagcaggctagagattatggttctaagcacgacttagtagatcaaacttaactggtgcagtactaagtatgaaaagaaacataatatctagacaatgaagctgttgactgagttttcagggtggtagatgtgtagctaatctaatctagcaatgcgatttagcctataccggtagaaaccctaaaacgagaagcagccgatagagctaaattgatatgctaagactagattaacagagacatatgataaataggtaggcaaatatatcatccaaaccagagcaatccaagaggccgaatgtactgatgcagccttgaacgacgccgacgtagacaatacaattgcctgggccggcggaacattgaacttaccccttagccggagatcgaacaccgatgcagccccgcgtcaggtgccaagtcccgccggaacgtaaaaacaaaagtagtaaaggtaaaaggtggcgatgcgccgaattgtattgatcgtagcgatagattacatagactccggctgtccctatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaatccgactattggcgatttgataactcccatcggctgattccgagatgctgcagccgataatgattctaagccgatgacgtctttgctgattaccaaatttcactgttaacacacacgtagtgatatatccggaatttcagaattttagaaatgggtagttcaacttacatactccctccgtttcagaattttagaaaaattcttacattcatattgatgttaatgaatctagatagatgaatgtagaaaatgctaaaatgacttacattgtgaaacggaggaagtacttttttaaaccgcaaatatagcaaggaccaaatgtgcatcatgatatattaataatggagttttttttctctttccaagagtaatgtttagctatgtatttttttatggtccccggaccactaggaccaccctttggacacatctatcagcacacgtgtttcttttacaaaattaaccatagtgatgagcatcagagattaagaggactgaattttgtactacagtttatgaaaccttgacagacagtcaaataagcttggctcacaaaacttaaaactgatgtgccataacaggaattttgagtacccattttcagatgaacaatatacacatgctttagtagtaatggtcattggattcttgcgattccagtcagtccaggctaattgtggaacaattgagtagtaaaagttatgcaaaatatatggaactcttctactattcttcaaaaaagcaaacgttatttacagccacagatttactggtactaaaaaaataaaaagaatgggggaaaaaaggaaaagaaaagagcggctctcaccggcagtattccggcaggtcaccggcgggcggcgggtcgggtgccatacggaggtagagcatgtcgcgccagttggccgccggcgactggtacaggtcgaagttgcagttgtacttggcggccctcgccgggtcacgcgagtagagccgcgccttgtcgctgccctcgctgccgcgaccgcggcgccggccacctccgccggtacgccgtggcccgtcacctagaggaatgcccactccaccgcggcgcgccggatggtcacgaccactgcctccctgtccccgcccgtgccaccgaggtcaaccaccgggatggacggtggaagcggcggcgattcttggctgctgctcggcggcggcggcggtggttcggggtccgggacgcggaagatgctggggacggcggtgacgcccgaggcgacgaggccgtggactccggacaaggtggcgttgagcgcgcggtgctcggcttcgcggtcgtaggtggcagacatggtgaaaggcttggaggggagcgtggaatcgccgcggcgagacgagaattcaagcggtaggaagaacgcactgacggttggttgagagggagaaaaaggacaatatgctatgccactcttttcgtgtggtttcgacgaaatatcacccattagaatggcaatgataaaatgccacttaataggttatttttaggatattttgccactttaaaaagttttaagaccagaatacctctgctatggacagagaggaatgtgagcgcctgggagaaggctgagctagtgctcgccggtggcgggcggcgagcacgcgggggcggactgcgatgtgc

SEQ ID NO: 34866 - DNA, 1544 bp, Oryza sativa
  unsure (1)..(1544): unsure at all n locations
nnnnnnnnnnnnnnnnnnnnnnnnnnnnnnnnnnnnnnnnnnnnnnnnnnncggactgcgatgtgcggaggagggtggcggctccgaagggggaggacgactgggcgacgaggtggaggtgggtagcggcggagacgacgcatcacaaggaggagccgacgacgtgtagggcggcatcgacggtggaaggaggatggcggcgctcgcaacttgcagcatgtgtgcgcgctcgccgcctccaacgacaacggcagaggaggatagagcgggcaacaccccgtccaccttgtcacccatcttcatcccagcgtggacaccaccatcgtgctgccccgtcgccgttggcaaccctcccccgcgtgctcgcaggccgcaaccgcgctccctcgcatgctcatggcctgccgccggcgagcactggctgccgctcccctctctcccttcctctctatcaacaataggggtattatggtcttaaaacttctcaaagtggcaaaatatcctaaagacaacctattgaatggcattttatccttaccattctaatgggtggcattttaccgaaacctcatgaaaagagtggtataatgtcctttttctaaccgagagggaggaaaatggagtttgactaactgttagagtgttgaaggttgcgttcgctagcttgattggtgatctgaccatggcatcgaagacgcgagcgttccgctccttccaaaccatgcatccaagttatcgaaatgatactgaaggactatgttggttagtaggctgaactatgaaagcttaaaacactgcttgattaagtctcccagagcttgctgggtgtagggacatcgcatgaatagatgcagacaggtcactggcaacaaggtgcacaatggacacgatagttggcttaccagccgagctggttgacgttgtccgatgtcaagcagctttctctggtcgtcaagtacatgaagaactttcagctgtctaaactttttgccttccatacgattttgccgcaagatgcatgccaatgttttgccaatgaagagtattggcaagaaagcaagattccaccgtagggtccttatcatgctgtaaggctatccacggcctctattgttgtgtgtggcgccactatacacatcgcattcgccggtgtgtgagtgtggtgttgcgttgtagtgctgtgcatgcgtgcatatctaccttgtaatcaaattttaagtcaacttgtggttttagatgtcaaaatttcagttttgttttcgacaatgtcaggtagttccagtcctacacatgtgcaacttgctttgtgagagcgggcaatgcaacgaggctgagtgagaagagccgtaccatgattggattaaggtgaaataaatagctatatttgtggtgtcatatttttttttattaaaaacagttaaactttttacaatacaaattacatacatttacaaggtatttatgttataaaatttaagactgtatttttcaaaaattttctactgcacattatataagagaattaggataaaaccattgattac

SEQ ID NO: 34867 - DNA, 2204 bp, Oryza sativa
  unsure (1)..(2204): unsure at all n locations
nnnnnnnnnnnnnnnnnnnnnnnnnnnnnnnnnnnnnnntgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaatggccaagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcttggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttccccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccacgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgcttgaaaagatcgcctccaaggagctccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcg

SEQ ID NO: 34868 - DNA, 2823 bp, Oryza sativa
caaatccccggcggttccttccggtaatcggcgaagtgaggccaagcagaaggccccccccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctctcaccgtttgcaacgtgaagttggggcgtgtcctcattgatgggggagcggccctcaacatcctttcccctgcggcctttgacgccatcaaggccccggggatggtgctccgcccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcagtcctagggaggcccgcgttggtgaagttcatggcggcagtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgctcggggtccctagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgcttcggaccgtttacctggacggaggaagccgaaaatgccctcacccagttgaaggcgtatctaagctctcccccagttcagcccttgttactctacttagcggcgaccccgcaagtagttagtgtggcattggttgtggagcgcgatgagaacaattctcatttcacgcttccccaccctgtgccgacttggcctgggagagagcaaggaggagaggctcccgagccgaacggtggcccaaggcccccgacggccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccacgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactg

SEQ ID NO: 34869 - DNA, 3405 bp, Oryza sativa
ccgcagatggacgcctacgtgcgccaagtacggcgtatggagtgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaagggagacggatgcgcctgaccggccaccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcatggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatatattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgatgacctcgtcctacgccacgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttggtcgcttctacccctgagggggggggttgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcactgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgtttggtgagcgcgtcctcgcggaggcggagcgtgaactctttttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggcgcacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcg

SEQ ID NO: 34870 - DNA, 5063 bp, Oryza sativa
  unsure (1)..(5063): unsure at all n locations
cgccggtcagattcccgcctgagggcctctgcgaccgccggatcctcggcctcagactggccggacttggaatggcgggagggacgcgacgggatctcgctgaaacgaaagaaaataccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctacttcctcttcccccgggcgtcggcagggcggctgctccccgggcccctatcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctccttgcttctcgcgcccactatttcgccccctcgtttctcgcgcccacgcttccactaatcccattcgcccgcttgcggcgcatgaggtggatatgcggttgtggcagtcgaaatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgtcctagctaaaaagccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggagatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacgacaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcagcccgaacctgtatacatcgcccgtgtcttgtgtgtttcctgtctcgcgagccttccacatacagagagcttagaatctctccctgagtccccggccgaaccggcaaaggggggcctacgcggtctcccggtgaggagccccacgctccgtcatatgtcataataaggacacgatccaacatgtaacatgtatttggtgtaatttacttactggacaatgaattgacaaataccctgcaatgtgatgtctaattttatctactttcctccaatgcatagaatttgtaatttaggcagagtttgattcagctagttggcttaattacttcctcacttttcaagactcagggcaatctttttcttcgcatatgaccaattacaaatgtaattgtcactacatatttcttgcaccggcccagtagtttcatgagaagtacatcttaaatgcaagccatataattgcttatgggcttttggcccagataagtcataagcgcgtgttcggaataaaagacaagatgagagattgagatcggttttatcccacgcgcctttccctttctacatgccactcgtataacacaaacaaagccttcacattttgttcattgcttccctctctcacattctcaatcggcgaatcctcgtgcttgttggtaacctcccccaaaccctagccgccacttcctccccccccacccccttgctttgtgccgaacatggagggtgaaccctcacgccgcctctctttgctggaccggtgcgacgatgggagcgaggatccggtggtgccaccgcgagttcccaccatcctcaacctcacctcccaccaccgtcttgaccgatcgaaattcctaccattgatccaccctactcctgcccgcttcatctcttcaacaggatcttccttccccccctactcggaaccaccaccttcggcccctatgctagaacttggtagtggctttgggcctgaagacttatactcgttctttcctaatcattttttcttgatggaatccatcagtctaccaccatatgatgttgtagatgtgccgccggtgatccctgtcgcactacggtcggggagatctaaccaggggcttcctagcaagctaccgcttattgaggggcataggcggtcgcatagcgacatccccttcgggtattcacaagaacacccacaaatgccacctgtagcatcagttaagccggaggtcacaacgatcaaggggcaccaattggaggatgtggcggctgctgccctcaaggacatgggcatacaggcatggagcccttctggtagcatagacaaagaagttaagagctccggtgctggcagcacaacccaccattgccgcagcttgtcggttgacagcttcatgatggggaacctcaacttcggagttgttggacagcagatgtccagcccccctttgctaactacagaggtgaatgttggtggaggtgagcccattggtagtactgcttctccctttgctgcagagcttgcgaatgtgaaattcactgaggatgagaagaagaagattgtgatggataaatccctctcagagattgtcttgactgatcctaggagggtcaaaaggtgtgtgagtttcaatctttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgttnnnnnnnnnnnnnnnnnnnnnnnnnnnnnnnnnnnnnn

SEQ ID NO: 34871 - DNA, 17748 bp, Oryza sativa
  unsure (1)..(17748): unsure at all n locations
nnnnnnnnnnnnnnnnnnnnnnnnnnnnnnnnnnnnnnnnnnnnnnnnnnnnnntttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgttcattttttttcaaagtagtaatcttgcatctgcaaagcatgttgtatcgagtatatttcaagaagaagaatgtctttctttagaaactacattcatcgggcatcgcgatagtaatatatagcatctacaactaaaatacatagtttgaaatttaaaaaattgtgcatatatttgtacaactgtataacaaaatgtcttttattgctgaatggccgtgatttgagaattattgtttcttataacaaatgttgcttaccatacatcaagaacatgattcggatactataagaggaaaacagttcgcacgatttaatatgtatgagagaaggtaacatgtcaaagaaaaactttacagttgttttatatatggtaatgtctataatcaaaactaaaattgaaagttaaaatagaaacaacaaacacttcagcaacccaaaatattgtattatgcattttattaataatggccgttatttagagtgaaagaaaaataacagggttggaataaacctccacttactcaaaatagatggatagacgtcaggcaacttattcctagcatgccatcaaatttatttccttaacactattacctaaatcgtttaaccttcacaataaatgttttttgtcaaggaaaggagagaacaaccttgaatctatagaatttggctatctattagcagcaatgaatccctacatactaggtacaaaacacccaaggtttcttaaggagtttatatcagatctaacttgtagttcctatgatataaaacaacagttcgatcataacttatatgtcaaccattgtatgaaatgtattaaaaaaatctaatcacatttgggctaaatgatgtaccaaaagtatcaaattggtggatgaaaatggcgttgaaaaaaaagagaagtgaatgtgctacttttattatttatcaaccctcccaaatcactgtgaaacatgatacgactctgtcgacggaaagcattcagatatcttttgagtactgatcctatgttggacatttgtcaatcaactatgtcagcagaaagcattcagatatcttgtgagtactgttcctatgttggacatttgtcaatcaatagtgaacgacatatctgctaatagactcttaagctcgttagaagttagcaggatttcatatactagatgatgccctgcgtattgctgtggaaacttttataatctagttttccatagataagagctaaacattagccttgacatgtgtgagcataaacaaagcttattataatggttgtaggctttgtcagcttacgctctcaccaatatttcaagtcaaagcacttcaaaataaaactaaaagtgtacaaaacaacattattacaaatgaatctataagcgcaaagggcatggttgaagattctattcaactttaccgcttggacactgagctagaacaaattaagagagagagatgaacctgacagttcaatacaacctaatatgggtaagtaaaaagtaagaaataaaacacaacaattatagagaatccacgccaaaatagtcaaagaatacaaactgaaaaaaaatctgctgagaaactgaagaaagataatgataaaatgataatatatcaatcagtaatataatttacaatggaacaattagcatagcactacctagcatggagtacagattagtgaaaatgtgggacaaatcttttgcacctacctattacggatttggtactgaatttgaggaatgcatccaagatttggtattgaattgtggtttccatcataaaaaataaaatgggtttatatattgtctccacaaatgggagatgggccaagagatgatcgtcactggcaatggaagatgtatattataagtatttcttgtaaaggttatagatgtcatgattaattaccatgaaagtaaataggtaagataaaacggctagctagttgattaccatcttgtcagctacatgaatcctatcttactataaagtaatcccccactaactccttaagcttaatattcaaagatgccacatcatcatccactaataagatgccacatcatcatccactaacaatcatcacatttaaacatcatgcaaacatgctatatctttatagtttttataatttaagagcttttcaaatacaaatatgttaaattatcatccaacataattcacataatgtttcaatgtatatcttttatgatatcctatatacttatacagttcatcctcacttagttagtgcttaaatgattaatctatggtccaaattatatttctctttttttcctctaattaagtcatatcacatcaattgtttttagcctttagatgattaatctacggtccaaactatctttctactttttttcttccataaagtcataccaccttactttgaatcaccattctacatactatttaaatttaaattatcataaaccacattaatttacttaatctgatattatctagctatcttacatgttattttttttgttatcatactaaattctcgcagcaatgcacggggtttcacctagtaattagagaataataaaccagcaagcatgtgccttttgatgcgctacactctagctgcctggaggtgagggatggcaatatgggttgggcaccgttcttcttgtattgcattactcaatttgtagggattggaaacaaatctgggacaaccaatgttaatctagtggcttaaagtaattcagatgatgttgctgcaacagggttgagagaattagtattaattgttgttagtggggatcaactatatagagttactagatgaattcccgtgcattgttgtgggatggttgtgcatacagtaatgactttgaaaagatgtcactacaaaaataatgaaagaaaaaaaaatctgatgcttagtatttagaaataaaacaacatttactttgaggtgacttgaactattaaaagaatcaaaacactatttataatatttagaacatgaactgcttacggtagttttactttttctttgttttttaaaatggatggttaggacaaaatctgttgatgattacttatgcatatgttttattataaattactttcggttgtttcattcatttttccatgacttcgtagccgtagctcaaacgatcatggatatattgctttatttattgtttcatattgttcttgcctagttggtcacgtcgtagattaaaatagatctgtattctatgatttggtacacaatttccattgatttgcaatgtgctgtctcattgcacttgcctcattatttactcaaggattgcctgtcccagatagttctgtgcacactatggctccagttctgctaactttgatactcacatattaggctccctcctatttgtggggtagttgggtggaggaagtagtactccaaaatcctttatttatatttatggacaaatcttgaacccaaaatcccttaaatttttagagggagggactagttttttccttggggcctatagcctctagttgaacgcaagacgatagcaagagatatatggagagaacaagacaaaagtaggatatggttgagtgccctcttgttgatcgagatcgtctcgcagggccttcgattattgcggattgcagacacatgttttcaaactagtaaacggtgcatttattttaaaaaaaaaactttatatatgaaagttacattaggaaataaaacaaatccattctttttgagtttgaaatagttaacacctaattagtcatgcactgatggagtgccttatctggtaaacaagcctggtgtaaacttgataataatagagaaaggcatctacgctttagaattgtttgggctctactttggtgtagaatggtgggcaagcccttttctagtattattacttatttgcagttaatactcactctgtcctcagttacttgtcactgttcaccatcactatttcaattttaatcagtaataacttttaaacaactaatttattgttaatgaaaattatatggttaacggtacaacacacattgctaatataatatggtggtatacttttatgtttatccttttctttgacaaatatttgaaaccagagaaagtacaacactaggccacctttctagcacacgtgctaaaaatataaacttcaaagtgtactagacaaatgattaaatgaaattatgtcgagcagccttaatgggaattttgtttgaagaaacactattatgtatgtctccaaatcagccatgaatattattcagggcgaacctttaggccctgctgccatgcattttatgtcagcatttacatcagtaaatctggtccataacattttttttgtctacttttcttaatatttgttgtctacatttctttgtccagctctgacttcaagattggctgctgaggcccagcacctaagagctgttgttagtgagatcagtgatccaaatctgccaagtggttcacaccaacaactgagctctgacatcgaccaactgcagcagctgcttacacagaggcagacatcacaaatccagcataatcagccacaataaactgtggaacttttagggtgatttctcataagagacttttgaaagggttattgcatattatattttgctaaatgatgggtaataactttttattaagataatggaacaaaatccgacctttgctcaatgagctacaaccaattattacataaaattgctcaaaagcaatcacgcaccaaagagttcacaaaaacacaccaaatttaacaaaacgtaagaacaactaataggcatcaacacaaaataaagaacccacaatttattgaatcctatttgtaaacctccaccaaagatagcgaaaagctgcatttccgttgactcaagtttatgacatgcattatttattagctagcttgatgtcatcacacctttgtagttacttttctttgttgcacatcattttttagacaaaaatgtaattgcaattatactagtgaactaagtatacacaacttctgaaagacaggcataatcacggtttcggatcagtcatttccaatttgcatcctttcacaagtgtaggggcactaaggtattgttaaaaacttagacgaaactttttcttcacgtctgactaatgaaagtacatctaggcccctaattattttgggttaattggattcatgccattgcaaatatgccgattcagataaatacaattataattcgtctattcgtatccatgacattcgaaatcgcactaaattgaaaccatgtcatcgctgtcacgttttctgtatcaaaatactcctagacatatgacccacatgttagttccatcttcttcctccatcctcccctcttctttcttccaaatctctctcttcctcgtcattgctggagcaggaggtagagcagtggtgtgttacgatccctcttgacctccatcaatcaacagcaaggagaagggaaatactccaattccaacacaagatatcaagtatttgagatacaacttgaggaagggattgaatcatagacacgggaatcaacaatctagaatgggaagaagaagcaagagattggggaatcagagaattggagcttgaggtaggagagcatttgggaagaaaggagacaaggcatttgcctgttcattcatatgttcatccatgatccaaagaactgcagtgtggcttggttttatactccttgctgtttggttgggcctagagccggcccagcccatgtacatgacattctcccctcctcgaaaatcggcttgtccccaagccgatatagcggttctgccgggatcccatggaacatataaatcttcgatgcaggtagcattctcatcactagtttttcagaatattcttgccttcatgtagtttaagtagcaatttgtccagattttggtgaaatatgaagctccataccactgtgctcttgtgcttgagctgaaatacaaccatgagtttacgtacttgctgagccccttcactgtccaatctcttgctccagaaatcagcattgagatgtagctggatcccatggtaacttgaagcataaccccaataaaattgagatgcataaccattttaacaatgcacatttgcttatccatatttgctgatgtcattgagccttctgagctgatgcagttcagtttcccaactgatgcaattcccccaggatcccatggccttgacatagcatattcttgaacttgggcctcatgaaaagcagtagcttgcatgaagtaaagtatggctactagcagtttgatagtctcaagatcccaaagctatgtcatcttcatctctgttattataatctgctgaattgtagatgatactttgaaatccaagtgacgtagatttaaggaataacctatggagaaagtgaactggaataggctctgatcttgacagcacttgcacaaatcatgaacttgatttagttcttgatctccccatcttccaagagcaggccaagagcgtagtttaattagctttgtcattgaagccatgatctgcagcaatggttccaggtcagccctcaaactaactgggaagacaatttgcagtggtcgtagttgtggttgctgcatgtccttcctaacatgtaaaccatccaagtgatgcggatgaaaaataaattgccagtgcttttcagtatgcatggtcaacataagctgctgcatgaaccaatactccataatgacaaataaatcaagaactgcatttgatttcctctgaacactaagtccttgcaaaccaaattctcctggatcccaaattattcccaccaacagaatatattgcagatgaagtgtttcagccaaataagattgcatgtgaagctcccgaagatttactgagcatcccctcacatcaaagttgctcttggcaatcaattttcccatataagtcaaccattgaacattttgcaaactatcccaaggtccaaacaaaaacagccattgaaccttactcgatgtcctaccgagtgagaaaaatgctccaacatcagttttatctcctgcttcaaaaagtgctgaccgaggattcttcttgccttgtttccgtagcaattgcccctgctcctgaacaatagtcacaccaatgcgaagagaaagatcaggtagtgaccatcgttgtaggagatacatcacgtctccgctactttcattcaattgtggattaggccatggttgtggctggtgctccactcgatcacctttgcaattggctttgagaaggtggccaattccatagaaacttcactaccacgccttcactgccttgacttagctgtggatcaggccatggtaagggccgagaaccgaaggtcatctcagcttggttccatggaattactgctctccaaggtggtactggtggtgagctagctgtgtattctgagctccggtcaaggcaactatagcaagtcaagtaaacgacagaaatagcttgatggccaaaccatggattgttgaaggatgtttgcagtaatgtgaacttggaattcacttcagtgagctcaactaaatcctcggtggctatgtcatcatcatcatcattgatcatttgttcattgcctttcgtcaaacacttggtaggtgtccccatacacgactcattagtatcaaccaagctaattgaattggcctcctttctgacctccatgtgttgggaactaattcagtgttggtgctcgtaactgccaccactctggtgatatcaacgcttgcggttgactcaaccttgatgtcgcagcatgtcacgagcatgttgttgagcatggcaatcatcttggcacacaactcttggaatgtctcctctggtttcatctcagatttgtccatgtcggcctcatcctccttagtcgcggtgagggaaaccggtggcgccgctgctgctaatgcggctgagggcatagattgactcatggtggccgggaacacatgttccaatgtggtaggagtgctctcggcatcggacttggtgatggcacagcttggtaccagcatcgaacacttggtgggtgtcagcactgcaccatccttggaacaaggctgcacatgctgagcctcgagtaggcaccctccatcatagatgtggtggccatgggtggccccccgagccttctccgcaccacctctcgcccggaaccaaacaagagcctccactcgccatgcgtcggccaccagtatatgcaattcctccgctccatagatgtcataaacctggtgcaatacctcattggtcactgggtagatgatgtggctcacttggacatgaagagcagcacctgcaccagttcccaaccagctcggcatttcatcaaacacctagcaggtgcctctagtgcaactacctccaatgcttggattcagtatctggaagtcgctgctgcaaccgtgtgtcgtccaccttgtctcctggcatggaatcccacgaaccgacggctctgataccatattgttacgatccctcttgacctccatcaatcaatagcaaagagaagggaaatactccaattccaacacaagatatcaagtatttgagatacaacttgaggaaggaatagaatcatagacacgggaatcagcaatctagaatgggaagaagaagccagagattggggaattagagaattggagcttgaggtaggagagcatttgggaagaaaggagacaaggcattttcgtgttcattcatatgttcatccatgatccaaagaactacagtgtggcttggttttatcctccttgctgtttggttgggcctagagccggcccagcccatgtacatgacagggcgtcaccgctggagctgctgcggctgctggacatcccatgggtggactcctgagcgagtgccaaatcctgctgttcccgtcgaccatggcatacatgcccaccagcttcaccatcctagcacaccaggcgtggcacacactcacgctgggagcttgggactaggcaccaagtagtccaaggcggtgctcttatgttttgagtccgagggaacgaagaccgccgtcgactagctctggccggctataatcccgctcggggacgtcaacaagaagctcatccgggggctcaccggctggcagcgagatggcccggttcaagttcaggatggtctgcctcatcatctccatctccacaagttcagcgagatggccctggtcgtagtagctcactaatccaactcttcaagtgctcttgatagtttcatcagtgcaggtgttccactttgtccacaaaagaatctgcatagtccgattttttgtggtccaattggtttattccagtgtcagtgttccactttgtcccgctagaaggtgttcttacatatctactgagcccaggaggaggaaggtagagagagagagagagaagaaattggggaagaagatagaaaatgtgacggtgaattggtgatgacatggttctaattttgttcatattcggatggcatgactacaaatagatgaattatagtagtatttgtctgaattggtgtatttgcaatggcatggatccaaaataacccaattattttgatggttaatgataatgttattagtgaggactaacattttaattgagaatatgtgaaggaattttagtcctctaagagttgatgttcaaggcaatagccattcgtgtagcaaaaagatgaaaaaggtaaagattcaaatggtaaaatgttttttttcttgcttgtgtcgatagggaagtcgtacaattagatggcatgttgtctcctaggaatgagtttggtgctcaaaattgttgatgaagtgttttttattcttggactttacattctcccaatatttggaatttctaagagtggtttttgaaatttctagagtaaattttggaaaactgcaactatagtaataaaactatcagtttgctgcagcattaacgacctatttcagtttgttgcaaagattgcgtgggaaattatcacaaaagtgcaacttttacgtggcctaagcatactattgtcacctacatgtcgtttagtagcataagatgtaaaagttgtagttctatgataatttcccacgctatcgttgcagcaaggtgaaatatgttgctaatattgcaacaaactgatagttttttccctatagttgcagttttctgaaatttactcagatttctaaaaaggttacgccttgaaaaatgctcgttggtgattttcgcaagttccaaatactttttggcattctcgaaacggtcatggctagccaaaatgctctcggtgattttcgaattttccaaaaatattttttcaaaatttttggaaatgtgaaaaagctctctagtgattttcggaaattcaaaaaaagtgtatttcaaaaattttgaaaatttgattttgctctttggtgtttttttggattttccaaaaatggtttccagatttctgaaatggtaaaatctgtgaaaaagctctctgttgatttttggaatttccaaaattctattttgccgagtttctggaaatttatactgttcggaatttccgaaaatgcatttcaaattttccaaaaggggaatctttgctcccatcagcaaatatgtgggtgtgcctataaatagtcccccttcacccccaagctagggttgctgctcttattgcacactttgagtcgttggcttgctttgacttgagatttactttaaaccttgctttctcacttcttcctctccactgatcttcaatcttagatttcgtgtgtgtgtgagagagagagaaagagtgagtgtttgatttgagtttgtgtgagtgcttgatgttgactataaaaatttattgagcatttgattcatccccaagagatcattgcttcgtttgttactcttggtggttaaggacacctaaacgggttgggatcaacctcgaggcactgattcatttgtggtgtgccaaggaattttgtgaaggtcgaatctcactttcaaaagggacgatataccactaatgaaagaattgtgcatttgtgcaaccttgaggatagggttgaaaaaggacccggctctttgtgagctccacaacggtgagtagaatcctctcacgaattcgaacttcgggaacacattaacttgcaagaatcccggtgatatccctctcttactcctctagctttgttattttgtgctgctagtagtttagatggtgcattccttccatacttgtgcctagctagatctagtttaacttgtgtatatcgctttatctatgattttcagaattttcataacttccgaaaagtattgctttcgtttttacttaaaaattttaattgtctattcaccccctctaggtcgaattgaccctttcaaccaactacaaatctaagtggcattacacatttattggcatagtagtcttgtttagggctaacaaggcaagcttcaacaatctcaagtgccatcttgcatgcaatccatgccatcgcttacaagatcatggcctaaataaagcacatgccttgaaagaaagacgcgatgggaataacctgttggttttatcacacatgcctttccatttctgcaaggcaccatacaaaatgaaaaaaagaattttgccatttgattgatgccttctctcactagctttcggacctaacatccatacactgactagaagcctcctccaaaccctagtccccgccgcttcccctaggcttgtgcccaacatggaggatggcacccactatagttctcacagccggaagggtgcattgatgcgcgccggcccccatggtttgtgccctagtccctaggcttgtgtccaacatgaaatcctatcttactgtaaagttatagcccactaattctaaagttcaacatgcaagcatgccacctcatcatccactagcaataattacatacaaaacttacgtaagcatgaaacatccaaaaaggctaacgggcaatcgatcgcccctagtgatcatccccccctcctccacatagtttcctttttaggcaccacattactttcctattttagtaaatttatgcacctaaagtttgtacacttccagtttacacatctaaattttatacacataaagtttagagacccaaagtttataagtcaaaagtttatatatccgattcaatttgaatttgaattcaaatattttttacatatagtatttctatacatctaaagtttatacacctgaagtttagagacccaaagtttataagtcaaaagtttatatacccgattcaaatttaaatttaaattcaaatatttttatatatagtatttctatacatctaaaatttatacacctaaagtttaaagacccaaaatttataagtcaaaagtttgcatacctgattcaaatttgaatttgaattcaaatattagtttatagatccaaagtttataagtcaaaagtttacatacccgtttcaaatttgaacttgaattcaaatattttatatatatgtatttccatacataaatttttctaactttattttcttatttttttaaaaaaatttatggtgtagtaggaagagaagaaggggaggaggaagggggagaggagcgtatcgggggatgggggcgatcgctgggcgattacccgcccattagccacacatcatctataattcattggattctacaaatcaacatccaatcatcttccttcacattatttttcataatatttttaacatatatatccattatttttataatacttaacatatattcatccatataatcaaagtgcgagatatcatatttcatctacaatctcatacagagtctaccaaatgtatttctctatgaacatagtttgacaaatcagttttatttgttgttaataactaatataattttaacttaggaatttccccagcacatcgtgggcaattcctagtgattatagaaacatcaaagcgtggggaattcctagtgactatagaaacatcaaccaaattaagctcctttaacttaattttctttgatgtgaggcaataacatttgagcctctctaccaagtggcaagtctcagtaagtccgggtgtgtacttacccacgataacactacgtagtccatccgtcttataaaaaactaatctactaccggatgtgatatatcctcgtactatgaatctggacatacatctgtccagattcatcgtactccctccgttttgagtttttgtttgcaacgtttgaccacttgtcttattcaaattttttaaattattatttattttatttatgacttactttattatctacagtactttaagcacaacttttcatttttcatatttgcaaaaaaaaattgaataagacgagtggtcgaacattgcaataagaactcaaaatctcttatattgtgggacggagggagtattagaatatgtcacatctagtgctcgattcgtattttatgggacggagggagtagggttgtgccaccaaaacaatttaagttaaattaatataaacccaaaacaatttgtttcgattatataccgtgtatatgcatggcaatgtatcttaagcgaatcaatttaggctgtgtttatttcacttcaaaattagaaatttggttgaaattggaacgatgcgatggaaaagttagaagtttctgtgtgtaggaaaattttgatgtgatggaaaagttgaaagtttgaagaaaaactctagaactaaacccggcgttaatgccaaaagtatgaataaattcgaattcaaaaccgtgttcagaaacttccggttccggacaaaattatttagcactgaccagctgtggaagaagattccacacaaacccacccctccctctccccttccctcctccttcctaccccgccgccggtgcttgtcgccgccgccgccgtcagagagggcgaggagggcggctcgaggaggagcagcagcagcagcagcaggaggaggatggggttcatctcgttcgtcgggagggtgctcttcgcctccatcttcctcctctccgcctaccaagagtaagcacgcgcggcaccatcagatctctctccctccttgtcgctggctgaccggcttctttttgttcctcgccgatttctactagtataggtcgtgcccgtttcgtttggattggttggtaggatcgaagagtcgtcttgaggcaagatccgtgcgttcttggatctttgatgtgacagatctgagagagtgggtaggtgttgttgattagcggcatatcgtcgtgcgagtaaaggcatgggattccattccactgcaaaaggagaggggggattggggatcagatcgcacgcggcgtgaatcttgaatccctgcatgatgatgcgcatatgcatcatcagtgggagcatgcatgttctttctttcggatgcaaatacagtagcatgtttgacagtttggaacactagtttgcagttcctctgatcccatatggtccaaatactccagtgtgttcatcatctgtgctcatcaattgggtatgtgacgtccacattatgagctgatttgatatctgtttgggttggccaagattgtggtgctagcagcagcagcagcagcactgtgctattggtagactgacccgtactcccaaccgattaccaaatccatcttcgtctgataacttaggtgtggcatgagtcgagtttccaacagtttgtgccgctagtggtgaagctctctcccaaccaattccaagtttatgactggtcacaatgctgagttaacatgactgttttgaacatcttacatttggtgatcttttaggttggggcctgacatttttattatctcagggtataaatatggttcaccggagaagcagcgatttggagatcacttagtgtaactgattttcgcgttagcttatgagttacattggtcagggttctgtaaactgtctactggtacaatgccatatgtaaggaacaaatgtcttgccagttattactgtatataattggtggctttgatgcataaccagtatgagctgcatggattaatgaataacacataccatttttagtataggacattgccgtggtcatgtttgccaatgttgtgacttgtgagtaataatcgaccttgtccaatatgtaacttttatttttcttgtttaaggttatgtggatcaacaccatttcaatgaacaagggtaactaaaacttctgttgaatttttcctctctttttcattagttagtattgtgtgcatgcttttttgtcccctttgctccatagcttgccaaaacctttctacttgcttgttacagtgacgttacagcagatatcactatttttttccacattatttgaaccattgaatgtatatgcttgaatctgctatcaagtactaatacaagttttctgaaggttaagataaattttgttatcataagtaggatttgttattccatatatgtctgctctacttgtctccgtggcaaaaaggacagtcatacttctcttgtcaacccccctgaattgttctccaaaaaaaactccctcttaattggtagccaacgcccaacgcttacaagtattagttcttctgtggcttgtgactcagaatttagcgcaggaattggcaatacaagtcctttggtagcctcccctgtttttgagttggttgtaaaaagtacttctgaaactctttttagtggttaaataattctttttcttctttccatgcaccttttatactgttgagaatcttgaatacaattgttcatacctgcaggtttagtgaatttgggactgatggtggaccagcagcaaaggccttgaagccaaaattcaatctatttacgcagcaagtgtccaagagcttaggaatggcagtgccacatattgatgtatgaatatttatttgatttggctgccccattctacctaatattgtttcatttacttataccattctacctctttttctacagataaagactgtcattgctgctaccatgtttcttaaaggctttggtggtcttctgttcatcatcagcagctcatttggagcattcctacnnnnnnnnnnnnnnnnnnnnnnnnnnnnnnnncacctaatgtgttttctttatgcattctgcaccatgcctacccaaagtaaaatattatgtgtatttactattgtatgatatatgtagttcttattgttttaccatataaattggcaattttagctttatttctgctttggcacagcattttgatacattttaacgagattttgtccttttaaagtcatagcatctggaaatggaaaactaacactattttcctaagagctcagtgtgcatctcattgtcagtgtagtatatttcacttgactggtgcatataagatgcactttggagtttggagtttgacatgtgattcaccatagtccaaaggccttcatgtttttttactctggaagtaaacaaatgttctgtaatcccatgaaaaacattaacccattcaaaatatatgtaattcagatctatatatgtcacagcaacactatggatctaagtattttaaggatcctgggttaaaattattgtgtaaatgtgtgctttgtctagtgtaaccccatagtatttctttccctttctaactattcttcacattctttgtcggagattggaatactgaatatcttgctcatttgtgcagctcctgtacttagcagttataacacctgttgtgtacgacttctacaactatgaaatggagtcttcacaatttgttcagcttttcgtcaagttctcacaggtttgttagcccaccacctcacttactaaagtttttatttcaaaataattcagccgttcttgttaattgttacaatccccgcatatttttcttgtctattcagaatttggcactttttggtgccctgcttttcttcttgggaatgaagaactctattcctagaagacattccaagaggagggccgggaagaccaagacaaactgaaaccagccactgtagtaggggaagctatttgtgctccttatgtttgcatactttacaaagtacatgtctcaattttcctcttgatactccatagaaattgtgaattggggacttaacagaacctagtatgtaggatacctaagtatgtctttatcagttctgttatcggtatatcccggtgtgtttcttctgtcatgaaagtaccattttgctaccgaaattggttgtctatggaagatcaaatagattcata

SEQ ID NO: 34872 - DNA, 11143 bp, Oryza sativa
  unsure (1)..(11143): unsure at all n locations
nnnnnnnnnnnnnnnnnnnnnnnnnnnnnnnnnnnnnnnnnnnnnnnnnnnnnnnnnnnnnnnnnnnnnnnnnaaccaatatggtgggttttttctgtcacattcctttagccattgagcctcaccaaattgatcttgagcaagccttgtttattgtgaaaatgctctactcaggccgaccggtgcggggggagccggatcagacgctccccccgcgcaccctacccccacgtgcgcatctgctagactcacatatttctcccttcccttttacacaaaagatgtttcatctagtatatttacaacattatttataaatctaatgttgcagtgaattaaaatattcttttgcaacaaaaaacccatatattttggaaactctctattaagggaatttggtttattttttgttccatcaaaaatgtttcacctagtgtacttacaatgtttcactatatatagatctaatgttgcaatgaacgaaacattccattgcaataaaaaacccacatattttggaaaccccctattaagggaatttggtttattttttgttccaccgagaaatgtttcacatagtgtactcacaatgtttcactatgtatagatctaatgttgcagtgaactgaaatattctttcgctatttgttgaaacattgttttaatatagggtgaaacaacacccgatttaaacgagtgaaacattttcgatctacttagtgaaacaattccgatatacctggtggaatatcgtgcaatatttaaaaataattcaataataagctaattttttttcatcggaatatatccatgtgtggtcttattttgaagatttaattgcaacgaatttaatggtacaatcggatcatgatttggataagtaatttaagagataaatcagtttaaattaattttgcacgtaaatcgagcgctaacgtcatgctgacgtcagcgcccgattttacccctccggatcgggcgcccgaccgggagtcatcatctcctgtttgtttattggcttcaactttggataatatggcaatatacattggctttattccgttactcatatttgcttgtaatttaagtgattcaaattgagattgacccaaccttgtttgttggttgtcatggattacattggtctttcttttgtccaatacatggaaaatacatatgcactatagattgggggcctcaccaaattgagttttgagtgaatcatgtttgtgagctttcttataaagagattgcaatgatattttcttttcccaaaatgcagggatgagccggaggactcacatgcacactatatgcatgcatccgtgaatgtgtcctcaaacagtcaaacagatgaggagccatcgttaaatccataacctcactaaaattttattcaaaacaaactcacatggtaaaatattgggcttgtttttcaagcctggtaatggaaaagttgcctgatatatataggaataagttcactttgactcccttgaaagtgatccgaatctaatccgtgaccctcaaccgtaaaatcgtataggatgtctcccgaactattaaaatcgatgcaatttgactcccttggtggttttggaggacggttttgctgatgtggcgtctatgtggcggtgttgacctggtcttcatccaacatgatattgacgtggtacttatgtggtaatagaattaaaataatatgtgggacccatttatcatttaaaaataataattgtgggacccatgtggggcccacatgtcattatctatctcttttccttcttcgtcctccctctctctcttctctcggtctctctctgttctctttatctcccccttctcttcgtctaagcaccggcgaaggaggcggacttcgtctgagcaccggcgaaggaggcagacgaggggttgagggccgagctgttgcgggagattatcgaggactggggcatcatagcatgtaatttcatagaaagaataaaaaagatgcgaatattagggaatgacctaatatcaaataattagaaggaatgagacttcaaacccaggtcgtctagtccaccaccttatgaagctagccggaagacccctgtgtatttctcgtaatttcatagaaagaataattttccatatttcattgtcaagaaccgacgcaagaaattcagctcactccaaaaggggatataattcttcttgtgccgtaaatgtagatttctacagaatgaagggacaattacaggggatgaggaagagttagtccttacaggcatgcaagctagagtggtgctgatgagccccgtgatggggtcggtggcgagggcgagcacagcaggcaaggcgatggtgaggatgtccatgccaatctcatcaaccatgaaccacccgcgcccgagcacctcctttcctccgtccttcccctcgggcttgtcctcccgccgccaggtctccttctccttctcgtcgtctaccacgtcctccaccgccggcttcgcacggcaccgcgcaggcctccaccgaggaactacactatggcagtgatggtgggcgaaggggaaggagagatggttgagcgctggagaagtggttaggacaaacgcggcggcgacagacctcatcggccgcgaggtcgccgtcatgccacgcgagcgtgtgactgtggactgtggttgagcaccgccttctgcttggccgacgccgctccggccctcgcctgccaccgccgctgctgctccggccatcacccgccgccgccaccgctccgtctcccccctgctcgccgattgcgccacgagaaagaaggagagaagggagagagatggaggaagaagagagagagagggaggatgacatgtgggctccataatttattttatgtgtgaatcatagttttttttaattctaatgccacgttggatgaaagactaggtcaacattatcatgtcagcgtcacatcaacaaaaaccatcctctaaaacttcctttcacgtcctccgtctagcccctcgacctacggccagtccttttacgtgctactgcacagcgccggcggcacgggacgacgacgaccagtcgaccacgatgcggggatactgcaggtgctctcgcctctgacagcaacgggaacgtccacagcgggcagctcgcgccgcaacaggttgtcgatacgggtggcaaggaggaggaggatgcaggtgacagcggtggcagggagggattgcgtgaagcggatcatgggactccccgacgcgtccccgtcgaggagcgggccaaggtgctcaaccccctacagcgtgacgacagtacgcttaccgtgtcggactaaatcagaaacaccatttttttcacttcatatgtggattttaattgagctatatatgtgcagttcgtgagttctcatctgaaaatattttctggaagttcttgcatttgttcatcacaccagttcagccggcgtgtgtgatttgtttctctagtttttgcgttttttcttcacagcagttcagccctctccgtgctcgccaaagccaaggactcctccacgatcgcgctccaggggttgctgcctggaacgttcgtgccggtttcctattgtagcacaaagaagtggagttcacactactacgaaatcggtttttccatgacggggaaaatcaatttttacaagcgaaaagacgagccaccagcaaccaaaggccagagcgggcctcatccacttgtgaaaattgaatttcgcaggtggcgtattaagaaatctgctagcaaaaatcgaattttgcaggcgtcgtcctaagaaatccgccagcaaaaatggatttttttttgctgacggcacctttaggtcaaccgcgagtgaagagatttttcaaaaaaaaaatccacatattcatcatgattttcaaaacaaaaacacctcaacatcattttgaaaaaaaaaaaactcatcaacatctagattcccattaacatattcatcaatagatcagcggattcacatcaacaaattcaacaaatcaacagattcacatcaacaaattaacatcaacaaatccattacagtgaagcaaatcgattttcacagcatgcatctcgtcgccatccaccgtcgaggggcaccagcactagatctggcggacacaaagtcatcctgccggtgcagtcgccgtcgagccgaagagaggcggagggaggtgggaggccggaggcgcagagaggagagagccgcgcgccatcgctaccgagccccttgctgccaccacgcaccgtcatcactgagccccgccacgtgccatccaccaccgccaagctctgtcaccgtcgatccccttgccgctgccgagccccctcccctgcgctgccgctgacggtaaagcgggttggacgtgagctccatagcccgcccacagcctcgcctgctgccgcgagcctccccgcccccagtttcgcccgccggcgcgagcctccacgcctccgtacctccccgccgccagatccgccacgtgcgagccttcccgcagcctcgcctgacttctgctggcccgcccaccgtcgcgagcctccatgccacccacgtgccttcgcgccaccggatcgccacgcgtgagcctcctcgccgcctgatccgccgccgcagctccacttgccgccgccgccaaccacgattgagggagaggtgggagtggaggggagaggagaaatggatctaagagagaggttgagggagagatgcggtggagagatggatccggggcatatttatcctcccactaacagtttttttaaaaaaggcctcccacttggacttagtccccacgcccccacgatcttttttacggcggctgttcttataccccgccattaaaaatagagatattttcgctggtggttgtttaaatgggccgctagcgaaaatagctatatttttgctagcggtccacttaacctggccaccagcgaagatccatttttgctggcggtccgtagccaccgatcccccgttatattttcgttggcggtttcgacgtataaccgacagagaaaaaaaatgggtgatgccataaaaaattgattttgtagtagtagcgagcgaacctaagaatagatgaggaagaagaaaaaaaagggaagtttgagattgacaggtgggacccacgctgattccgtttttaaaacccagacatcaaggatgaggggtcaaaagtgaacttattcctcgacctgatcccactagagtccgtccagcctattgaatttcaactcgtttgttcaagtctcaaaaagaaggaaccatcttgtggcccaactcgtggaggatatattagtcgaaatcatatgcgtctcttcgtcccgcccacgccgccaacacacacgacaaccgcttccttggcacgcatccccccgctccccaagatccccatcttctccagcgatgccgaagccgaacccccgcaccgcctcttcctctgccgccgccgccgcgtcctccccggacaccgtacgcaaggagcgcgaggagaacacggtgcccgccgtgtacgacgccagcgccgacatcgaagatgactaccgcttgttcttggagaacttgcttgtctacgagaacgaggactttgtgctggagtacgagggcaaggtggtcaggtatggaggagacgaagccgtttctgctggtggtggcagtagaggggaggatccggtgatggagaaggagaaagagaaggagaaggaggtggacgttgtggtgatctcctcctcctctgacgacgagtctaccaagattatttcggagcctaatccgcttgacagaggcgtgtttcagtgaaaggttaatacatcgttccacttcaccaatctcttttttttttctttggttagttttgctgcatttctaacacaaattagtgttgttggcagatgaaaaaggtagtggacaaggaaaagatggatgagaagaatgaggctgctgcccctcttgttaaggggaaaggtgttggaaaggttagttctcatgaccccggttgtgcttgtttcaaagggctgatgtgagatgtggaagagaaacatgtgtgatgtgtatgccgtgtgcgcgtgcaggtgatcggaatggaagtagaagatgagcagcttgtgctggctttgccgaaaccgggcacgacgactagcttgacaaacccaagcaaacgccatgaaaccgagcctcatactacttctgtgagaatttcttgcacatgctgcttttacctgttcatgttgttgtcgattagaataaggatcgacatctgtcacatgtggttgttattggtgcctagtgtcgtagatatgtcaaatctgctttgtagttctttcagctcgtctaaagggtgtaaatgtctaggattcctatttggcgcggcacagagtccagtagtccggaggcagaggagttcgatttctctcttcttgttccttcgctcactcattcccttatctttcctccattcccgatcgacaactttgatagagctgctaatcgtcgcccattgatcttccggccacaatcctcatccctgtcgctgtctacgttcccagctgccctctattccccaatccccctctccatccgcgtgccctagctcctcaaccatagccatggggactccactatcaatgccgccgccatgcgtcgcagaggagtagcagtagcaggcaccaacgacatggtcatagctgcggtcgtgaccgggaagatggcgaccttgaggaagaagagcaattttgactatgacatgaaagttttatggatttttcaattgaaagttttgtggtttttcgatgaaagtattcattttatcgcaagtttttgtgatttttgagatgaaagttcctgattcgaactgaaagttttgtgattttgagatgaatgttttcatatcattgaaaagaatggtttttgattttcaagatcaaagtttgaggaagactataagttacagttaaatcattggtgcaagaagcggcagatgtcgaatgaagcaaaagcaaaaccagcagctaggagagcaggcatggctgtgcgcaacttccgttgctagcgcagctgcgccaactagcaacccccttcaatgttttctacaggatgactaaaaataatatctgaatccacgctagttgtaaagaaatggaaattgttataacattgttaaagatagaaacactttggctatgtttggataatgggtttgggatataatttcccactcctcaaagagtaagtttcaattctagccatccattcttctcactccatttcattctatccctccattcatttctatttcccaatcccacctctcctaacccattatccaaacatatcctttcaccattggtcatctactttgggcatgcgtaatcaaactttgccttacttgtccatgcaattccttgtaaacaagatagtggaatagcttgcacttgaaaactagtaaactattttccattatgaatttcgattgtttttagttaatacagatcacgtcccattcctttcccctctaccactcatttctctccaccaccttatccatatcctctccaccatccttctctctctcatgcatccttctctctctcacgcgaagctcagaggaggagtggctggggtaggggcagcggcggcggtggctctaacgagctgcggcatcggtggcggctccgaggaggagcggcgtcggcggcggctcgagcggaggggaggtgcatctgcggtggcgcgggtggaggaaatgtgcgtctgcggcggcataggcagaggggaggggcgtcggtgtggagattatggatatcccatatctacatggcgacgatatttggactggatataggataccgaatatatatagaatatcttatttgtatctcgggtttgtttcttaacttgtacatcaaggaaacaccttgagacttagtcggttacgactgtattttacctgtatttgtatattccgttagggatatagattatcttttgtaacccggactccttcctatatataaggggggtccgggcgcctctaggggcagagatgttgattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacagttggcgcgccaggtaggggtagcgtcaagcttttcgccgatcagtgcaatgggtttcgtctccggcatcgacgacctcgtcttcccacccgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagctacttcaagaccatctcaatcgagtcggcttcaaaccactcgggcgagatcgcatcttctccaacgacaccagatcaagatgatggggcttacccaccagtcctgatgaagctccccgacgatttagcggccgtctccaccacgacagcgtcttcatcccgtaggcctaggcggaagtcgacttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttgaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcagtccgaccacgtcgtcaacatcttgaaccagacgaagaccatgattgcggcttcggtcccagttaactccgaaagcgtccacacgccgactggtagccgagtcccccacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtggcttaccgtctacggtctcgcaatccgcgcagcaggaggagacaacaaggccatggcgaactatttaccagtggccttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaacgcaacaagatctccgacatcaccgacgacgttatcatcgccgcgttcaccaaagggattcgccacgaagaattggtcggcaagttcgggcgcaagcctcccaggacagtcaagctcatgtttgaaaaagccaacgagtacgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagattgcaattaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagttaaaaccaagcaatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggag

SEQ ID NO: 34873 - DNA, 4396 bp, Oryza sativa
  unsure (1)..(4396): unsure at all n locations
caatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggggcatactgctacgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagttgactgggtgcatggcggcgctcagccgatttgtttcaagacttggtgagcgggggatgcccttctttaagctactgaagaaaacagatgatttccagtggggacccgaagcacagaaggccttcgaagatttcaagaaactcctcaccgagccacccgtcttagcttcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagtaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactgcggattgcaatttccctagggataaagcgtctaatagttcgaggcgattcacagctggttgtcaaccaagttatgaaagagtggtcctaccttgacgacaatatgatggcatatcgacaagaggtacgcaagttggaagacaagttcgatggactcgagctcagtcacgttcttcgacacaacaatgaagccgccgacagacttgccaactttggatccaagcgtgaggcggcaccctctgatgttttcgtcgaacacctttatacgccgacagtacctcacaaagatactactcaagttgcgggcactcatgacgcagctatggttgaagtagactggcgagagcccctcatacgatttttgacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgccgctgcacgcaccattgttggcaaagcttaccggcagggttttttctggcctactgcagtgtccgacgccgacaagattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgacaaattctccaagtggattgaagctaaaccggttgtcacaatcacagcagataatgcgcgagacttcttcatcaacattgtgcatagatttggagtgcccaatcggatcatcactgataatggcacacaattcactggcggagtttttaaagacttttgtgaggactttggaattaagatttgctatgcctcagtggcacaccccatgagcaatggacaggtggagcgagccaatggcatgatacttcaagggattaaagcgcgtgtctttgaccggctaaaaccctatgccggcaaatgggtgcaacagctgccatcagtactttggtctttgcgaactacacccagtcgggccacaggccagtcaccctttttccttgtctatggggcagaagcaatgttgccgagtgaagttgaatttgaatctctgcgctttcggaatttccgtgaagaacgctacgaagaggaccgagtggatgacttgcaccgtttggaagaagtccgcgaagcagctttgattcggtcggctcgatacttacaagggttgcggcgttatcataatcgcaatgttcgatcccgtgcctttctagtcggcgacctggttttgaggaaaattcaaactacacgagatcggcacaagttatctcctttatgggaggggccatttatcatctctgaagtcacccgaccaggttcctaccgactcaagcgcgaagacggtactctcgtcgacaactcttggaacattgaacaccttcgtcgtttctatgcttaagcttatcattgtatttccctatcttgactgtcaccatcaagttttcttcttgccgttgtcagtcgggggctatcatcataataatggagtgtgattttttatcaatttaatttgcttacttggtctatcattgccttgtttgattttttctacttagtctgcgaggattgaaagtttttaatagcttctttgggttttaggctcaacaaagcttgataaaagcttttaagaaatcaaagacttggttagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttacaatcttgtcagccgcactttgagcattactgataagatcaagagcagcttcttcgcttgtcccgtctgcaaagccatcaatggtatcaatttcaatcctcgggtacaaggatttggtcatcgccaatgccatactagctcccatacttccagcttttttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctccttnnnnnnnnnnnnnnnnnnnnnnnnnnnnnnnnnnnnnnnnnn

SEQ ID NO: 34874 - DNA, 1112 bp, Oryza sativa
atatgtgattaggaggcgtcagaggcctatagtatcaggtaacaattcgtaatactctgaaagtctgaattcctgataactattttgttcagtttactgggattttttttgccccttgagatgatgacccatcgtttctcccacgtcaactgaatagtcatgaaaaaaattgataagatagattaacatatgatatattgctccatgagacaaattaaacttctacaaattataaaaaaaaaacttctaatgtatgaatactttaatttgttgttttctacaatttgtagaggttaaaatttaactttacatgtactattttttatattttttcataactatttagtcgacgtgcacaaacgagaatttgactttatatgtaatatattttatagttcttttgtttttttaataactatttgacgatgtgctacaaacgggaggcgtctagagaggagaaaatcatccccatagttttctactccctccgtttcaggttataagtcgttctgactttggttaaagttaaattattttaagtttaactaagtttgtagttaaatatagtaatatttataacaccaaattagtttcatcaaatatataattgaacatattttcataatgtatttgttttgagttaaaaatgttactacttttttttctacaaacttaattaaacttgaaatagtttgacttttaccaaaaacaaaacgatttataatatgaaacgaagggagtgctttgatatacaagaaggtgtaaatcaatgcaattatattcaccagatgatgatgcgggcgttccagctgctactgctgctgttcatgctcgtcctaatcctgctttggctgccccttcaattaatctgtctagtgtgaaggaggctacagggaatttctctgaaagcaatatcattggcagaggtggtttcggcattgtctatcaggtctgcacttttttcaacaatttgacacctttatgtacgcaaactaagttacgatttgacttcactaccacaaatcttgaaatgcaaagtctgcattgaaacatctgattttacaatcaccaggggaagctgcccagtggtagaaaggttgctgtaaagaggc

SEQ ID NO: 34875 - DNA, 646 bp, Oryza sativa
cggtatagttattttgaatttttatggacatagagcattccatggtacttacataagctaataggttgggaaagtccatcagccgaggtaagctaatcttcagaccacttacaatctccaagagtataacaccatagctatatgtgtcggacttgactgaaaaggcgccatccattgcatattcaggagacatgtaaccactgcttaacagttttagtaataagtaacaaaggatttttcaggaaatcaatgtaatagtaaaaaacaaattcctggatcactcactatgttccaacaactcggttagtattggcttcttgctggttgccaccgaagattcttgccataccaaaatcagatatcttagggctcatatccacatccaacaagatgttgcttgatttgagatctctatgaattattgtcaaccttgagtcttggtggagataaagaagtcctctagctactcctttgattatcttaaaccttgttggccaatcaagagcatacttacttgcaggatctatcaagaatggtatacaatgttcttatagtaaggataattttatcatctttgagaaagtactggtaagtatcacattgtttattgtaaattttggtaccttcagatactaaatatctcaag

SEQ ID NO: 34876 - DNA, 490 bp, Oryza sativa
tatgaatgtatataatggacgctgctcaaataacagcctaatccatggcaatcttggctctttctgatgtttacctgtgccagtcacatctgtggttgctgtacttcatcaactacaggtagtataaacggccgcccatgtctaatctgaggatgtaatttcaggacaaagttaatcagttctgttactgtgttcacgtgtggctgttgagtaaggcattgaagcatttccactaggaagttcacaaaaaattctaatgttgatacacattcattagtgcgtgaagcaccgctgaagcagagggtgtgaatagtctacatagttatcccagaagcccttgtacttctccatcccaatttttagccatggcttcatatttccattgtaatgcaacactgcaccttctttgatagtagcgggatccactgttgtgtagcccagtcccaagacatgccatttggggtccaatggctcaaccaagccatagaaa

SEQ ID NO: 34877 - DNA, 358 bp, Oryza sativa
cttgagctttccttttcccatttttgcgattcttcttcttgcttgactcaggtgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgggtagtatagcgatctctgacaccggatttgaaggcgcgaattacagaagcatcggtgatttcggggattgtatttttgcactcgttgaagcactgaacatattccctcaaggattcacccgagttctgtgtcaacgcgtgtaggtcgtcttcgatcgcgtggcg

SEQ ID NO: 34878 - DNA, 612 bp, Oryza sativa
ctcttgttgggcatgtattcatacagcaacatcttctcttctccatgaacacaacaaccaaagagcctaaccaaattccggtgttgcagtttggatagaactatcacctcgttcttgaactcttccaatccctgactggatctgtttgacagcctcttgacagcaatctcctggccatcaggtagtaccccctagaagtaatatcaactatgttggttcaggtattgatcttatagcattacgattttgaattccaggtcagaacaaagatagtaaaaacaacaatttcattcatattaacaagataggataaaatgataaaatgtttaaatgaccataccttgtaaacaaaaccaaatccgcctccaccaagcttgttgctaaaattatttgttgctgaataaatcgtgctaaactcaactagtggtgagcttagaactgcggatttcactgaatcacttctgaatatagcttcatctgcaggtggtccagcttcttttgtgatcagccgtggtgcttgtattctccttatgcctgcagattagtaaaaatattagatataaacctaccagacagctgttaacgcaaactgaactatatcagcaatctcta

SEQ ID NO: 34879 - DNA, 640 bp, Oryza sativa
cccgccgaggcggagaacggaacatcgacgacatccgagctcgagaaggattctaatgcggccaaaccttgtcgttccgacatgaaccgcgagctgacgaagatgacttccgaagtgacaaggtcctggtgtcctatccacaaaaccaggaaacacactttgtgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaaagagcttttcttgtttaaaaatccttaaattataaattgttgtttaaaaggaattattagaaatgattttaaaagcttataagagaagatctaattttaatttggtaaaatctcaatataaaattgggctagataaaatttcattaaatactttgcttaattctataattcctagatttttctgggatttatttgagctaagga

SEQ ID NO: 34880 - DNA, 605 bp, Oryza sativa
ttgaagtcagaatgaggccgttcaagtctcataattcatctaaaaatatgatctacatgtgggattactttttatgtattgtttatttggtttttattagtctttttcctcgttttgcgtgatagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagcttcacgatggtcaatcgtgattggttaattaattacttgccaactaaaacttgataatggcgggttgtgagcacatggttttgagag

SEQ ID NO: 34881 - DNA, 374 bp, Oryza sativa
ccgtttttcaggcctcggacgcgtctctaccgcctccacgacgacaacgtcttgtgacggttggcgagaagtaagtagatgaacttaagtctccgtgattttgttcgagtgttatctgaaccatagctatctcatagggcggcacgggcgaaggcggtgcaagacgagtctggagggacttccggcgtgtctcccactgcagcctcgacggatgtcgtgcttgcgcccgggagacgcgaggcgacaccaagcggcccagtcagcaatcctgcggctggtcgtggtccaccggcggccatcctcacctgggaggagctccaggtcgagatggggcgcctcctcgaggctggtgctcgcggcattgcccgtgagat

SEQ ID NO: 34882 - DNA, 365 bp, Oryza sativa
cggtatctggccctgtgtttgcagaacaaaaagagtgtgaaatcatgatgatggttggtctcccagcttcagggaagtcaacatgggcagagaagtgtatcaaggagcacaaggagaagcgctttatccttctcgggactaatcttgcattggtgcaaatgaaggttcctatgcttgtttcacaacttgcatgctctatgatttccactattttcagtttatgactttccttttgcaggtgccaggattgctgcgtaagaataactacggtgaacgctttgaacgtttgatggatcgtgccacaatgattttcaacacattgctgaccagggctgcgaagatccctcgcaactacatcatcgatc

SEQ ID NO: 34883 - DNA, 343 bp, Oryza sativa
aaccaccaccttcggcccctatgctagaacttggtagtggctttgggcctgaagacttatactcgttctttactaatcattttttcttgatggaatccatcagtctaccaccatatgatgttgtagatgtgccgccggtgatccctgttgcactacggtcggggagatctaaccaggggcttcctagcaagctaccgcttattgaggggcataggcggtcgcatagcgacatccccttcgggtattcacaagaacacccacaaatgccacctgtagcatcagttaagccggaggtcacaacgatcaaggggcaccaattggaggatgtggcggctgctgccct

SEQ ID NO: 34884 - DNA, 764 bp, Oryza sativa
attatggatatcatgtattcatgatgtttgtttagtacttaagcacataattattacaatgggtcgttcattgattgttgcattgttgtcccttgcattgttaactcgatggtatattgcttgcatacacacataacatccaacaaatttaatccgtttctgaaccgagtccgcaccatttccaacatctgaaacaatccgctcagccgctctgaatccgtttagaaaatatggtttaggatatggtatgaccactatccatccgaatctgctccatttttacccctatatactagtcatgtcactgctgcggaaaccctctttaaccccggtttgcaaccccctttaatcccgggttgcaaagcgggactaagattccggaactaaagatcgctatctttaatcccggttgaaatacccgggagtaaagatgcatctttagtcccggttgggaacaaccatctttagtcccgggactatggtttttttcttttttttcctccttcggttttttttcttttttttcctcctttcatgatcttagattcacagcacagatatcacaaattcattcacacatatcatcacaaattcattcacaacaccacaaattcattcacagcacatcatcggaaatttattcacataaacattcacaaacacattcacatatacattcacaaatcaacaacatccacaaatcattaaaaaaaatcaagaaaaactcaaacaaatcaaaatccacattggcatgtgccaaccgg

SEQ ID NO: 34885 - DNA, 9907 bp, Oryza sativa
  unsure (1)..(9907): unsure at all n locations
tcctttttttttttgtaccatggtcatgtacacttcatcaacccaactaaaacaatggaacctttttatttcttattattacatactcatgtttgattgtattgaactgccaggttgatatgtccgtctttgtgctatctcagtgcgcaagtggtaaagctgcatagaatcttcaataatcatgccccttccgcttacagattcgtttgtaataatgttgttttttatacttctccttctacttgaagtgctttgatttgaaatactggttagatcaacataagttgacaaaatctataactattatacataggaagagtgcacacaagaaatctgaatgctttctgttggcagagttgtaccatgtttcatagtgatttgggagggttgattttaggaaagggtgatacatcataaaagtagcccattcacttctctttttattttcttgattattgccttttatgtccaccaatttgatacttttggtacaacatttagccaaaatgcgattaggttttcttctatacatttcctacaatggttgacatataagttatgatatgtttgataatataggaactgtcggttggacctaaaataaattccttaagaaacctggggtgttctgtacctagtattcaaggattcattgatgctaatgaagagccaaattctgaagattcatggttgtgctctccttttcttgccagaaacatttattatgaaggttaaacgatttaggtaacaatattaaggaaattaatttgatgtcatgttaggaataagttgcatgacgtctatccatccattttgagtaagtggagatttattacaaccctattgtcttttttactctaaataacagccactataaaatgcataatacaatattttgtttggtgcttctttgttcattctttatactattaactttcaatcttaatttttctttgacgtgctaccttctctcacacatattaaattgtgcaaaccacattttccactcatagtatccgaatcaagttcttgacatatggtaagacaaatttgttataagaaatcaacaattctcaaatctcacccattcaaaaaaggacattttctttacaattgtataaatacatgcacattttctgaatgtttaaaggatgtactgttgttgtagatgctatacattactaccgtgatgcctgatgaatgcagtttctaaagaaaagcatttgtgttcttgaaatatattcaatacaacatactttaaacatgcatgatactactttgcaaaatgaacaaatgaatgttgaaagacaaggaaagagagttaccatctccccactgtgcttgctgatccattgcttgcagtctggtttttagctcattgttcagagatacaagtccattgttgttcctctgcaaacaatataaaaaattactaagattgtgaaaactccgaatcaaaatgaccacaccttctaataacatacctgcatcattgccacttgtgctcataatgtagcagtctccaactgcaacacctagaatttgtgttgaagctcccctatatacttcatctttttctcctttgactttgcggcagatgatcgattgttcaggatcctgaaaaaattacaataagatggtgattttcactaacaaagaacattgtgtcaaactatcaatccgcatgcacggactagtacacaagaattgaagttcacacacctcttgaccctcctaggatcagtcaagacaatctctgagaggaatttatccgccacaaccttcttcttatcatcctcagtgaatttcacatttggcaatggactcgccttcaccaccatttgcctctatagttagcagaggggggctggacatctgctgtccaacagctccaaaattgaggttccccatcatgaagctgtcaaccgacgagctgtggcaatggtgggttgtactgccagcaccagagctcttagcttcattctctctgcttccagaagggctccatgcctgtatgcccatgtccttaaggacagcagccaccatgccccccgattgatgcccctcggtcgttgtgacctttgtcttaactgatgctataggtagcatttgcgggttttgatgtgaataccctaagaggatgtaactatgcgaccgcctatgccccaccataagcggtagcctgctaggcggcccctggttagatctcgtcgaatgcagtgcaagagaggtcatcggtggcacatctatggcatcatatggaggtggaacgatggattccactgagaaaaaagtattaggaaagaacaagtaaaagtcttcgggtgcaaagccactgccaacttcgtaccatagaagccgatagtggtggttccgagcagggggacaaggcagataccgtcgaagaggtgaagtgggcaggagcagggtggatcaacggtaggaatttcgattggtcgaggcacttgtgggaggcgaggttgaggatggaggggactcgcggtggaaccaccggattctcgctcccatcaccgcaccggtccaacaaagagaggcggcacgagggttcgccctccatgttcggcacaaagcaagggggacgaagtggcgcggccgctagggttttggggatgctaccaacaagcacgaggatttgttgattggtaatgcgagagagggaagcaatgagaaaattgtgaaggttgtatttgtgttgtatgggtggcatgcaaaaatggaaaggcgcgtgggataaaaccggcatcactctctcatcttgtattttgttctgagcacacgcgtatgacttatctgggccaaaagcccataagcaatgatgtggcttactcttaagatggacttctcatggaactactggtctggtgcaagaaatatgtaatgacacatattcaatgagatgagtacagcacatttttttgcataacttttacttttcaattgttccactattaggctggactaaaataatcacaagaatccaatgaccactactattagctaaaacatgagtgtattgttcatctcaaaataggtactgaaaattctcattatgccatatcagttctaagttttgtaagctaagcttaattaagtcattatgcccttgtaagaactattccctctgtttcatttttattttactgaaaatactagtacaatgtttcccccagtagtcatatctccgttttatattataagacactttgacttttttcttagttaattctttttgtcagtttgacaaactttatagaaaaacatagaaacgattctaacaaaaaaacaaacatactatcaaaatattcaatgttagatttaatgaaactagtttggtggtctagatgttgctaagtttctctatacatttttctaaacttaagaaagtttaactagaaaaatattcaaaacgctttgtaatatgatacggagagagtacttgatttccattagtggaaatataggggtttctctcttgatcagaaaaaataaatggctgtcgttgtttcatacactgtgcaaaaatcagtcctctgaatatctgatgcagaccagtcaccagtcaccccctatatatggttaaatttgtaaagaaaaggcaaaatttgctacaggatactaaaaaatcgtgtaattagctgagggacactgaaaaacgtgacactatcgatggacactacaaaattgtgtaattggatgtaggacaccggaggcactattttctaatttctaggctgaaagaggggagagaaattttgaaatgacgggaatgcccccctctactccttcctttcttctcgatgcagctgacatgtgggcccgcgcacaatgctgtcgtcctcctctctccaacgcccgacgccactgcatcccttccaaaatccgatccattccctcgcccgtttccaaaataagttgaggggatttgatgtcctcactttcctcttcgatttccctcaagaatcctttgatatcccaatctaaatcgctcagatttgagtaaagttcgagctttcctttacctacgaagaaccctaattttcctaattctttttcgccgcatccgagtcggattcttcctcgtccacctttaaatagcatgccccagagctcctctctcaaattcccctttagccctggcttgccgctgcccggaatcctctcttcgcgcgttcgagcagatgggggacgatgagaggacgacgacttcctagagcacgctcctcgtggagtacacgtgggtcgaactctgggcagagtgcgtcgagtcatttgatgccatggtatgcaagagatggaggcctgacgagagctccatggttggcgtgcgtacctaggtgcccatggcatcgagaaggtgacggtggtgttcgacgtgatggacgacaagaacgcgtggacaattctcacatgtctcccttcttgcaaggtccctagctgggcgcacgcctttatgaagatgaacgggaacatgtagctgtcgggctcgatgccatgctccaccatgttccaccatgtccatgcagaggaagaagaaaggaaggagtggagaaggagagagaacaagaaaaagggttgaaccgtacttttacatatatttctctctccattttctttggaaataataaaataatgtcgtgagtgtctggtagctaattatcagttttttgtgatgccctacagaaaatactcgttcttgcaatgccctccaactaattacacgttttctggatgtcctgtagcaaattttgacaaaagaaaaatgagtgcttgcagggattcttctttgggtatgctagcaacatcgagggcttgctagacaccttgttcatgttgctatcagaggctcttgggcctaagtagagttacctggatgcaaccaggctgccaagcaggggtagatgataatttgccactactaccctctatgcccccagcttgagatcgccatcaggacaacacgccattcggactccaacttcctgaccgtgctcctttaggatcaaactggtggcctgcaagtcctctttgacaatcggtgggtcgatgtcacgctgatacccggagcactcatcttcaatataggcaatctcatgcaggtatcatgttcagagttcatgaaacacacaatgagaagaataggcattgccttgcagatatcattttcagaatccacaaaaatacaatgaatcttgcagataccatcagaatccacaaaacacacaatgacttaggtggtctcttgctggtatcaagttgagaatccacataacacacgataatcaacatgaaaattcaaaattttgttttgagacaacattaaaaacccaacttgtttaccctacattattgaacatatatttttgagaacacgcaaaacacttgcgcatcatttcatttctgaacatatatcggagacctgttttaactaatgtccatatgatctcgaatgactagttcaaaagcatggaacattcaaacaggggcacaaagttcagggccaagagtatcaatcgcgtgtttacccagcaaatccagcatcgacaaagatgttcagtccgttcaaatagctgttgtttgatcactactacacaaacgatttttccgtgcggtcgaaactcactttcgcgtgcggttgtttcgcccgtctggaacgaagggtctgcgaaaatcgtgattttcgcgtgcgggcgcttaagccgctcacacgggaaaatagaaaatcgaaacaaaaaaaaagaaaatcaaaaccaaaaccctaaccctaaccctaatctagccgcctgtcgggtcccaaaactaaagacttagatccgactaagattaatgtatcaatccctggatcagtaaatattgatgcatataatacagctggttcttcattgcatacgttaaagtttacaatactaagagttttacaagaataggtactcacctaattaaacataggtactaatattacacagcagaagttctaacacattctaactaggaaagtataacctctaaggattttctaagttatcagggtcgtcatagtaataaacataggagtcctcctcttgacccaaatctgaaaaagggttataagagcaagggtgagtattcacaatactcagcaagttaccaaggaaacatgttatgcattggcatagagtagagttctttgcaaaaggcaataatagacaatatggaagtattaaagcaagagtttgtaaaacatatactttaggtttctaaccaaggtaccatatgagtcccggtactcaattccgtgagtacggctattcgaatagtttcatgaatattctactgcagcagatgtacgctttacccgtagtccacgacttgccaattttcattagcttagtcatggcccagtattaggttattaacaattgtggtacctgttccgtgaacttatatcctcatgcgctctgaacgtgacgttaacagcagtgagagcagttctggcgttcccggggtatttaaggggaactgatcgtatgacaccacgtcatctcgatcagggtttagaattaccattatacttataattatactcgagtgtcataaaccaattacctgtacatggtaatggtaaaatttgcccttcgcggctatagttgcctcctgctcgaggacttaaaaataaataccatgatatagaggtaccacattgctaattaacataatgactaggtctgtccccattctagaaactgcggtcatacccattcgtttgacataagtacctgataataactatatcgatcgagacagtactagccaccaagaaatcatcccattctaacgtactgtcccaatttaagtgtaagacattttaaccagattgtaagcagagtaagcaatactaaattgtctgggtttctatggttgaattatgcataaaaatagagtattgaacagaaaggctataaataaataatttgtaaaatataggcttaaatgatcaaaagatgtatagtaacttgccttgctcgatgtccggagattgactgatattatctagtgtgtcagaagaatcctcaaggccaagggttagacatataaaatttaaattcaaaaagggattcaaataaaatcctaaaataggaaaaatataaaataaaatagaaaaatagaaaaagtagtctcaaaagatagagaatgattttaggagaatattggttcaagtttcactgaaattggatctatattttaaaagatatgggcttctaaagtttgaaaatcaaattaaatgtgaaatggcactgtgtacgggtcccacctgtcagtctctctctctctcttctcttcttcaacctccagccgttccccatttacggccggcggtgctagggttagtgatttcggcggcgatagagggagaaaggggttgcggccgaggaggggaggtagctagggttctccggcgacggcgagtggcagcggagggattaatttgatgtgtggatagcctagcggctagggtggcggtgccatggatgagctgagatggtgatcaaagtggtgagagttagacatggctcggagagggttcctagagcatctatgaggtacctagaaggatttaggtagcttgccgacctttggcaaggtgtggaaaatacttgccaacgagcgcctccattagcggcagtcgtgtgcacgtcggcagccaaggaggttgtatggtagtgccaacctattgcgaaaatggaatctagggggtatgtagatggttaaaatggaagaactcaccgagataggctgagacgacggattacggccgaaaaaacttctcggcggtgaagaacagagcagagcaggagcgacagtgctcggctcagtgcggtgaggtgaaactcgacacggagcttcggttaggctttagtaagctagaacatggttgaatataggtgttctaagggttggttagggtggagggtggatggaggggtgtaaagtcgatcgcgcacaaggtgttcgaccgatgggcgagagtggttgatgatatgaattggcaaagcagggcttcggggttgtggggttatggttggtgatgatcgatgatggacaaggaaggggctgaggtcttatttatagggctaggagaagcggatgagttcgggcgccattatcgccattgatgaactcgggaattaggtgtggcaggggtggcagagggctgagagagggagggcaagatcaatttgagtggcgggaggccatgttcaaattcttaccgatgaaggcttgacttggccgcgggtgaaaacggctggcgacatgttggcgccaatccgagcacgacgcgcggcggcggcgatggttaaaacggccagctcggtggtgattggtttgaattgagagaggggaaaccatcgtatatattcaatccaaccgtgcggcaagaattggcgcgattcaccccgggtagaagaaaaatcggactcggcggcggctttggacgggcatgcacggcatcgagcggcgattacttgtggcggaggtcgtcccggcttcgtcctcatcaagattggtgcgacggcggtggtctgagaggagttgtgcggctggcggcgcgtcaaggcagtcgggcacacgcgagcagccctgaagctgaagcgagtaaaggggatggaaaggcaaagaagaccacggccttgggtgggttgtggtccccaaggacccaacctagactttgttaaagattggatggatgttgggctgctctagttggactgggcatttcatcgagcaccttgagtgcgatgaacagtgttttcagagaattttgaatatttttcctagaaaagaatgaatttaaactataaatttgagaaggtttcaccagggtttaaagtatagcaaactctcactactaaaagggtaaactaaggaaataaactaaagtttgaaatttgagagattttgctcaaattcactaaggtttaggttaggggaataattaaagtaggttaaaagaattctaaaggagtaatacttgaaccaataaaataagaataacaaggattcaaatagatttttaaattatattaatctagtcaaaagccagcatgatgcagtcaaaatttagtttaaaatttgaggatgttacaccgccgctgccctagccgaggcccaccgccaccgcccgctcccgttgccgatgccggccaaacaccccccatcagcgccgcccgccatcgacacccctcccctctgccggaactagggagggaaggaaggggaggggagggaagccggatcccgtgcgggaggagggaggccggctgccgtatctgtgcggggacagccgccactgccaggtccgtgcagggacgaccgccgcccaccggatcctgcacctccaccgctgccgcgtggaggaggccgctgcgtgccgccgtcactgttgccgctggcctccggcccacctcgtcatcgtcagcgcccgcctcccgccggcctcccgtcggcgccgccgctcccggcctttgcgccgcccgcctctcaccggcctccatgtcacccaccgccatcgccgtgggccgccgaggagagaggagagaggagtgaggaggagagaagggaggagtgaggagtgaggagaggagaggaagcatgagagagaggactgaggcgtgagagagagcgcacgtgagtgaggggacttagccgcgcggataggggagaggagagaaaaaggaaaatttttaaagtgggtaggagggaaactattttcccgtgcggctctcttaataggtacgcatgggaaaatcgactcattttcgcgtgcggggcatttaagaggacagcatnnnnnnnnnnnnnnnnnnnnnnnnnnnnnnnnnnnnnnnnnnnnnnnnnnnnnnnnnnnnnn

SEQ ID NO: 34886 - DNA, 2346 bp, Oryza sativa
  unsure (1)..(2346): unsure at all n locations
nnnnnnnnnnnnnnnnnnnnnnnnnnnnnnnnnnnnnnnnnnnaattttctcgtgcggtcctcttaaatggaccgcacacgaaaatgagccgattttcccgtgcggaccgagttaccgcccgcacacaatctaaaagggtcgtgtcgacgtttgatgtctcgactacggtatttgcatggcatggggattgttggtactaggatatacgcgagactgaggtaaaagagatggagacagagatttttatacaggttcgggcccctgaattgtcaggtaataaccctacatcctgttggccgaagccggtattgctcttattcatgataatcacaccagtacaatatttggggtagcctatctaactgttgtcgacatggcggtctgacgatctaactcgtagtcgacaacagggtagccttcctcctcgaatccgtgctcggcgagatcagagatagcgctttcgtctctcctgacagtatccggagacaccgtagggtactagccgtgcttatccctgaagtcgatatccagcggcgtgtcttggcgtatgtaggcttctatgttatggcttctatgtcgattgtgttgggtgttgatcctcccccctctcctcctaggggggcttgtatttatacccataggtgtccccttgtccaagtagaactagggaaaccaatatggatacaatccgagtagtccttgtcgtctccatgtagaactctggttgtctttccttatccggaactcctcctatatccgaaggttgcttccatataggacatggtatgtagtgggtcctgccgagatttattcaactgctattaggtatgtggtatccataaccctgacagtaacccccgacttcaatgcaaatgaacgagttcatattctcaaccgcagaccttggaggaactgttattgagcgcacgtgaccgttctcggtgagttcagagataacgttagacttcctttatcagcctcgtgcggacacctaaagggtttatctgagtcaatctccgacgtcaaccaagaaagtacaaagcatacgactaagtctcccgtcttgctgtaatcgagaatttggattgaagtcaagaaattttatctcggcgggcacaccatctcttcattccatattccttgtcgagatccaccaaccgttctcgagtaatcgagtaggtgtagagtctgcgacggagccttgtcaacatttgtcgtactcgccttagtcgatcttggtgtagaaccatagagacatggagtcttcaataatgtcgaatagaattttcctgaaatcaatactcagaaaagaatattagatagaaatagcccccgagcgagtgctcaaagggtaacatgttatagaatgtatggaaaactgaacatgaattaggtttacaaaccagtgttttgtatatgagcgtctactcttttaccgacttcgaccagtcagtttgttgagttatacactctccctagcccccagccttgtcgtcggagaatagttctcggatgataaggctcttagacctttgacctgccttagttgaacaagcactgatcctagcccccagccgtgaagttggaaaatccatttccgattacacggcttggttaatacgcacggcgagaactattacacgaccagatcttacatggtctttcgtctctgaaggatccgacaaagccttatccgctctgggcgtccccagccgaagttcccttaggttcctcagaggctttgtcaagacagcgtaaagggacattaggataggtttcaacgctaggtgtcttttgtggtaagggatctttgggtaaaacacttggcgatattgtgcacctgatatcaactttgttgaggtagaggtagtgggagaatcgctacacctctggtcgaggaccaggtagtagtcgtaactcgaccacttaaagtggaagtagtgggagaaacgctacaccgctggtcgaggaccaggtagtagtcgtaactcgaccactagaagtaaatgtatgagagatcgctacgattaactggttgagaaccagtgagtaggtgtctttcgatcaattggagtcgtggtacgaggatcgctacgctgccggtcgaagactagtcgtagctgttcctcaaccatctgaagtcatggtgcgaggaccgctgcgttattgctgtagtcgtacctcgaccatctgaagttaaggtgcgagagattgctacgttttactagttcgagaaccagcgagcgagtagaattatctctcgaacaccaatggaagttgcggtgcgagagattgctacgtactggttcgaggaccagcgagcgagtagaattatctctcaaaca

SEQ ID NO: 34887 - DNA, 660 bp, Oryza sativa
ctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatctagttcccaggatgtgcaatagattcacactttcatctcaagcatgattatacatagcaaacacaaataagatgaaagcgattataaactacatctactttagttacattagccgaccggccaaataaatatatagaacagcggaagcttgtctacccaatccacaagcacaccgactaggggtttacccca

SEQ ID NO: 34888 - DNA, 771 bp, Oryza sativa
gtgctttcagaatgtatgtgaaagtgctcttgatgtgggattctgagattcagatagatggtgggggtaaggatgttgttcttgcatctatgcttgaggccagaaaccttgttgtactcagggtatgttgtttgaaaaaaaaaactcactgtcaactttttgttagttgtggaattttaatttttttttaatgtaactactacagcatgggtcagtcatatcttcgaatgctgctttgggagtctatgggcaaggacttcttaacttgactggccctggtgatggaataaaagcacgccgactttttctctctctgttttacaacattgaagtaagattaattgcatccttttgtaacatttgtggtacagtgtatctttatgctatacattaccttttgtatatgctagataatacctctattttatatgcactttccactaggtatccactaagtcatattatgctgggacaattgatatactatattccatcacaaatatattagtttcttataatttcttaaagaccctataacttacaaagtaaatgtttgagctgggttgcattcagagtttcagactgtctgcaccagaggggcatttttaaagctgtttcttaatataatctactccctccatcccaaaatatattaacctagtattacgattagacatctcctattattaagaatgtgattagctagaactaggtgccttttatcgttctgtaagcttggttcgctgttcttttgaactcgcagtgcccttt

SEQ ID NO: 34889 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnnnnnnaatttgggagagagcttcaccactagcggcacaaactgttggaaactcgactcatgccacacctaagttatcagacgaagatggatttggtaatcggttgggagtacgggtcagtctaccaatagcacagtgctgctgctgctgctgctagcaccacaatcttggccaacccaaacagatatcaaatcagctcataatgtggacgtcacatacccaattgatgagcacagatgatgaacacactggagtatttggaccatatgggatcagaggaactgcaaactagtgttccaaactgtcaaacatgctactgtatttgcatccgaaagaaagaacatgcatgctcccactgatgatgcatatgcgcatcatcatgcagggattcaagattcacgccgcgtgcgatctgatccccaatcccccctctccttttgcagtggaatggaatcccatgcctttactcgcacgacgatatgccgctaatcaacaacacctacccactcttttagatctgtcacattaaagatccaagaccgcacggatcttgcctcaagacgactcttcgatcctaccaacccattcaaacgaaacgggcccgacctatactagtagaaatccgcgaggaacaaaaagaagccggtcagccagcgacaaggaggga

SEQ ID NO: 34890 - DNA, 639 bp, Oryza sativa
  unsure (1)..(639): unsure at all n locations
nnnnnnnnnnnnnnnnnnnnnnnnnnnnnnnnnnnnnnnnnnnnnnnnnnnnnnnnnntgaaaactcaacaaggtgtgcatcggttgacttgataggagtttgagcaaggaattcataagctgctttctctgattctactgaactaactgttgagctaactgtggagatggacccagacccaatttcactttcatgtgaggtcacagtatcatggtttactctctcatcagaaacctgcaatgcaaaggaactggtaataagctctatagtctatcccaactggcttcagattttcaaatggagcaatggactaagctttaaacttaacctgagaaataaaccatcccttaactctttgttgggcttattttgacgctaactagaaattttaaactcgaacattacattaaaattcgacccatagtcccatacaatcaagtacatgatccagtaacagtaacttcaaatttgatgtccaatacgcaattactccccacatttcatattataagtcgctttgactgttttcctagtcaaacttcggtaagtttaaccaagtttatagaaaaatatggtagtattttcaacacaaaaacaaacatattatcaaaatatattcaatgttagatttaatgaaa

SEQ ID NO: 34891 - DNA, 1176 bp, Oryza sativa
ccttacaatgcgaaagtctatggccaagtctttccccacaaaaatgggggggacacgagctcatgacctctggtcttcaagcttgccaatgatgaggcagagcaatggaacattgtgaaacacattgtttttgtgaaagtagcatgacttctaaggacaataccacacagtacagactcccctaatgctaagcaagcgatagcaaagaagatgactacgagacgtgatggaaatggacacgcatccttgcgataatccagtacccaatcgagagcacgcacgtaccgggtcgaccaatgatctgaagcttggggcagttgggattgggatgggcgctgggctaaggctccggaacctggaatccgaccgcgcgaaccgaattccctccgaggatgccagcttctggcacacagagagaaaccaaaccacccatcagcgaaccccaaaaacagatttcagaaccaccctccccgaaatgctcaattcgaagccgcagccacgcagattgccaaaacccgcggttaccttgtgcggaagctcgtcgagcgacatggcggcgcgatccggcggttggctcaccctcacctcgtcgtcgtcgcaccaaaaaggaaattccggcctcggctcgggttgggtttggggaggggaggggagggagagaggtgggtggtggactggtggttgggtggtgagaggcgacgccgacgcgaggcgacgctgttgaggaggaggagcaccacctccacctcctccccccgattcggttatttatcggcgaagcaggaggccaccgggagttgacaccaacggggggctgacaggtggggccagggggtgggtgggtcccggtcgcagtgaggctacgactgacgcgtgcgctgatgccgctttgggttggggtgtggggtgtgcgtggcgtgtgaaaccgagcgctttcgtggttactgctgccggcaagcagcaagctaaaccggtttgtttggttggttggttggtgggtctgttccctttccttttcccgttcccgttttcatcccatcatataccagaatatttctgtcacttggttagttattatttcaattttgaaattttataacttaatattatcttaaacaccagttgtttcagtagatatcttgtttgatttcatataagaaaaaaaagggtaatgtt

SEQ ID NO: 34892 - DNA, 5747 bp, Oryza sativa
  unsure (1)..(5747): unsure at all n locations
ctataggtatttatagcaggagagagccgtacctcgagattcttatattttacactatttttcttaaaattatcctagaaaaacttgtagctctaatatctttttaaggactacaaaatcattaaaaccggtaaacatattttatagtactttgcggaatcctttggtttgcatttcagcagcgtggaatcgatagtcactcggcgtgccccttttgcgtttaggccatttccaacccaatgactaggatagtgtctatagcattaaataagctaccacctaggatgaaaaatgatgtggcaagtgaataaatgagaaaagagaaggaaacaatggtttctacacaatatccaaggcatcatgtgagataaatagcattaaatctaagtatggaatagtggtatttgcattggaagagtagtgtctagtactagtttcttgatgatgtggagtttatggaaactatgtctagtgtcatgggttgggaatggccttaggatcttgagacggtgaaacacatcctcctcgactatgtgtttgctcggcaggtctggttgcgtgtgctatcgcctccctggctgggctgctatctcttccccatggcagctggttccagaattggtggctgtccttcagggcctgcttagttgagcatctccatgctggctttgacttcctagtgctcttgatcgcttggcagttgtggaaggaacgaaacactagggttttcgactctgcgctctcttcaatctcagtggttctgaaaatccatccactcagagggtcatacgtggtctttaactagcattgccgcttttggagacttgttgggagtgtagcgtggctcgggcccttcctgctacttggagtttgtgtttagctgccgtagttttataagcttcagctttttattttactttttctctcttctcctggcataagccggtctagctaattgtgttgtgtaactataactcttttcttctaatatattgacgtgcgatttttttgcgcgttcgcggaaaaaaaatgttccaagatgagagacaacatttttacatagctgcgtagtaagtatatttcgttggcttatgttagatttgcatcggatctgaagctttagaattctcttgtctcgaccaatattccgtgtataaagatacccttgacgagtacagtgacttgcctttgtattttggggcactcaaagttgctttcattctgaactagcgttggattaggtagccaccaaacgtacaagtatacatctcagtcgttatctgaaaaattcatcagtgaagctgggagtattcgtcaaatgtcaaatgacatgaaccgctaaaagaagctacatttccactgatttgaacttgccccattgatagcgacaaccaagaaagaattcatgtctcaggatgcttatttctaaagacttgactgacaaattctatgtgtgttcttttttttgcaaaaaatatgtattgcattcatgatccattgatgcacatttctccatgaaatttaacaagattaccacccattatctccaaaaagaaaaaaaatcaccagtagcagtcaacagctgaaaatatcagaacaccattatatatatttatattgcaaagaggcaggcgtaatattgaaaagcaatagtatatggcagagtcttggtcgtcggctacgaaaggtcgccgcggacaaaatcttgtgcgattgcagtatagtgggggagtggttggcatggcaacaacatgcatgcgaatgcgcaggtatgagtgtatgaccgccccaagtcttggccactccagggacatgaaaaatgagcagttacaattcgcttggactcgctgaaaagtaacgagcttttgttaagctttgctcgaattcaggcgcatcagaacaaaagcgtttcagaccagagacacacgactgttcaaagttaaatttttttcttcagcgaatcgactgttcaaagttgagagtccaagccgtccttcaagcacagttccagttgatttctggaaacaagaaaggtagccattgttgtattccagtcttcaacaagggtagcccaggaaagtagtcgaaatgtgagataggggggtgtttagacctaggtatgtaaagttttagcgtgttacatcagttatttatataaggtgttgtatagtatgttcgggtactaattaaaaaaactaattacagaatccgtcagtaagccacgagatgaatttattaagcctaattaatccgtcattagcaatgtttattgtagcaccacattgtcaaatcgtggagcaattaggcttaaaagattcgttccgcaaattagtcgtaatctgtgtaattagttgttttaaacctatatttaatactttatacatgtgttcaaacgttcgattttataaagtaaaatttttatgtgggaagtaaacatggcatatagatgacgctgactgctgcattgtttccgttgcttacgatactctcaaccaccaggaagcgatggtgtgtttcttactactatacccacatgatgggtacgccgcgtgttaccagtcaggggcagatcgaggaggacgacggtgtcaacgcgaagaagggtgaggaggtttgggttgggcggcgcggtgagaaacggggtggaggtcgtgcaggcacggcttcggctttctgactttgggcggttggcagcagaaaagaagaaaacgccgcatttggtgtggtgttggtggtcagccgcgcgcgcgagacgcgtccgttgaagcgtccctccaaagaagaacgcagccgttgccgccagcaaagtcagccgatcgcgcgagcccaacacacatgtacgatcgcgctcgcgcacgggagaccggagactgcggaaaatgcgttgcgatcggagatgggaccgaatcgggcggatcgaatcgcggaggcgcgcgcgcacgcggcgcggcggctcgatctggccgggcgggggtaggtggttggtggttccgctccgatagacctgcgtacgtctcgcgtgcacgcgacaagtccccatgatcgtcaagcgcagcagattttgcggtcacgagtactagcatgcggcgtttctcttccaccggcaggcgcaaccaaacccaacccccaccggccggcacaacccaaccccagccacgtttttcacccgctagattattactacccccatctttttcacaactatatactatactatatactccctccgtatacattattttaatgtatgacgccgttgattttttaaccaacgtttgaccattcgtcttattcaatttttttatataaatataaaaatacttatgtcatacttaaagaacatttgatgataaattaagtcacaataaaataaatgataattacataaattttttaaataagacgaaaggtcaaacgtttatcaaaaagtcaacgacgtcatacattaaaatacggagggagtattacttacgcaacatagaagtgattgacaagagatgtactttacagtgcattagcaaggagtatgtgattttgaccctaagttaccatgttcaaatcccatcacacttacaatttttcttaaaaaatatttggagtaacgtctctttctctaaatctcatttttttaagtaactgacaaaaatatttagagtaagaatcatactaataaggtacatgcacgcacgctacgtggtggagaatcagattcggtgcagacttgtcagttgttatatgatcaacactagcctcgtcgacggtcgttatacatctgtcccaaatctaccaattcagcagtgaagcgctcaagaccggaagaggactggtcgtcgactggacgttggacgaggtaccatcgtcaggttagatggcggttggcttcgcctctcctcacctgttcttttccccaagtatttccggttcatcttggagctcatggaaaatactccctccgtattttattttaacgtatgacgccattgattttttgacaaacgacctttcgtcttatttaaaaaatttatgttattatcatttattttattgtgacttgatttatcatcaaatgttctttaagtatgacataagtatttttatatttgcataaaaaatttaaataagacaaatggtcaaatgttagttaaaaagtcaacggtatcatacattaaaatgcggagagagtaacatagaatcagtcaatggatggtagtagtagataggtccaaggactaacatgagctctcggaactgacaatgaccaataataacagatccattgtattgtcgttacgtgccacctgccaatggattagacatgggaaaaaaggcatcattagtattaggaatactagaattactgcatatcgatttccctaaccacgtagtgcttacaacacttcagtgagttggtgtgtgatcagcttagattgaatcatcctacttatttgtgagcaacttgctggtgcactagctatcttgtgttagtaactagtagtacgtagtacactaaacattcactggttcaaccaatacagagaaatgcctttgtttgactatattcatattcagagggtcgtaactgtttactggctggcatagcacgagctctaaccaataaccactctgaccgttcacaacggtcaagaacacaagtaatctgtgtcaactaaagtttaaagggaggagaccaaaacagagacatttttttttcttttagaaaaaccgagttggtccagaagggtgaggtggtaagctttttagtcagaacttacaccttacatttttacaactattatttttaactcagttttgtagaacaaatcttcaattcaaactgccgagctgatatgataaaatcgaaaatgaccctgcccaatgtggagcaaatcaaagagggaaacagcttgtttgtagtcagtgtataactacaaaagaaagtataataaattgcttgtgtaattttcatatgattaaatttttaaaaagcatataatcattagtcgttttgaccagcaagtgaatatcagcatccatgaacctacatgttcaaccaaatcaacaattcaacgcacaagtgaaccattaacaagacaaaaacataccttgagcctttgagcacctcacgtaagcattgttgcacttgtagacagaatgataagacagtgttgtagctgcaatcccacattctaaaggctactaaactcctcagcttcaaacatagattttaggaaagatgtgtagcgaattgatgaacttaaatagggctgccttttggtgaagaaagctttgggtgaggatgctacactagtatctagctccggccttaaggatgctatacgagtttctgatgctttaaaaaatggaaatagcaataagggactgttttcatcatcccatttaagattgtcccaccatgttttctcccccatgacactctttaatttgacaattgcatgcccaaaaggcagccttctcagcttcggacaagcaaacacatcaaagtattccaaagaaggaaggtctaggctaaagttacagaagttttccaagcttggcaacgaattcaattgcaaaattctcagtcgtcgaaatccctggattggcatttcatcttgtacttcagtattgattttattctttatatggacaagctgtttcattttattgcagaaagacacatccaattcggtnnnnnnnnnnnnnnnnnnnnnnnnnnnnnnnnnnnnnnnnnnnnnnnnnnnnnnnnn

SEQ ID NO: 34893 - DNA, 10676 bp, Oryza sativa
  unsure (1)..(10676): unsure at all n locations
nnnnnnnnnnnnnnnnnnnnnnnnnnnnnnnnnnnnnnnnnnnnnnnnnnnnnnnnnnnnnnatctccataacactgtggcttgtttgtgacagagaactcctttaattctgaacagtccgttatattaagaacaaggacactatctggtatagtgagcgcaagagatgtctcgccactcaatttatatagaccaagcaatctcatgtgacttccatgaatatcaaggagcttcttcaaggtactcactttcttgattgttattcccagagcttttagttctctagttaagcaagataactcttctattctaaactcatcataatccatgtgacttcttgaatgaaacccctcttcacagccagcatacctgctaccatataagtccaacacttgtagctttgataaatttggaataacaccatagggtatcttctccaagaaatccatgtagctcaaatttaggtacttcaactttgttaattggccaatcgccacaggcaatgatttaatgagtgtttggttcagtttgagacattggagttcaactaatgcgccgatttcttctggaagttctttgatgggaatccaagacaagtccaagtatgtaacagacgataagcatttaaaaagagaaggtgggatcacattcaaccaaaagttttgctgcagtgacagatattggagattgtaacagctgatagcatgaggaagttcactgatataattgcacatgagcgatatctttctggctgacctccatttctcaatatccctgctatcaattttatgaattccaacccctgcctgaacaatccaattcatgctttggtcaacacagccagaagatattgacagtgccatatctcggataatgtcatgtattctcacctccctatcttccaagtagccagcctccaataagcaagcatttttcaagtactcaatgatggagtggcccttgtcatatgcttcctctatagtatcatactctatcaaacccatccccatccaacagtctatcagtgcaactttccaaattgagtagccttcaggccacagagaacagcataagaaacaatatttgatctgtttatcctgcagataatcataacttaattttagcctagtgtatatgtgactagtatttcccatatttgggatctcatgaatgcgggacttcttcagatatgacagtgcaagtgcccattcatgacgagtcctctttgtggacattgcacgaccaagagttgcaagagcaaggggcaaacccccacattcttctgcaacttcctttgctaggctttcaatcctaacatctgaactaataacttcttctgttgctttttctttgaataatcgccaagctttttcttggtccaagcattccatgaagatcgtcttgtgagctcccatatgcccacaaacactctcagaacgtgttgccagaactactttctgcttatttaggccattaggatatggaatgccagcttcagctaaatcaaaataaccccataaatcatctatcagaagtaagaatttctttctccttaaaaaacttaacaaaaatgaagcccgtatattaatgctacaacctggtttcaggaacagcccgatcctttcagcaatatctgcttgaagctgacctattccactggctgtagatgccacgacataaacaacaaggtcgaatccataattttctttggttacacctaagaagtgattgttgatttttctgagcaaggtggtcttaccaactcctcccattccccatatccctaaaattccaacattgtcatctttgaggtactgcagaacttctttcaaattacactctgtttcttcagttgaaggtatggtgggcacttcttgcacgaaatatggtggtacctcaaatgatacctctttgaatgcacctttttcatgcaacatttcagcttccttcagtttcttcgcagcctgcatgccaatttcgtactttgaccaataactgaataattgctttctcttcctctgcacattttttatctcattcacctcagtttccatcgctgctaccttttgtagccattctgtaacttcaggattacatgtttcttgcttcccctcagagatactaagccggatttggatttcatttttcctaacttctaggtttttgatagtgttgtccagctttccaatattttcttccatctctattagatatctgaggcgtgcgaccaaaggattccataagtgggatgccaaagtactagatatggaatcaatcagcattggaacatacatgtgtaacaggaaaacgaggtgacaaatagggcaatgttttgaaccagctgttgcttcaattaacgagacaaaggatgtcgaaattgggagctgaactgcatatgagaaagtgcaatttataataagtgtgcgaatatgcatgtctttatgcctgtactttctaccatgtacacataatttgaacaggcatgtaaagcccaatacatgttgtactctttttttaatccctgtagtaaagcactaaaattatgtatcttatttctgatatatgtagttcaacctagacgacaaatcgaagttaaagatttatatgatgaatattttattgaagctataaaactattttaggatgaaatcctacaaaaacaggaagaagatcattatagtcatcatgtcatcagcatccttaataagttgatgtcatctatttccataacttactagtaattccagttaaacctaaataggagaagccaagcactgctatgcgccaacaacaccagattgaatgacctccttcggtcattccggcaaaaaaaaacctaaataggaacagatagagctaaaagatcatattgatattgactagggaacctaaaacttcatcagcaattgatagggcacatgaaaggcgtctcaacgcacattatacacctatcttgaatgcatgggtgatgagatgtcaagtggacgttgtgaagcaaaatcaagagaagaacagatggcacgacaatttgtcagatcaattatgcatcgtcctaataaaaatattcagaatcaaattggtcacccaaagaggaaacgaaagggatatcagtacttacagtcacggatagaaggtctcgacacgacgagaggatgctgaattaggccactagaggagatctcagcacaatgtggccatcagcttagctcgagctgcaagagaagtttcaggaaacagggaaagagaggcagaccgtagacactgtacaggaaggaaaccacaaaatggttgcgtgatttagttgtgattcggagggggggaacttcactgggaattgcagacacggcgacatttccagcaggatcttcagtcgaaattcccagcgttgacttggcggaaaactgccccctgctagtctgctacctgcttgcgctgacctagtttgcgtcgacgagctgcaacgaccaccccgatttcgccaacggcgacttcgcgaggcttcagaacggccatcagatctcatcaggcaaaggctaggtggcaaaatgggccgggccttcccgtgccggcccagtcaagcccgtttggacatgggccatgctgacacgacccaaggaacgaatgaatcgaggaagccactagctcaggccggagaaaccggtggtggtggtggccgcggcgctcgccgacttaggcctacaaggcagcacggtggtgcggccagccccatccacgggcatagtagtcgagcacgtcagagactctccgtctaagggcagggaaagggtgacggtggccgaaccatcgccaatgccctatctatggtccacggcgcaccagtccaccaccatcgtgaacaatacatatatttatattatattcagttttattgtgtcacatcagatattatataggctgtttagatattaataaaaaaactaattacaaaattagtcattaacccgcgagacgaatttattaagcctaattaatccatcacctttgcatttgctgtatataacgataaagcaatataatactccctttgtttcataagttaataatttgcaggattcaatttttgcgcgtgtaaggaacatgcacgtgaaaaaggaagtaaaaaatttaagaaaaaagaaagaaaatatctcacgttaagaccttttgtttaatcgataagagataaggaatggaggagattgagagaacaacaccacattataatatggatgagtctacggtggaaaaaaaataaaccgaattcccttaataggggttttcaaaatatatgcggttttttttctgcaacattagatatatatatagtgaaacattgtgagtacattatgtgaaacattttttgtggaaaaaaaaccaaattccttaatatatggtttctaaaatatgtgggtgatttgttgcaatgaagttgtgtgtggataagtggcagatggggacatgggatatgtggtggggcccaggtgcacatgtgatggggggagggggagcgaccgatttttttcccctcctatcgtgcgtccgtcgttgagtattctcgttataacatatgtggaataaatactttttaaatcccagcaagtataataacatattataagtagctataagcacatatggaggagataaaagatgagagagaagatccgtcccaaaaaaactcaactcttggagtttgaattttatcaaaaaaaaccaacttctaccatcctacctaccctcagcacgtaaaatgaaaaattttattcctttggtaccctttacctacctatcaccattactattttttttaataatgagggatattttagccattttcacttttcgctaattttatattgggatgctagggttggattttatatgggacaaagggagtacatatttgtaaccagtaagctgtcacacggactataatatgttgtgtgtatatacacatatatatatatatatatattattaatgacgtagtatgtctgtataaattggttattaaattaattatagataatttgaaactggtagtcgactgtgctattaatcttgttcttatcccctcgtaggggattaaacgaaccaggctttaagggaaaaaagaaaaatagaaaacccttttggtcgtgaactgtgtcgtctagcctcccactaatcccggtgccttcttgatcccaccgatccccgtgctttcttctcttcggcatcgccacgaagcggagggtgccatcgcagcagccatcgccgacgagcggctcacggtcactgcggcctcggcaacgtccggcgatcgtcgtcgatccttaccttactccctcacgccccctaggtatgaagccgccgtactccaacccaacttctatcgcctttgaaaccctaggcaggtaggcggttgctttgccttcggtgcggttgttgtgctgactctctcctcgccctcgccctcgccctcgccctcaccctcgtcgccggcgattcctccgccgtactccaaccctagctgtcgcctttgaaaccctaagtaggcacctaattaagtgctaactctttctgaatgtaatatcacaaatctttcccaactaattcagtagcattcggttaagcccaacaccatacagttgttggtactgaaacttttttcccccttttccgttatcttcagaagtaacaatcagtcagttacttcagtaacctgacacttgtgttctgattgcctgatccaagttgtgatcttagttatctgcttcttagcttgtgaatacgagtaagtagtagtaaaattggtgtgttttggtagattttgcttgtaattcctagcggttggtaacttggtatattcataattcggctaaggtttgataaaagctgcagtgctgcacatcagcctttttttccctgtgcacatttgcttttcttgtgtttatgctacttgcttgatttattgctattgttcctttgctcctggaggtggccaggggtagcctgcctgcctgcctcattcatgttttctatcatttagtggctattcgctttgaagaaattaatgatttatgcagctgttcctttaaataattattggttaatcccttgaatttatagctgtctcctcgagaagaatcctgcttaagttgatttacctccgggtgtttacggtctttcaaattgctaagcataatcttgaactttccaagaaaaaaaacaggcctgcattaactagtgccagggcagcaataatggatttgtgcgacgacactcatttcccatgggaggtaatttttttaaaaccagaatcagccaagcgccaaatttatgataattattcttcgcatatgtataattttgttccttgcaggggtcccatactattgttggcagcaagcggaaagctaaggatttaatggcaaaaatctgaacttgtttaatggaacttataagatggtggaaaccacagttgatgttatgataagaaaaggaacaaacatgagactcgaaagctacgagtttttgagtgatttcaagcatggcaacgctgtggtactcctggactacacagagtccggaaacaaggggagtttcatcgtcacacaagttgatgggtcattcactgcctggtttgaaacaggtggaaaagagctctgctttgactcatctggtcatattactcagttatttaaagacatgattgtgtgagtatctttattgttgtccatatttttaactttcttcttgttatgttctctgaaatcatttttatttgtgtgaagcgatttttacgatctgacctggagtttgcacaagaggcacttagtcatgcagaattttgtaaaggaaaatatatacgtcaaaatctttgatggcgtacccaaacttatgattctactaactgaaggtatatatttgttgctagtaacttaatggaagttcacagttttttttttatatataaacaatggcaatataacttgtacactggattgaaaatgcgatttaaattttgtacagttaaattggttgatcagctagggccattcaaacaggactggagtcatgtccaaggcctcatgacttggtgtaaagaacaatctggtttaaaaatggactttcttaccaagagtttctatgatttcatcggatctaccgactgcacagtaatcaagctgagaaactaccctgatgattgggatgaaaaaaagaaaggtgattatttgctcacactcgcagaagtaaaccacggagttcttaaagataagttgaagagtagggatgattttcattggccgtttgtgaagctgcctaagctggagcagaacttaccaccaatgttacagcaaattcttagtggggagagacagatgaaaagaaagttcgacgtgacattcttttgtgattatatcaacctcttgagaaactcctacaagaaattcaatgaattaccagaaaatgttaaggtaattgcttaagatgtttccagattgaataataccttcttttactgcaggatttgttgtattcaaacatcttatgttttgacaggctttatgcataaaccaggatggcttcattaaactgatagatgggtggtctcctgagttttggaccaagatctacgagaaaattggtaaaaacagtctgtgcctttggttttaggccttcgtttgactgtgctctttttggaataggggatttatgacggtgttctctttttgcagggtggccagattataatatctggaagtggccttgtaaaaaatagctttagtgctttgcatttgaccagtgagtactgcattaatacttaatgtatgattcctgtacgctttcagttcaagatataaccttagttatcattgttctatgtttgagtaccttattagattgctgcatttatatagcttgtttgggatatggatttccatccctcaaggggatgtcccctcgttgattgtatgtcatctaaatagttataaaaaaatttaaaaaaattgacaacatagattaatatgaaatatatcatgagaactgtggtgctcaattgttaagaggtaatgatctccttgtgagggctaattttgtgccggtttggtcgttgctgtgtagtggtaggaggttgtgggtggcaagctgttatgaaactcagatgttttttttcttccttttcagtcttttgtatcagactctgtaattcctgcttcaggtccttgatctaaaaaaaaagttcaatgggctttggaaaaatctaatactttctccgtttcacaatgtaagtcattctagcattttctatattcatattgatgttaatgaatctagatagatatatatgtctaggttcattaacatcaaaatgaatgtgggaaatgttagaatgacttacattgtgaaacggagtgagtaactgctactcaaattctatgcacaaagatttgtactgtccagatgaaaaaaagggaacttggtgtgttttgtgctctaatcctgaaaaaatgttcagcacattctctatgaatgtcctgttgcaaaattcacctggtgtgtttcccgtgatgcttgtggctggagttttctcccctctgcttttgaatcttgtaatttctggagtagttgggctagccggctccaaaaggaacagaatcaaaatcctttgctttgctgctgtttgtttatcaactttggctgatgggcaacgatatgttttttcaaacaaaaactgttatctactcccccctgactttgattttccgtgtcatttcctccttgtttaggaacactgcttgatctcaatgatggcgatgccggtgcccgcgctgacattctcaggacatatggtgctgttctgcaggtccgatccttagatggctcctgttaggagtttttggttcttagaattatgttagatgctatctcgaaactctcaagtaattttttgtcctcctgcatgaagcaaaacttagtgtattggttgaaaatctggcatgattgaatggagaactatcgagattcattactgtgagtccatgcacttttagaccttttagataatgatgcacttctagaccttgtttggatgggcctcaattccggccagcgcaagtggatgtgtatgaattcaggctcgtcaaatgatacgtggcctgaatcaatataaacacatgctgagttgtgttggtggatgccgagtacaacaaattaagtgagcgtgcataattattattcttagtcggtgttgctgaccatgtatttgtgttgtttaagtttttcgactttgttgtgtttgttgcgtgtgtaacgtcgaatgcaccaaggtctagtttgcgttgggccatcgacatactggcatgtttttgcgccctttgaactcatccaccaagatggctagggaatcgaaggtcatctacactgccttcccttgcattgaaggcttgaaccaccactccgtgtgaaggtgccgtcgatgaaataggatttggttcagggtggtgaaggtgccgtcgatgaaataggattcggttcaggtgcagtcagtcacactaggaccatccaagttgtatctaaggactgagattctcggagcaccgttcacataaaaaaaaatattgtacaactattgtagcaatggtactgtagcacttgatctacatccttgatctgaaaaataaatggagcatgggcgccacttaggggtgtttagatccaggatagtaaagttttggtgtcatatcagctattatataggatgtcgcataaggtatttgggagctaatctatctatctatccgccagctgattagtggagatgacggcttgtatttttctgacacgtggcacgaaccaacatcgtatagatgattctctccagcgcggctgctgtttttctcgatacatcgcatacgtacgcgttcatctgggcctaaagcacctcctgcataagaagcccattagctagccaccctgcgctatggaaaggaataagatcactttgactccctcaactgaccaccgaatctaaatcatatccctcaaccgtaatactgaaattttgactctcgaactgtcactcccttggtggttttttagggtggtttcgctgacgtggcgtacacgtggcagtgttgacttggtcttcatcccacgtgacattgacgtgacgcttatatgccattaaaatttaaaaaatatatatggagctcatttgtcattaaaaaaaaaattgtgggtcccacagacatgtgggtactacatgtcatcttctctctctacccttcttcctcctctctcccttatctctctctccccttgacatgagccagcagctggcaggggctcaagtggaggcggcagcaggagggtgcgcggtggacctcgggcgacgggcgcgggagcagctcctccttgcggatgcagagcgggcgctcaaggtgcgcaagagcctgcaccatgactgccaccagcgagctcctagcatggcatggggcgacgtcctccgtcgacctccacctgaagcttcccgacgaagacctccttgcgcgcccgcgtgttgaaggtgagcggtttggcctgaatcggccggggtgagcgactgagcgcccgacgacgccgccgccgttggtggctgcttcatggagtgttccctgctcagcctgaatccgttccggttcaagccgatt

SEQ ID NO: 34894 - DNA, 5167 bp, Oryza sativa
ccacgtcaatgccacgtgggacgaaaaccaagtcaacactgccacatgtgcgccacgtcagcgaaaccgtcctccaaaaccaccaaggaagtcaaattgtaccggttttgatagttgaggggtcaagatttctggtattgctgttgagggatacgatttagattcggtggtcagttgagggagtcaaagtgatcttattccctatggaaaatcaggggaaggagcaaatgcctatgtcagcccacttgctctacatgtacacgttcaatagtcattagtatcggaaactctagggcttgtttggtttgataccaatttattaccctaccaaaattttgataatttcaatagtagcaagtgtatgtttggtttgctaccaaattttactcacaatagttcaaattgaatactacacaatttggtagtgccaaaatttgccaatgttttggcattaccaagattttggtagggcaaaaattggctccaaaccaaactagcccctaatgcacgatggatcgctaccgcgatcgggtagcgatcgcccaccctcccccctccctccctccacgtttccttttttggcaccgcattactttcctattttagtaaatttatacacctaaagtttatagacccaaagtttataaatcaaaagtttatatacccgattcaaatttgaatttgaaatatattcgattcaaatttgaatttgaattcaaatattttttatatatagtatttagtttcatctaaagtttatacacctaaagtttatagtcccaaagtttataagtcaaaagtttacatactcaattcaaatttgaatttgaatttgaattatatccgattcaaatttgaatttgaatttaaatatttttatatatagtatttctatacatctaaagtttatacacctaaagtttatagacccaaagtttataagtcaaaagtttacatacccgattcaaatttgaatttgaattcaaatattagtttatagacccaaagtttataagtcaaaaatttacataaccgtttcaaatatgaatttaaatttaaatatttatgatgtagtaggaagagaaaaaggaaagaaggaaggggggagaggagggagcgaccatacaagggaggagcgatcacccgcgcattaggcgtaccccattagtattctatagtacatttacaaaaaaaaatgttgaatgcatatacaactactcatattcatacatatctctatgagtattttttaaaatattaaactgcatatcttaaaataaaaaaaaatattttatttcttcaactaattcaatggacaccattaaaaaaaatctaatttttgactcggttcactttacttcgtaatagcatttctcattttttgttactctttatataagttgtattttaaactgaaccatacatgggattattatcaaagtttgttacggatgtttgcttgaactttaaattttgatgtttaaattagtcttaagtgctttcaacctacataaacaatgagaaaaaaaagaaatgttgaaatgtatgttgtaaatgcatgcaaaaatatgacttatatagagatttttttttaaaaaagggagagaaataacattaaaggagtaaaatgaaccgttttcaataattcgggatgtaaaatgagaaaaaaagtttagaaggtgaagtgctttggtgaaatagtataggggtaaaatagattttctcttaaaattaatgaaatcaccatatataactcattgtcaacatatatatcacctaccactaattagctgtcaatacaaattcctatactaagtatatgacttaaacccaacaaaacattatgactcctaacaaaacaaaattctagaacactttaattttttaaaaaagaaataccaacaccctattttattattagcaaacaatttaattataattttagacaaacaaaagaagaattaataatagcaatttaattataattttagacaaacaaaagaagaattaatagtacggacggaaaaaagagagaaagtttgacggatttctctacaatatgatcgattatgttaaactggaacacaaaaaattctattcaattatgatttttgcatgagtttcaaggaaaactaaattgatttctatattttttttatgaaaaatgcgctgattaataacacaaaaatattatatacaggtaataaatcgagcgcgccctaattttctagtctaatcttctaaagctggcaggcgttcctgcaagctgattggtcgattcgtcccccttactttggttgacacgtgtcctcgagcccgtcacgagttcgcgcgacgccctcctcgatgcttcatttttccgtgcgtacacactcgtgcaatcgtgcgcctcaggctccccgttgggccgtgcaactagcgtgggcctgatctgcctcgagatactacatgggagccaggtgctgtggcgtaagcaataataaaagcatataaaaagatttatactggaccatgttctaaaaagtacaaaacaatattctatagtgcagtcgtgtaatatatatttttatatggaaattgaactattttcaaggaaattttcaacatgatcatagataaaattagtttatggacgatgaccatctatcatacgcaacgctaagatcaggaaatagtgcaacggtatactagatcattaaatagagtgatggtatgttcaaaattatttggtggtgagcaaggcaacgtagttcagatggacagagccatctacatatatatatagagagagaatttcactaagacagacgaggaagcagacttgaaaaaagaaagaaaaaacaaaacaaaaataagatttaaaaatcattcatcggtattagacaactagcatcgacccagtattttctccccgtcaatcctccatgatccaaacaaatcacttttcgcccatgaaccgtttgtgccaatggattggtttgatcaaaaacttcaccaacattataaatttaaaacccattaaacaataagcacgggttataaaatgaatatactcgaaggtgagtgagagaccgtttccagcgaggtagatgaagtaggagacaaatcgaagtaacgcgagcagactattaatgcgaggaagatggtttctcatgaaattttgttccatgtgcgagtctcgaggagccgggaagcatgggaggcgcgcgggaggtggggagccggcgggtcggtcgccattctggcagcgccggcagatgagaacgctggggagtcaggagcgataacgacgcagtataatcggaatgggcctaggcagtggcttgggcttacccatgtatattgggctgtggttaacggtagggaagagagggactgcaatctgaaccattgctatttcgctgtggtaatttaaggtgacgtggctgcacgacaatacaggaaatttctattagtggggatgaattatataggtatataggataagagaagattcgaacgacggaaaaaaaacaaagagaaaaatgctgtgacttcagataaaatggttactgatcacgtgtatccaatatttcatcccaaggaacaagtacttgttcccttgttcccttgtatcaattctgattgaaaactagtttcacgcttatgcatccaacagaccaaagctacaaggtacttcgtgttggggaatacgcaagctttagctccatcagtacatcagaatttttcccttgaaaaaagtggagtacatcagaatctcaacactggaaatacctccggtagagataagagatcatatggagcatatcccgcagagacaatcctgctgccaaaaggccggccatggagtgaatgagcagccatgaatgaagcctccttgcacaagaactctacaagtatacagccagcttcgagtgcagtgttgttagaagccaaagcgttgtctctagcatctactgcaggtgccttggtgttgtcactgccagcaggatactctacgacatttatggatttcacagctccatacctgcaaaatcttgtccataatgtaagctgaaaccatcatgataagtaatacagcaagaatgcaagagaattatttctataccttgcacacttcacacgtacatcttccaatactgcatctacctcatattttgaaagcagcgagtattcctcctggtcaaactacatttattgcaagtttgtaaacaactcacatctttataaatgtaagaagtgtgaaaaaaattggttgttctgtttaccgactaaatgattttgatacgaagagagatatctattgggagagacttatgaacagagttaacactatgacataccacattttttagctgcaggacttgtgttggtactgcaagaagaggtttgggattggcaggaattccatgaaatgggcaagcttcattgccagcctgaacagagtggggtttaactcaataaaatgtataaggcagtaaatgaatgaatccaaaatgtcttaaagtttgaacctgcccaggatgatcagttaacacgccaacagcagttattacgcatccaccaagcttcatgccgttaaggccagcacatgcctttgatgtaatggagtgatcaatgtactgtgcatatcaaattgatcagaaattagtttgttggaggtatatccatatgctctagtttaggagtaagcagggctttccagacctcaagaaatgcgcatgctccaccaaggtcttcattaaaaagaaagcggtaagcagccaattgaccaaatgaactaactatatccctgagctgaaagaggaaaatgcagtaacttgtcagggataagagctttaataacaacatgcagagcgaagattactaggttatgcaaatatactggtggatgctgttatattaccatcttagatgaaatcactctaggaattccagcgatgaaaatctgcagagttaaaaagtgagatatccaatgaaagctactaaaattcttaaacaatcaaacccatatgtattccattagttcaaagacaaattttgctacatgacacttaaaatttgtgcaagttgttggtaggcatcgcaaacacatgtcgtagctgaaagacgctatagattattattggtaactagctagaggacactttcagcttaattggagaga

SEQ ID NO: 34895 - DNA, 2023 bp, Oryza sativa
cccatggccccatgtacattgccagcatatatacatcatattccatctttcactgcattcctaggttagaagcttttgtccctaggggtattctcgtctttttgaagaatttctctctccaattgagccaaaagtgtcctctagcaaattaccagctttttagagtgtctttcaaccgtgacacattttttgcgatgtctactaccaaattacacaagatttgagttcaaaataacagtaggcatatgatatgcatgtatcaaatatttaagccagaaaagcaagcatttctatctgtaaatattcttttaccaactctctctagaaatatagctatctttcatagagatgagaataaaacaactcagactgtggcaacttaccttgtgtggtgaatctctaacgacatcagatattaatttaatctcttcaactggcttcttagaatcagcatgctgcatgaaacaatatatataacacaagataaaataaaataagaaagattttacatgctatgatctgctgcaaagctgcaaaattcatgcaacagcaaaaataaaaaatgcaaaaggaattaagtatgctgaaaatatcagagtgatgttgaaaatcggacttaacccttaataatatttcttaccgacatgtctgaacttccaagaagatgccagatatcactgcatatggtaggatggttttgccgaacaatgtcgtcaacatttagctgcaaatatttatgttagaacttagtacagacaacctccatccatcccaaaacatagtgaactagtattcaattagacaccactacagattcatagtactaggtggtatctaatcgagtactaggtagcaatattttgggacggagggagtatttggctttcaacacatgcaaaatacatgtcaaaaaacattacctttattttattccagtgagcataagcaccacagacacagcgtacataatcttttaagcttctgaagtcatatgctggaattccttcatctttacgataggtttccatttcaaacaggagacctttaaagtcttgagttgttccttcattccaaggaagcttacggatttttgaagctctcactcttgacataaaagtgtcatcattcaacctaagtgatatatcctttgcaaagaagtttaccctcgtcatcaaatcccaaaaaagaggatgcccaagaacaatttctttaattgccggcaatgcagtcctgaaaattttgggaaaatgatgctctgcattagagcataaaatccaaatgctcaagtgatccgctacactatgttcaacggtataatgctacaatatcaaagtactgctacagtatagaacaattcaaaatccaaaggctcaagtgatctactacactatcaaagaagtactctgctacattataaaacaattcaaaacccaaaggctcaactgatctgctacagctacagtatcaaagtactagtgctacagtacaaaactgatctcagctaaagatgttgcattgtttttaacttacttatccagggttttcaatagagcagtcaaagattcaacatgtccgcagaaatatctatcacattgagcaagctttgagcttatttcagcagctctttctaaaatttcttcaagcattttaataaggcacaaccaatcggcccactgggcttcctccaagctcattgtctctgtaattcaaggagtaaatgtcacaaaatttaagaatgctacacagtgataaatagtacaaaacatgtaaaagtgagatcagtgatcagattgcaattacactatatatgttttaccttgttttctgaagttagcaagcttaacggtagacggttgaagatacaaaatcgaatcccaattgagattaccatgatacagtttgttcttcctcaagaagtcaagcccctcaatgacttgcctgagaaaagattcagcccaaaataaataactaaacaaataagatacatgcccagcagttatcattgcagacttgcggttataat

SEQ ID NO: 34896 - DNA, 2594 bp, Oryza sativa
tttaagaatggtacacagtgataaatagtccaaaacatgtaaaagtgagatcagtgatcagattgcaattccactatatatgttttaccttgttttctgaagttagcaagcttaacggtggacggttgaagatacaaaatcgaatcccaattgagattaccatgatacagtttgttcttcctcaagaagtcaagcccctcaatgacttgcctgagaaaagattcagcacaaaataaataactaaacaaataagatacatgcacagcagttatcattgcagacttgcggttataattggattattgctaccttaataaggactggagtaatggtgaaggaatgtggtttattctgtcaccccagcaatcatgtttaaaacaaagtgatgataacagtccagtgtaaggctctacaaatgctgctaaggatgaggggccattgctctcaaccttgtccctggatagggctttcattgagagaatgtttcggtgatttagcgtaagcattatgcaatgcacatgatcattatctgccatctccctcttcagacagacaaggggataactgttaacgcttctgcatatcttctttgaggacgaaggtttgataacccttaaggaatacttctttttaccagggactctctcctgaagcactttaaagggaatctccacttgatctagagcaaaaagaaaatgagaatggcatatgttttagtaaaatgttaaccatcaagactgaaatgaattactagaagcaagttggaaacatagtgaagctacagcaagcctgcaacacctcactatttcactttcagatcctacttgccctacttgccagatatccatataatactgttaaacaatcggcacaacttaaatacattttagcttgctatggcttcgaagaagatgagatactatactacttagaaaaccactgaggagatgaagacctttatatgagagaatagattaattcatacatcttgcttgccccacataaactgctgaatgctcctcatatttctatatggccagcccctaagaaccaaataactcaaagatctcaaacctaacagcaaaatcattaatcgatctcgatcttccaactatataactaggctataggtatcaatatcatgtgtagtgtgcttttgatcagcaccatgggcccatacagaagttgccatgtgctgccggccagccattgtacagccatatgctcatgagccatgaaactagtattgatattgagaatatagagaactgttgaatggaaatttacatacctgggtccattttgatgaatatagcctttgcagctgccttgtttgttatcagaatatcaaggagcttactgccaacaatgtacaataaacaaattttagtatgcaagaagttgtgtttgctgacatatatacaatgggtaaataatagcacatcttaacaaaaggagataaatgatacttttttctttcctctcttgcattgtcacaataattcgacaagccaagaatcccgtccttgttacataacagctacaaaccagtaataatgtcttgcatcttatagcgcaaaagggttcaattgacaagttgtttcatattcaaacaagctatcctatgaattgttgcaattatgcagtatcatctggagtatctattaacaagttgttgtatgttttacctaatgttccattcttcctgttaactacaggtttccagggtacttcaagcgtaccacctatcagcaaaagagtcaacctgtgcagcacgtgtaatgtctctagactctcggattgaagaagcacttggatcatgcttgcaacaatcattgcagcttatacctgcaaggctgcaaaccgtgctgtcgatatggagatatggctccagtgatgcggtgacttctagccaggaactgagttgagaaggtgaatgtttctctaattctctccctgggatttgaccatcatttgggctctgattagtttatggatcgtgtggagactgaccaaccaagtaaagttactcctactattaaattcccagaagctactactctttacagagcagtgaaccataaatctagtgctgcaaaagaggctgccacgagcgcatagcccaagacagcacggcatggttgagcccacaggaccagaattctggaagtcacagaaaaaggaatacccaatacatccaggaaagaacgagcaaacaagaggaaatggaggcttgagaagaagacgacaatgcaaagtgaaactttgagcagaagccaacacacattctgtgagattaccagcatgtaatatacacctctaaatatcttactagtagtacaaactaatcaattaataccacttcataacagatgaagaacgcgtggggccgggggggggggggggttgaatatttgtcactattagaagtggcaactctctaaatgccacttttaggtttgtccttgtaatttttgccactggtgagatattatgcactaatattttgccactgtggagtgccacctaggatggccagcatggacaaggcagttgaccaatccgcccctccatttctctggtgatgaagacag

SEQ ID NO: 34897 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnttaaagaacatttgatgataaatcaagtcacaataaaataaatgataataacataaattttttaaataagacgaaaggtcgtttgtcaaaaaatcaatggcgtcatacgttaaaataaaatacggagggagtattttccatgagctccaagatgaaccggaaatacttggggaaaagaacaggtgaggagaggcgaagccaaccgccatctaacctgacgatggtacctcgtccaacgtccagtcgacgaccagtcctcttccggtcttgagcgcttcactgctgaattggtagatttgggacagatgtataacgaccgtcgacgaggctagtgttgatcatataacaactgacaagtctgcaccgaatctgattctccaccacgtagcgtgcgtgcatgtaccttattagtatgattcttactctaaatatttttgtcagttacttaaaaaaatgagatttagagaaagagacgttactccaaatattttttaagaaaaattgtaagtgtgatgggatttgaacatggtaacttagggtcaaaatcacatactccttgctaatgcactgtaaagtacatctcttgtcaatcacttctatgttgcgtaagtaatactccctccgtattttaatgtatgacgtcgttgactttttgataaacgtttgacccttcgtcttatttaaaaaa

SEQ ID NO: 34898 - DNA, 973 bp, Oryza sativa
  unsure (1)..(973): unsure at all n locations
nnnnnnnnnnnnnnnnnnnnnnnnnnnnnnnnnnnnnnnnnnnnnnnnnnnnnnnnnnnnnnnnnnnnnnngctgagatgcccgatgtcagcgtcaaagaatcttggcacttcactttgtttctttggtggctgctgacattgcctatttcagcgccaactgatatggtgctgatgtttgttgtttcagcgccatttgtgttggcgctgaggatgcaaacactttgagccagcacagcaaactgctctctgcccaggaaaaatacatttaacaccgcatagcaacctatttcagcagcacaggaacacaacttttagaaaccatccatccattccagccattccatccatccagtctggggagccgttccaagcgccactcccgcgtcgttgacggtccgcaagagctcttgtgcctgtaaggttagaaagtgcaaaaagtcacaaaaattaaagcgagagcgtgcaaataacataacatggcaagtactcaccactctatcgcgaagaggtcctgtctcaaccgtggtaccttcacgggttcgagtgtcgtactcgttctgctcctccacatcttcagggtcgtccgctatgtcggctagcgtccaggccgggcgtaggacaagacgatagttcctatggagccacgccaagtatgcatcgaacttcgtcctgttgtgctgaccttggtccggtactccgttctcatcgaatttctcccattgcgtgatatgatcttgatggtagtaagtccaatcagtcaccttcttgttcttccgacgatcgaccctgcacatatgcaaaatagacaagtcaacaatttgaggatggcatcaaatcgatttggtctgttaactcaaagtacttacttgtggaggtcgatactagtggagaaacggtgcgggattgtttgaagcctcccgaactgccgcattatgcggttgcatagctggaactccactgcatagaagcaa

SEQ ID NO: 34899 - DNA, 10203 bp, Oryza sativa
  unsure (1)..(10203): unsure at all n locations
nnnnnnnnnnnnnnnnnnnnnnnnnnnnnnnnnnnnnnnnnnnnnnnnnnnnnnnnnnnnnatgaatatatgttaagtattataaagatgatggatacatatgcatacatacatacatgtatatgttaaaaatactatgaaaataatgtgaaggaagatgattggatgttgatttggagaattcaataaattatagatgatgttgcatgcttgcataagttttatatgtaattattgttagtggatgatgaagtggtatgtttgtatgttgaactttaggattagcgggttataactttatactaagatagaatatggagttataaaatttagaaaatgaattagaaatcaaacactagctatctaccagcagctacttaaaatcttattaagcttttcaaacagaccaagtatttttcttttttggcttcgtttctgaaccggagtctgggaatttttactagtaagatcatggtttaccacaatttatcttttttttttctgggaaggtcaaaaggaaatttaatgattgtattctgagctttcattttttttagcttacgtttttgagccgttaaccatacaaatataaaggtcatgtcccaaaaaaaatatttattgttttccctaaaaagagtatttcgtttggtttttctgtggcttatcaactgaagccacaatttagacatatgtatgcgcaacatatcatttagccatgcgcatacatgacaatgtatagagaattaatttgtgtctatgatgttgttcgaccgagctgaaatgtgtgagaatgtagggaaccttaagcataaaaaaaaagagagtagagaacctcgtacctgcgactttattcaatttttttcacggtctagcgtttggagccggaaattattctagcagttgcattagcaaaaacacttatcaaaatattactaacaggcagcgaagcaacacaaatacatcttagctagcaaagtagttgcattagcaaatttatttaccaaaataccgaacttatgtttaccaaacaaacaacatatgtttaccaaactttaaataacaccaaatctcctgtttaaaatttgcattagcaaaccatccgaacagatccgaaatgcacgttgacgaatgcgcgaaagcattaattgttcagaaacagcccctgaaggctgaagcttagtacggtgtgttgcgtccagttggaacttggaaccacctctttccaatcttgtccccgttcgtccggttatccggtgtagtgcgccagaagaagggaggaagggagagggagaattcgggggaccacattccaagttccaacggaggccggagaggatggtccatgtctgatgtctccatgatatccgtccgtccaacggagggacggccggatgggttcgccgtgtaacagagccgtacccgtccgtacacggtacatctactccaggccagtcgtgctgtaatagtagtatatactacctccgttcaattttagatgaatgtcctaggatacgttacgtccgtctaaaatctcttatattttagaacggagggagtaaataactagaaaaatatgcttgtgttatagtgaaaaaaaaattaaaattattgagcaatattaaaatctacttgtttagtgctaagcccttcgttcccttttctgtggggctcaaacagaagagaactcatttgaactacacatatatgaaccaccaatattactccaatgagaaaactcctgtgtaccccccgaaaattcacctaatcccttatatgcccttaagatttactcattctctttcatgcccctaaatttcagtttggatcctttctataccctttccgttagttgaccgttaaattcttatcataaagtccatttttccgcttgaaattgtgcatgaagggccgaagggtgaggtgggtggttcgacctcgaaggttggttcagcacgactgtcggccggaccagcgccatggttgcttgaggggctggacgcgtgaatatggtcagggtcggctgaaccaaatgaggtgaaacctaattgacttgggctgccgtggtcgaagcttgaatcacttgcgtcactgttgagggtcccgaagatggattgggcctcgccgaagccgaaggtgctgtcttggcttgcagggccgcctcataggcttgatgttgctcttgcatccggtgaagtgtgtcgtgcagccttatcatgttctggcgcatggcttccatctcggccctttgcgccgccggagcctcactctcggcaaccgcctgagttgtgcttgggatgatggaggccatcgcctgagtcgaagcttgagtatcaggacttggatggtcgaaggtgctgcttgagtccgagctagtttggccactgcttgctcctcgccaccttcaccttcttgtagctccgctcctgcttcggctcgtgcgggctcttcgcccgccatctccgcttcgccttcgctctccttcctcttaggtgcaactctctctctctctctctttgtgtgtgtgtgtgttttcttcggtgcatcagtggctccgccctgggttccctacggtcggcgctagctattgtcgaagcgacaatagcttcacattgaaggacgtgatttactcagtggagtgattgaacagtaaaacaatgtattaacttatgaaaatttgttgggatcccccattacatgcttctagtgggctatttataggctcagtacaaactcatgctctgtagggtttaatatgtttagagaaatttacatggatacctttataatatatataaactcatgcagtgtctattctaatgatgggcccctagatgggtcattggcctggcccataagaggggaatggtcttcatgggccatgctgcttggtgggctccctggtgaagcctgtcttccatggggcgaacccttcatgccttgcccagaggagagactaggtggtgagccttctcagcttggtagcgaaccctcttggcttcgtcttctggcttcacctcaaaacttcgcacgaggcaaatcttcttctgaacttggttggcgtcttgctgatttgatgatttcggtaggttcagctgaaaaccctcgtgacatgcctccggcacccatcttcctcgtgcaccacaatggtcaacgacctcctggatgctatgctgtctgtggcctctgtgttatgtcgggcacagtttcactgtcgcctgctgctgcagactagcagtgatcgatggaactactccactttttccttcgagctcaggcgttcggggccggggcaccctccgatggcatccagcatccctcaccaccacccgcgtcctccctcagccgcagccgtagccgcgctccggcggtctcgaccaccgccctggcgtcgtccttccgcgaggcaaaagacgagcttgatcaggaaacgaaaggcgtcgtcaggtggctgccaccaccatctgacccatcaggcccagtaacagtcggggcgcggtggcacagcagtggcaggcaagggaggcgatgctgtgctgcttgccggagctcctatcgcaagttcgtgttgccttgcagcaacttggtggccctcagtcttaaggtagagaagatcagagcaattataactaattaagttgcgtttttgctagtgatctgacgcgtgatttttttctcaggtatttcacgttttttttttgccgcacactatgtgcgccaagatttgtgcaagaattggtggccaaggctacatgcgttgtgcgttgtatgtttaggcccggttttttctaaataaaatttgttttctttaacggttgaaaaattaagatatttggaactaaaataaaaaaatataaaattatagtcctatataactaaaattatatttgtattagtgattttgttgagcaggatttgatggtccctttttttagagggaagttttatgcagtatgaaaggttccaatttcactcaaccattcatgatgtcaattaaccgcaaaactgtagtgcagagcacatcagaataatactgttttatcttcacccattgcaacgcatgaacattttgctaataacgatatttgttgcataataacgatataatagccaaacatttcgtaagtttgaatagaaaagaccttggagttcaagcctaattttcaaactaatgaaactttcatagggagacgagagaatacgacgctgttagagcaagtttaatagtatctcctgaagatgaagataaagattaagtgtttcacacaaaacgaggtggtaataacgtgtgattaattgagttttaattattacaaacttgaaaaatggattaatctgatattttagaacaactttcatatataaagttttcgcataaaacacaccgtttagcagtttgaaaagcgtgccactttaatccaaaattttatccgcgtttttaattggattcgaacgggaccacttgtcaactattagctccaatttatctatagtcaatctaatagtccattcatacaatagttacatactgcattattaatacatggtcacacatgtcatacacactgcgtcttggagtccagctgactacaaatctgtagccctttgttcttttctctcctcatatatctccttaaaatatatttatatgttcttttctctcctcatttactttcttaaaatatatttatagcaagcttatagcctgctattatacctactcacggctcacgggatcttttacggtgtattcgtcatgttgatgtcacattcctttttttaacaaaattaatgtcgtggtaaaatatagcaacttgaaatattccaatttcctcttagcttgccatgcatattttaggaccaaaaaagtatgtgatatctgagtatcacagcgctattacatgtagttaccaaacacctagttaccatatgcaagtatcatggcatttagctagtgtaccaaaattttagtttaaatcattatacaactggatggtctccaaagcagacagcgaacatttaaaatgatgaatgtattgtccgcatctgaataactgaggtatttggctaatgcataaatttcaattaagagccccatcgttttggtggcatatatttacaaacgaaaaataatttgtaaataaaaattttatatgcacacaaaggctgaaaaataaactataatgaaaaaccccccaaaatcaactccaattttaagcttcaaaattcaaagactaataagcattaagcataagcgaaaaaataagaccgtaacattacactgtaatagggttgcccagtgtaacacgggataaaagtatcatatctcaacagaagataataaataagaaatttgataataaaccgtagcgccaatatcctttcttattactaataatatactcaaaaagatttcagccgccatttgcttagttgtccatggcatgcattgcctcgctattgtctcccctgggctgtgttgtgcagtgaccttctaggttcttggctctggtcctctgcctatataagcaaatgatacaaaaagaactaaaatccacacattgttcccgttatagtgatgtataatcatatacaactgttgagaagtgtatgcatacttttggtaatcaaaccgatatcttctgcgatttttatcttgtttctggcgtaatccaaataagtctgtggttttggaatctgaagataaaattcgcctccatgttagcaaaataagaaaaatttggtgaaggcactcaacaccataatcaactaggaaagaaaaagagtctacttcaccccttaaagtaatggagttggtctacttaaccccgtaagtgtgaaatcggatattttagccccttaggtatgaaaaccagctcaaataaccccctagatggtttttaaggaggttttgccatgtaaatgatgacatgacagtattattatttgcatggcacaaatattagtccaaccctttacgaaatttcactcgctgattggtatgcctaaaaattatatattagcatcaatgtatattattctaaagccgttcaacttattaaaaaaaaaacttagtcgagtctagctatcatcatgtcattagaccctccatagtaaaaccaccgccatatcatcatgcatgttcacagtaaaatcgtctacaaaggagttatttgaaccgatttttatatttcagggggtagaatacccagtttcatgcttaggggatcaagtagaccatcctcaatactttaggggtgaagtattccactaggaaaatatcacctataccccaggatacatttgcttgatagggaaataaatcaactaaccatttctataatggcatctttgatcaattgacgagcttccttttctggcacctacacatagatgttccattagtgtgaagaacatatttcagttgagcatgaacctcatgcaaaaaagtatatgcttaccgtttcatcaatgcaagccacgtagagatcgtactgaacaacagaaagaaaaaagaattaaaaatggatggattgatgagttgtaatcatcctgatgtaacgaaactgagaagaggaacctacattttccttcatcgaacggaatctccctcgagtactgcgaagctcatccttaatatcaacattgcgcaagggaaacatatcttctctataaagttctgacagggcatcagtgaattccatctgacaaaagatgaaatagcataagtatacatcactaagaatataaagcaaagaacgaacagaaaaaaaaaagagcaccataagctgcgtagttctgcacattgaggtaatctaaccttctgcttagcaacccgcttccaaacctcaaaatacacaccatcaaaatccttgtagttacaacaatcaaaccgcatgctccatatatattcctaaattagaagatagtactattgttaaataccatcaccacttatgcttgccaattaaaattaacaggaggcattacctggaaagcagtcataacttgcattagagaaacaacacgaatgcgtagtgcgatcttcattgcttgaaggtaaactgtatttttaactttgtcccactaaacaatggaaacagttgccattaattgacgcattataacataaatatacattgcacaaatggcttttgggatggttacctgacccatggttatcttatcctcaacagcaatgagtaccaaataatcttgaaaccactgccatgtgaataaatgacatcagacaaggatgattagatggcatatggccagtattttcaccttgagtcagtcataccttagtcttatgtgctagctcttcacagaatttgacatatgctagatcactctcataggtactataatttgagtggtattgatcccagtccatgtacaaaccctgcacaaagaatacattgtccattacttgcacaagtggcatctactaggacacttgtactaacctaaacagtatctacaacaagaatataccaaatgcagaaatatggcacttgcacagaatgccagcttgcaaacaatagtatccaacatgcctgatgatatgaactaccaagttagtttgcggataacatggcaaaaagcaagtttcatatgcaaatcctactgaatatatcaatagagtgatctcaaatgagtcagtcaacaaacgaagtatatctctaatcaaatacttatgttccttttatctctaatcaaacatgtgcattcaacatttcaaaactttgatgccattagatttgctacttttgtcaacgaaagtaaccacaatggctaaacacacatatgcagacctatcattgtccaaaatggcagacaaacaatgttattttgattctatctctccaaattataaatgaatgggcatttgatggtttgcagttgcaagagaacattgattaggataaaaagttaaatactaaggcccaggggtgaaacggaccaaacaaaaaattaatagaggtcagatcagcatccataaaggtcagatagggataaaaccgagactgctctcatcgatgcagggcttgtcctgattgctaggtgactctgatcaagctagacctaactttcaataattatgtattgcttgattatacagaagtacatgtgccgcttaacttgtcccttaagaatacaattgatatctacattcataacaaactatatccataattcctaactaaaccaataccttcctagctactccctccgtttcatattataagtcgttttgacttttttatagtcaaacttttttaagtttgaccaaatttataaaaacaatatagtagcattttttaacacaaaacaaacatattattaaaatttattcaacgttacatttaatgaagttaatttcgtgttttagatgttgctaattttttctacaaagtcagatttaacaaagtttgactagaaaaaaaatcaaaacgatttataatatgaaatagagggattacagataccatactaaatatctatctctatcctaggaaagtaattgatcatttaggcactactccctccgttctatttcatatcatagtcgtctgacttttttcttagtcaaacttaataaagtttgacaaggaaaacaagtcaaacgtcttataatatgaaatggagggagtagatattattgttgtccaaggtaaactccctaatcctataaatgcagtacgcatttcttttcatataacagtataaacgctcttaacaataacaatgttacaaaagaatgtaacataactagcccaaattttaacctttacaatattttcgtttaattaagtaaattaaaattgtggtagcatgggtacagcaacgcaattgattataccaccaagtactgataaaaataagcatttaagctagttgtcatggaggagtcaagtgccgatacctacattatcacaaagcactagacgctggtagttatcaagggcagcaggctggaatcgttcaggatcaaagtaccattcaagactatcctcatagtactgaaagtaccccttctcataaagaatggagggagggtacttctctttcagttttgcaatatccagttcgtcaagctttctaccatttgataactgcaacagacaataggaaagtagtttataacaagcagagagatgcatcaaactaaaatatacataactttactcatcccaggtgatgataaaagatacctcataacctatgatgcggtagaaggccagctgctcatgcaactcagtgagctgctgtggcccatcgcattcaagccaatcatcatcatcatcatcatcaagatggtcctgaacatataactgatgaaagtagtaactgactttgtttgagatggtatcctcatccatgccaaggagatcttctaaatcctccattgattcttgttcttgtttgtgttctcgtgaaatcttggcaaggtccccagaagatggttttggctccccctctattgttgatgtgcttgttccatcatgagaagaggatgggctaccactgtggcatgatagattttctgtggattcgtccatcttgcgcctctgcctcttcttctgtttcttcttcttcttcggcttgctaatttcttgttgacttgaggatttaacatcttcaatgctgtttttcttctgctgtgcttcatatccaatatgcttgccctttcccttctcagcagtgggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttcttnnnnnnnnnnnnnnnnnnnnnnnnnnnnnnnnnnnnnnnnnnnnnnnnnnnnnnn

SEQ ID NO: 34900 - DNA, 2123 bp, Oryza sativa
cttcactattttttttgatttttttcttttttttttaaatttttgaatttggacgaattttattaaaccgtaccgtgcggtacgggtaaccgtacccccgcggtacgggcggtaaccgcggtaaccgcgcggttaccggcggtttttcacaccctggtcggcactcggcagacggatgcgaatcgaatcagagacgaaggggaagaaagaagaaggatagaggttggtaggtcagtagtataggggaggaagaaaaggagacgggattactcggtaggcgtctactctttgaggcccacgcaccgccgagaggacgcaaacgtaaaaggcccatagattggctcagccagggcgggaataagtctaatttgtctccctcaactgcaaaaccgggtataactcgtctcctaactcccaaaacagttgcaaatcaactcccgtagcggttttggaggtggtttcgtccgacgtggtaactgattcgctgactcatcaggtgggacccgcttgtcagcggcctccaccttatcatcttctccctcacttctccaccgaattaaaggcggctgtgtttagatcacgtcaaaattgcaagtttggttgaaattgaaacgatgtgatggaaaagttagaagtttgtgtgtgtagaaaagttttgatatgatggaaaagttagaagtttgaagaaaaactttggatctaaacacagtcgaaaacttctttttgtcgatattgacaagcacaaatccgtgcacaaattcatggctttggctggattcagtgtaatgcaggcatgtaagcctgttccatccaccaacaaaccggtcgcgatcgccggctactgatcagtagctgaagcgaagcaatcgacgcagctatagctgagctagctacctgtcaagctggccgcaatagcagcaagtacggcctcatgtttactaataaataaggtagactttatatctatagtaataattctaagaaaatttgaacttcaaagagacaacaattctaagacagagggagtagaaaacagaacatgttttaacatcattagataacattgtttctcgcagggcgacaagaacgaacactgaattatttacatttaataacagcattcgcatccagagcatgagttttccaaaataacactactgcatacatttaataacaccattcgcatcagtattccaaaataacactactgcatactactcattggtagtaggcgggctgactgtgcctggagtggtaggcgggctgactctggctggcgtggctggctttgttgtagacagttcctttggtggtaactgaatcaacacaagaacaaaatgggaatgaatgaaaacagaaaacacagcaaaaaaaaaaaaacataaggacttcatcctcatcagagtaaacaggaggcgtccgcgcggatggggctgcactacgagcagtacgacgcggaggggcacgagagctcgctgagccgcaagtacggcctccgcgacgtggtggtgtccgacccggaggccgccaagcgcgacaaggggtggggcttcgtcgcccgcgtctacctcggcggccagaacgtcaccctcgacctctccaggttccgacacacgctcaccaggctgcacgcgcgcgccctgcgcgtacgctcgttgcacccagcgccgtagacggattatcggatagcagcggcagaagcagccatggatgaatccatcggtttctcgagcggatagacgtacgtgacaagtgctccattgcaactagctgtttaggcctactaccactacacaaacgagatggactaccttcagccagaacatgtaagtactaaacccttttatcgtagatgaaaatggtaacttactctataatacaaaatttaactaactgtttattgtgttggtgcaggtggtgtggaggccatatgaggcacaagaagtagtcgagctagacatgaaccctatgtgccacatagaggatacgttgcaaaccttgcggagcccactgatttgcttttatgcagtggagttccagctatgcaaccgcataatgcggcagttcgggaggcttcaaacaataccgcaccgtttcttcactagtatcgacctccacaagta

SEQ ID NO: 34901 - DNA, 723 bp, Oryza sativa
cttaaatagggctgccttttggtgaagaaagctttgggtgaggatgctacactagtatctagctccggccttaaggatgctatacgagtttctgatgctttaaaaaatggaaatagcaataagggactgttttcatcatcccatttaagattgtcccaccatgttttctgccccatgacactctttaatttgacaattgcatgcccaaaaggcagccttctcagcttcggacaagcaaacacatcaaagtattccaaagaaggaaggtctaggctaaagttacagaagttttccaagcttggcaacgaattcaattgcaaaattctcagtcgtcgaaatccctggattggcatttcatcttgtacttcagtattgattttattctttatatggactagctgtttcattttattgcagaaagacacatccaattgctccaggtgcggtagtttcagaatgcaggacatgtccatcagttgatgggctttccctacataaaggacacgaaggttctgaatatgccccatactaatcttctcaattcttggaagatcccaaaaggtgagaaactctagcctcggaagatgatctccataacactgtggcttgtttgtgacagagaactcctttaattctgaacagtccgttatattaagaacaaggacactatctggtatagtgagcgcaagagatgtctcgccactcaatttatatagaccaagc

SEQ ID NO: 34902 - DNA, 713 bp, Oryza sativa
  unsure (1)..(713): unsure at all n locations
nnnnnnnnnnnnnnnnnnnnnnnnnnnnnnnnnnnnnnnnnaacacaaatacatggtcagcaacaccgactaagaataataattatgcacgctcacttaatttgttgtactcggcatccaccaacacaactcagcatgtgtttatattgattcaggccacgtatcatttgacgagcctgaattcatacacatccacttgcgctggccggaattgaggcccatccaaacaaggtctagaagtgcatcattatctaaaaggtctaaaagtgcatggactcacagtaatgaatctcgatagttctccattcaatcatgccagattttcaaccaatacactaagttttgcttcatgcaggaggacaaaaaattacttgagagtttcgagatagcatctaacataattctaagaaccaaaaactcctaacaggagccatctaaggatcggacctgcagaacagcaccatatgtcctgagaatgtcagcgcgggcaccggcatcgccatcattgagatcaagcagtgttcctaaacaaggaggaaatgacacggaaaatcaaagtcaggggggagtagataacagattttgtttgaaaaaacatatcgttgcccatcagccaaagttgataaacaaacagcgacatagcagaggattttgattctgttccttttggagccggctagcccaactactccagaaattacacgattcaaaag

SEQ ID NO: 34903 - DNA, 8669 bp, Oryza sativa
  unsure (1)..(8669): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttaacccgtgcatgcatgataaaatgtatctgatgaagatcgatgtgtataattataattaagcatattcatgatatcttgaaattaaatcagagggaaattattagaagtagcttttcatgaattaatgcaagaggttaatcaaccgagctagcttctatatatgatatatgaaagtgtgcataattatttgggcttatagacatgattgaggcagacaagcttgagtgcatgaaaagctaaacatgcaggatataggtatgcagcgatctgcatatgtagaagtttgccatttagcagagttcatgtaaatgtactgaaagataagcgtacgtggtacatttagcttctcaaaaggaagctacatataataatccatacaagtcgttatactaattggagatttggagaactccagagtaataatatgtctggtaatggcttccatcaatttttcatctgatttcttgggcctgcttgaccttaattatgcatatatataatgcattgctgccttaattatgggtgaaagggtggatggtgatacataacgagtgagatggaagaaaaccagaaatgaaggaccagatcgaatagagaatggatcgaaagggaccctgacctagttagtgtacaagaaaaaaagaaatgaagatgtataggtgaaaatgaaatatgtgactacgtactacaaattaatacacaattaattgaactctttcagtagcccccacaagcttctgtggagacatcttgaactaaagctgcatatgaaaaatcagcagcgactctaccacatattatttcccctgcactctcttccttaagaggtacaaggcacaacaaaacttttcctagaagctaagttaacatgaacacactgattaactgaagatgctaacctgtgacctatacatgcaggatggttaatttactcgtgtactagactgacgacacattggatgagagaatttcttgtaaaaaattaatgcaacgttcaccttaaaggagaattaagaagaccttaattgctagaccagactacacaatgcaaaattggacttaccacagtcctttgttagcatgccaaatacaccactcaacccataagtgggtacatttggcgtgaccgcgtgagtgtaattagtaaatatgtgagctgagtaagtatactcatgagagctaggacagatgatatgcatatgagatatgactgacacatgtgtgtggaggaagaagatactgtatttagatggatgcagacttaaggcagccgtggttttctaggccaatggtttctctggagctgcagcgacatgagaagaaatgagcctgtactgatactgtggtgatggtgccggcagagttggagctgtcagagacattgtcatgcctgcagaaaataaggatcgcattatttacttagtactgtattatcatatcaagtgcaattagttaatcgactccattgtagtactaccaacaataaatgcaggcccctctcaataaaaacaataaacaataaatgcaggccaattattcagttgatgttccagatcaggattaatgtattccaacagaaggattaattaggtcaccaagaatggttatctataagctctctacaagagatccatgttagcatatttttctacttggaagatattaaatgaagagagagagcaaagctatctactagcttagaaatagtctatagagaaaaacgagacaatgcatgagagagctatagatacctatgtagacatactattgaggtggtttattattaatctagtctattgttgagatgtacatgttttatagagagcaccttactttaccattgcgggtgctcttagtactccactcctaattaacaataactagggtattactagtactccctccattccaaaatataaggcacaactacccttaatccaaagaccaagaaataattattatcatattgtagtttggatcatcctaataaatataatgcatgcatccaataggattagatagcatgagagtggaggatttaaaaaagtaataatttaatagagaagatatcataattaattgtgtgtttgcatgtatgccttatatcatggaacatgtaagaaaagtggttgtgacttatattatggaatggagggagtattaattagtgcccaattttatttttgggtgagtaggcataacgtcttttttatatgtgataccctcacaagcatgcatgatctcgcgcaaaggattgagtagcgtgtcaatatgcacaagtactcatgcattgtacattgggttgcttgcagattcagacatatatatacagtgcatgtactatacaagaatgaaaatacatcgtgcatgtaggaatgatatatacccccatatggtacggttatgtataaatgtttaacgagaaggatgtttttctttttaaaaagaattaactattaatttcatatttaaataaatttataaaacctaattaacaagatattatgatagatagtataatttttaaggaaaatccaccactaatcatttgagaaattattaatcatcaattttttcataacttgaccaaaccctacactaaatgttaaatatttatagcaggatggagtagctcgcagcctcgaattaatagaaatatgacccccctccgcccctcccccccctaataaaaaaaagctatctcactgaagatatatactccatccgtctctaagatataagtacttttggactttgacatggtcgccaagatgttattttgaccaataatatatataaaaataagatattttaaataaaaagagttgcatattatgatagttttttaataataaatctagcaacatcaattttacatgattgatctttttttattttttactattaatattaatagccaaagttaaaagtatttgacctgtcattatgctataaaaatgtttatattttgggttggaggaagtaaaataaattaaaacatctctgacaaacctgctgcttggccggtagagttaggagcaagagccacagtgccagcgtactgctggagcccggccacggcggtcagctggctggccgtcgtcgccgccgtcggggctccgacagccgccgccgccgccgcgtactggtacatctgagggtactgcatgccggcgtacccggcagcagccgcgttcgccgccaccgctgggccgtactggaagtacggcgagtagagaccgccgccggtaggattcgccattgttagccccgccgccccggcggcggcgccaccagcgaacatctggtactgggctccaagcccaccgtacgcttgatagtagctctgtatagtacgtaaaaatgttgacatgatcatgggtgattaattagtttaccactaattttgagatgcaacattatagtttatgaactagtaatagtcagactttagtaaaatctataggagagggatcgatcgatgaatctctagtagatatatactttatcagcttgcatatatacacaatatatgtatatatgtaaactataacgcaaattgattaaacaaaaaattacatggatgatgattttttttttctgaatggaattgaagtatatatacgtaccagcggatagccgtaatccgagaaataaggtgagtacctgaaatcaattttgcaagtagccaaaggagagtgtcattaatttgctttttgaaatgtacatagaaatgacgtgatgaggtacatatgcatataataaagcaacctaaatacatacatttcgtgaatgaataacctaaatatttcgtgaatgaatacatctggatatctctcctatatatgggactcctaattgcacatggaattacctaaacaaacttggttgataatgctgattattgattataaatttcctaattcctagctgtaaacttgggaactctacattaagtaactgtatgaagcacattaattggtgttcagcctaattgcctaaagtagactaactaatatatgtgcaggcatggttaatttcagtttggagtacagatatatcttaacgtctagtactaatctccggccttaatgtggccaagtgaggtttcatatgaagaaattcatttgcatgaaaattaatcatcttaaatactagtcactaaattaagaacaccaagatctatatcaattagcagagctgcagaatggaaactttgagatctctctagtttcttgctacttttttttcccctcagtgcatgcaggcatgcgcatattgcaggaagaactgagcaagcaagaggggcgcatgcaatgcaaagctttttgtaaagtggcgcgcatgcaactgcatgacactatatataccgaccggtaccccacatgccagacgctgtacccgaggcattatgctatacagtatagtatatacgtacatatacgggctagctatacagtatagtatatactagtagcacgtcaaatgatcgatgaggacacatgcagcatgatcatgaggtgctcgatcgatcgatcacgcctagcttagcttatactactcctttcaaactattttaagtgcagttattgatttatatatgtatccaatgttttaccgtttgctttattaaaaaaatgtaaaaaaattaaaaagtaagtcacgcataaatactatttatgttttatcatctaataataacaaaaatattaatcataaaaaaatttaaataagacgaacggtcgaacgctggacatagaaacctacaactacacttaaaatgcgacggagggagggggtaacagctactacagcaagttgcacacatacactactagctagctgcttctctttcactactcactatttgcacacacatacacatgcatgagagagatgagagagatagtagcattgtctttgtgtgggcacatgcacatggagatggagatggagatggagaaggagaaggaggagctggagatgcacatgcagatggtgatggacggtgcagtcgttggccccctccctccattaaacgagctgaagctgagaccagctagctccaacgcctttaaccccccaaaaccatcctctttacagctagccggccatcttctctactacatatcatatcccagcatgcatgcaatgcaatgcagcagattgagaagcaaacacaagctctatatatcgatctctagctagctagctagctggctggccggtggttagtgtgtgtactattcctacctgcaactgtatatagaaggagagagggtgtgtttagtgcgctaaaattgaaagtttgattgaaattgaaacgatgtgacggaaaagttagaagtttatgtgtgtaggaaagttttgatatgatggaaaagttagaagtttgaagaaaaagttaggaactaaaccagaccagagatcgatatgagtagtttacccatacacattgtaggtcgggatcccctgctggatgccatgatctgccatgctcaagctggcaccaccaccgcctgtctggataatggacttcattgccctcatatgcccagctgctccagttcaattcatgcatattcacaaacaatttatcaactaataaagtacagtattcaattactatgcatggtaataaagtacagtattcaattactatgcatggtttgtaattaagcatgattagtaattggctgctggataattaattaattaattaattacagtcagtatatatatatgaacaggagtattggacaatccaaggacggcagataactgcatgcctgacaacatgctactatacacactgcaaactgcacaagaagcaagcaaggcagcctagaaggctggaattaacgactcccgagaataactaaccgtgctcgcttttagcacttttgcagaaaagctttagctagctcagctggagaccacgcagccttttcattaccggtgaaatactgtcggatgctcggatagcatactttatctagctcgatcgcttgttgttttgatcttaattcatataagcattatccaactaactatactatccagcttgatgacagtgaccggccttaatttggcgcgaagcaataccatatagttagacataagtacttaatgtgtacaggtattactaattagtttacatcacaattaataacttactagcttgattcaagaattagcatatccaaaaagtgactatacaggatttaagcttttgttagtaggaatttgttctcaactaactgatcaatcaaaagggacgcattttttgagccaataatataaattaatttgattctgaagaatgcaatttttgctcaagggaaaatgaagagtatatactaagtttagcagtacgtgcagtatgctcccaaagtatgagcataaaatgatgcacaatacatgttgtagaatctagctaaaagatgcaaattaagccaggaaacgcacatatatgctcctcagttattctacatgatcatcatcaaccttaaacttgtctccacgtagtgtcagttaattatatgatcatcagaaattaagaatctggattaaaaaaaccatgaagaaaagttaaggtgcgtgttttatgtgatagtgatttcgattaccataaggttgcagagacgctgcagctgccttggatctctggaccccaagatatgcaagattgcagttggccctcctcccatcgatcaccgggtacggatcaaagcaagctttcatagcagcctccggctcgcggaatgtaacctagcaaagcagaaataataaagattcagtagagatcgaaagataaccaatccaagatcacaataaaaccatgtagctagctagatatagatatatagatatcttaaaaaatcgatcgatcagttaggttcttcggtgattaattatgtgcaagaaagctgcatatttatcctggttaattaattattcttttggttgaagaattaacttgggaggtgcaactagctagctagaacagctagttggatcgatgctgaaattaaaatccaaattgattgaaatccaagcaaacagaagtagaattgaataggaagatgatgattgattggggaattaagcaggaagagagaaataggaactcacaaatccgtagcccttggatctgccggtgttcttgtcggtgatgacgacggcctcgaggatatcgccgaactgctcgaagtatccccgcatcccctccttctgcgtctcccacgcgagtccccccacgaacaccttcgtcagcgtcgtgtcgccgaactgccccgccgcgccgccgccgccgccagccgacacagccatctacaacctctacctcttcttcttcctcgatcgatcgctcgctccgatctgtacttctacagtaacctggtgatcgatctcaaaaggcaagggcgatcgagaggggggctgatggctatatctatcgaggcttgatatgcaagggaggatgaagagaagggtccaacctagctaggtagctagcaccaaccctagatagcctcgatatggatgctggcctttgctagtactacacctattagcttgagttgtagagagagagaagaagaagaagcaaaagaggaaggagaggagaggccgaaaggaggaggaggaaagaaaagcgaaagctggcaaagggaaaagaaatcaacgagagagaggaagaggaagaggaagaggagaggaggcgggaggaaaaggcgggtacgggggtactctccttactcatccatcgagtaggtataaagaaacatactccctatcccaaaacctattagcttattttggaatggagaaagtatcttctaacttattgtcctcttctgattttaagtaattgacatctaagagatgatctagaataagattagagcgtggactcatctccttcctccttcagccccctactcttcctcctcccctcttcttcttagggttgcaagcgggccaacccgcgaacccgcttataggcaaaattagtaggtaacctacggatcacctactgatttgacttataaatgggtttatggatcggcccacttgtatctctaagtgcagcaagccgaatcacgatatgaaaacctacgggttatcacttatttgacatataagtaagttcgcgtgttggcccgctttcatccctacttcttctccctacattctatcaattatgatccagcggagtagaggggactcaagtcccccagcacccacgctgcactgacacatgggtcttatagctcgtgggccgacatgttagcaacctacgacagatgatagtatatcaaaggagcttctttaataggtatatatatctctctatcccgatggcttgtgtttcatttacttaggcaatgtgcatcaacatatgaatattaaattttgaactcgtttattgtggattattaacctacctctacattattccctnnnnnnnnnnnnnnnnnnnnnnnnnnnnnnnnnnnnnnnnnnnnnnnnnnnnnnnn

SEQ ID NO: 34904 - DNA, 6213 bp, Oryza sativa
cccgcgaacccgcttataggcaaaattagtaggtaacctacggatcacctactgatttgacttataaatgggtttatggatcggcccacttgtatctctaagtgcagcaagccgaatcacgatatgaaaacctacgggttatcacttatttgacatataagtaagttcgcgtgttggcccgctttcatccctacttcttctccctacattctatcaattatgatccagcggagtagaggggactcaagtcccccagcacccacgctgcactgacacatgggtcttatagctcgtgggccgacatgttagcaacctacgacagatgatagtatatcaaaggagcttctttaataggtatatatatctctctatcccgatggcttgtgtttcatttacttaggcaatgtgcatcaacatatgaatattaaattttgaactcgtttattgtggattattaacctacctctacattattccctccgtccaaatatatatgtggcgtattttattcgttaagaatataattcccatcacacaaaatcgatgtctttagatttgtattcgaaatatttatagttacacttttatatcacataaacggtatatatagggtaaaacaattgttagtcaaagtcttgccaatatttttggatgggggagttgtatatatcagctagcttagaatggaggaatttattttagcaaatggtgtggtgggaaagtcatggcaatgcacatgatttcatccaacagtgttcaaattctaatttctgtatataagaactttttactgtcacttgaaaggcggtgcattagctgcataccggcataacaatgatttgtaaaacgaaaccacacatgtcacgaagcagattaatgggttagtctgcattaaaaggaggggattaattactgtactttgatccgtacttactattgatgaatgtaggaacagttgtttaaacagtatttcgactagtcctaatgaatctgtaagtaataggaccggcaattcattcatagtgagagctgtagaaaaagattgcaattattatgcttaagattgattgacctatttgcctttcgccgtatggatattattaagtgttagcaagttgcaaggcaaggacccagtcattagggataatattgccaacacgtactacatctctatgcacaatccacataaaggattagtgctaattatttgcaatcagtacatatgtacacctatctgtgggaccataagtgcaaagtccatatatattttgtggttactgatgcgctagctcttaatttagtttataaagatctcagaaagttaaggcagaaatggtacagtattcatgtttaggtggccataatgtgtttagtttaggtgtaatgacaacccaaagtgatcatatctgtatctaaccatgaaaatgacaccagaatagatatcaacaaaaagctagagtagccaccaaataaccacacgaaagaaaaggaggggagaagaatgtgtgaatcatgtcacaaaaaaggtcaccattctattggctgagtgggagaccaatacatgaatcttccttgagatgacagctagccctattaacaataacttggctttcacctagctgtgaccatatatgtttagtgttttagtattgctctattatgatatactactagtaagacaaagtgcttttgcagttgaccattgtgaagtagtggaagaacacattctaagctacaagtagctagatatatttatgattctagctacttattaatacatacttacaaaataagaaaccatgttctaaaaaaatacaatcaagaattctggggttaatgagttttggaagtatatgtgctgctagcttttgggttgagtcctcagaaaggtcaaaactgttatgttggttttggtgtgtttcaccaacctttatattcatattgacttttgatgttgaacctaagctaatctgttactaactttgcatcagtactgaagaatgtgtatgcatgtatgacaaatagggtacttgttaataataagacatccatttggtggatatatgtactatatctgcaaaagcatacccatgggaatagaacaacatgctcattgctgtagacctttcaaccctgatctggccaacttgtcttcaaaaaaggcttttcatttttttttagtaaagaaaaggcttttctggtagaacagaatagtggaggttctccagttgcatttctaaaatgaaaccttgcgtcacaagtgatccaaagcaaacatttttcttcctctaaaaaaagtcaattgattcacatgtattatcttgatctcatctcaaactctcttaattagcagataacttagagcttagagaactttaatgatagtgacggcagcattatgcaagcgcattacatcttgagtagaaatttctctgacatgttcataaatcagatgctgcaaaatcattgttcttgagtagaaaacccaacagaaatgatgcaaccgcagccaaattcaagacaatattgtgatctatcaacgaggtgtgagtgtcgtgtgaactactcattatgatcacatcgaatcctgacctggacgtgaaacatcgttattcatcagagattatccaactgggttagacgttgatggcctaaaagtgaggtcaagctttcttcactagtacatccatcatatcgtatctttggtctgtcgctggtattgcatactttatccttttgacaactgtcttgcaggcaccaaactttgctttttgaccatgggggtgggccagtctgtaaggacctgcagaatatatcactgaatttggtgagagatgatgaatcgaagctgaatttgcagtgtattcacattcagtgtagatacacaaccacaagcaaagtgacagatttagctgataatagaaagacgaatctacatagtatcaatattgagtacatcagcaggccaccattagcatcatcctaaagaactgccagatatatatggaacgaagagaatggtccatgtcataaggtgatagcttactccaaagtgatgcagccatattcactgttatgaagaagtgtgctctgtttggcactcccaaccagttcctctatgataagtagataacagcgcaatttaattgtgtacttagtgcatgacatgctgttgtgatactcatgccgacagctctaatttctcaaaatgatactgctcgccagcaactacttttagaagctgagaatatctaccaaccgacgttgctttatggaccacaattagctaagaacataagatgtgtcttattggccacaaaatgcagatcaatcctgctgttggagttgagtactaacaacttggcatttgtttaaattcttccagctaaagacctttagtctccaagtgtttgcaacaacatgcctcataccatctgcaggatgtctggatcagatccaagtgccataaagcataaacatggaaactgctaatgcaggtgacaggtgatcatccacggagtttccattcaactgttcaagaaatccaaatgtatagaataggggtctagacagatgcaaaatacaattcgtagtcagcaaatgagttgatgccacacaaggtatcaccctgttaccttgaagcctccatgatcataaagaacagtgcctatattatctccagtctcatcatcattatcatcatattcactaggattagcttcttcgtcagactccgaagcatcagtgatatcagagaaaccatcgttatccatatgcgataggtccttcccttgactcggttcttccattttcagagaagcagctcttctatcatcacaataaacaggatcaacattctgggattgtgggtttccataaagtgcaatatgccgataataaagttcaagctctttttcagacacggcaataaaacgcctcactgtctccagtgattgttcatattttgatttttcaagtgcctgatgaaaaaaagggacagaggtaagtgcgcaaaatgatgcatagaaaacatcagttatctggcatttctacaagctaccaaccataggcaataatccatctgagacaactgaactgggtaaacagaatcaacaaacctacctttttctttgatagtgtatcgactggtgacatgacatctggctgaacatagttctttccccgatagaagactatggtgtcatttccaatagtattaatagggataccaccactcagtctggctatctcacttgcgtactcctggatttgccctggcttgcagggtttgcagatgacttttacagtctcatgtttcttccagtgcaaatgcatgtttagaataacaccaccaaagactcctctccttccaacagggacataatttgactttttttgagaaaccttcttcaaataaaatctttcctcgccatcaagatcatcttgtttagccatagggccttgtgctttagcaatctcatacttctttaacttctcaaccaacatagcttctttcaatttggcctggaagagaaacagatagtcttagtttgtactcccctagaaacaaaacaaagagaaatcaagcacattgtcttccaacatatttagcatatgtacttctgaaagttccttggaaaccaactacttctaaattctgattatatcatagaaatagaagaagacaaattatgaaggaaagtatattggcagtgaattgaagctagaatgcttattcaaatactgaatggcaaccagcaatgtcctactctgaatgaaagatgcttaatttgattcattgattgtaaagattgcttcaacaagaaactagtcgagcaaactaaattaagcaaatatgtaaaaagacataccttctcaatcttgtatttgagtcgagcttcaggtgtagaaaatttctgttttatcttctttcccttgggtctgatacgccgtggatcatttttattggcctctttcctcttcttcttttccctcttcctctgaagcttcaatcgcttctttgtcaaatacccccgcttcttggaaggttccacctcctcaatctcaaacttgggtttcccatcatcagatagaactagattgactgagctatggctagcccatctaaccatccatggaggactaaactgataaaagggatttaagcatttcccaaatgaagcaatagcaggcctgcaacaagtagcaggaaaaaaataccagggaaattaaacccgaattgtcattggttacatattactcacatcatgcttggtaagctacacggagtaattttagtgaacaagtaggcaactcttgccaaatgaacatcagtgctatattctttacagaaacaacaatcgtttgggaggaaactcctttatatgattattggaattaaagttgcacacatgcttcatgttgcatacatcatttttgccgcctgcagtttccagctcctcataaacaaacacctattcacaaattctagtagtaataatttggtatttctcccatctaaccaatgaggatgtactcgaggatcaggagagaggagaatcgagtaacagatagagttacctgagaggttcaggggaaggcgagattggtgccctctgggacagattgaggagtgagaacgaagccaactttctcaggttctgtgacaggacgcgggtcgccatagcccactagtcctatgccaacgcattgaaaagtggtgtagtcaggaatattttgttgagtgtgcctaacttcatataccgaaattttctaagaccgcaaatcctgtatgaaagtacaaattttagttaaaagtgtgatacaaatataggaataatatctcataatatcactaatcgacaaaaaaagagagaagatcatatataaaaggtcttacataaatatagcagattcacatagaacaaataagatgtgtgtgacagagggagagagaagcacttgtaggttgtggcatggccactgtcaatggtgatcgcacaaactcgtcatgatggaaataatgaatataatggttgtaaatacaagaacatatcactagaacggatgataatttaaagatctccgcaatttcaactctaaaaggtagtgaattaaaaaggcatagggtctggttattaccattgactcacatatacctaggttattactatggcatttgatcgaacacctttctgtcatgaaaaaaataat

SEQ ID NO: 34905 - DNA, 1655 bp, Oryza sativa
  unsure (1)..(1655): unsure at all n locations
ctgttgcagtacacgacggcgacgccgaggaggaagtcggcgcacggcgccccggcgcggtggttggtgcagaagaagcccaaggcgaaggaggggccgaggcgcgccgggttgaggcgcagcagcgcggcgcgcgccacggagccgtcggtgtaggcgacgtggtggcgcagcgcggcgtcggtgttcgcccacgtcgtggacggcttcgccgtcgggtagtcgtacggctgcgcctgcgcgcggaggaggcagagcgcgaagcccacgccgagcagcgccgcgtgccgcatcgttggtagaaatgcaaggagtttgatggtggtggtgtgtggtgcgagttgtcgtggtggaggcgagtcggaacgtttttttatagctttggattgcgtgcaccgtggttggatgggcgttttccttgcatgggcatgcatggtgcacaccgcgcgcgccgctggttgaagactagtagaacaatctgataccaacgcggtgtcggtgtcaatgcctatctgggaatcaatccaccggagcaaacgcgtagcggtgcattgcgggccagctgcatgcatgtctcgtcccctctgtgtttgactctgctggcttaattcgtttcgcagtgctcaacagcgagcaggttatagcaattgtggcttgcgaccacaacgtttggtaacgttctcccaaagccactcgtttattttaacaccaaatgatatccagggatgcctcaggactataagctagctataaatatattttaataacataaaagagaaatgagaaaaacagtgggttacaaatttataaccaactataacacagatttcaaggcgcgatgtgtatatgacaaataggaccagaaattaatagtgtagtatatgttcataggtaactattgtatgatttaactagtattaaattgactataaatgatttggagttagtagttgactatactattagggtattctcaacccaatgactaggatggtgtccataacattaaataagttgtcacttaggacaaaaaatgatgtggcaagtgaataaatgaggaaagagaaagaaaccatgtcttgcatgagacatggtttctacacaacattcaagacatcatgtgagataagtagcattaaattgaagtatggaatagtggtgtttgtattgaaagagtagtgtctagtactagtttcttgatgatataaaatttatagaaaccatgtctagtgttctgggttgtgactgtccttaaacttgctctcaggccctagattcgtttgtcattgttaacaatttttcgaggagcttagctctggcaaccactggcgattgggtgtcggctaacaatggtgatcgagcacgccacggcgcgtcgcatccgcacgccaagaacgaaacgaaaaatccattaccgcgccgctgcgcacacgggaaagcagcagccaccgcggcagcaaatgcccagcccggaagtagcagtcagcgtctcgccccggcaaggagagatcgtgggcctcatgggccgcagcgtgaaggatagtcgttcttagacaaatgggctacgcaaggagaaatcgtgggcctcatgggtggnnnnnnnnnnnnnnnnnnnnnnnnnnnnnnnnnnnnnnnnnnnnnnnnnnnnnnnnnnn

SEQ ID NO: 34906 - DNA, 770 bp, Oryza sativa
  unsure (1)..(770): unsure at all n locations
atttttttttctgcgggcttgaaaccacaaccacagcaactatatgggctatatgagagtttatcaaaaatccacatgcagtggagaaagcgcaatcagatatacgaaaaatccttggaggcaaaagcattgtcgaagaagcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgtnnnnnnnnnnnnnnnnnnnnnnnnnnnnnnnnnnnnnnnnnnnnnnnnnnnnnnn

SEQ ID NO: 34907 - DNA, 565 bp, Oryza sativa
  unsure (1)..(565): unsure at all n locations
cgagctcggtacccatatctgtaaatgaaaactgcacctgcagggctttaacagcggatttgtacagatacttgtcacatttcaacatctctagtagcaacttggatagagaaccgaaattctgacatatatcaactgggtagcggcagaaggcaggaagcaaattccacagctgattggaacatgatttcaagtcttcacatttccgtgctgacttggctgaagttaaagcagaaggttaggaaatcatgttgcgtatgtatttaagacctaatgaattggctttacctacccatgttagaagcttgttgtacagattctgctagaggtacaatgcgctctaggaattgttgtggtgaggccccatagatatacttatctaaaatgggcaaagccaagtatttgagcatgttagccggtcctcatcaaaacctattggaattagtgaaaggattttatctggccccaaagcaatgacagctgccccaatgcactcttcaacctgannnnnnnnnnnnnnnnnnnnnnnnnnnnnnnnnnnnnnnnnnnnnnnnnnnnnnnnnnn

SEQ ID NO: 34908 - DNA, 1361 bp, Oryza sativa
gctaatttcttgttgacttgaggatttaacatcttcaatgctgtttttcttctgctgggcttcatatccaatatgcttgccctttcccttctcagcaggggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttcttcttcttcctcctcttgagctgccgatcaggcctcgcttcgtcaccaggcgagcggtgttggccccgcttcccgtcgctttcctgttgatcagcgggtgcatcttgtccggatccgctagcaccgcacgcgggatcaggttcctggcaataaatctgccaccgcttctctggatcaagctgcggcggcgtcttgagcatcttctccctggagttgtaggagcaagcaggacgtcgaaaccctaatataacaagcgaaaatagtagtcaagattaggggttggcttcaggagcaattcgagggagtcggcggagattgatgatataatatttagggggggaacgagtgggatctggggattgtggaggcgatacctttccggtcttccgtgtgtggtcggcaccagggtttcaaaaaccgccgggggcccggttaccgccacccggcggtacggcggttaccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttctttttccaattttcaaatttattctccgttttgctctcaaatttgaataaatattactcttttttgagaaatttcttccccataaaacactataaatcaagcactaccttcactattttttttgatttttttcttttttttttaaatttttgaat

SEQ ID NO: 34909 - DNA, 573 bp, Oryza sativa
catatatgatagtttctttaatgataaatctagtaacattaattttacgtgattgatcttttttatttttttctattaatggtcaaagttaaaaatatttgactcgttattatgctataatgcttatattttggaacagagggagtacttacaaacaacacggggctgacaatttctttagggagggtgatcccaagcccaccgtccctatgaaatcgcagcaggacgtaaggatgtcctacacttatgggcatgcccatgcatattgggggttcctactggttctgatggtgtcatcaccaacgctgcgcgcgcttgatgatttcatgtccttggattataggatccccgatttgatggagcttttgatgcacccgctttgttgcacgcagggatcgggcaccgagcaccctcgcaaggcgcgatccggggaacagatcgatcaggttgaatccattcatgagatccatggtcttgtctaaagcctcgagatactcatccccctgcgggcacgtgtcgccgatgattgccgtcatgatgatgttgttcgccatgatcttaaccagctcgctg

SEQ ID NO: 34910 - DNA, 5112 bp, Oryza sativa
aatagaaaaagaggagcacgcaggcgcaaggagagagcttgcgcacacaagcacaaaacgaattcagattttctttttgggtggtcatgtagagcctctgcacccttattgtgcattcttctttattttgttttgacccgttttcctagaattcaatggttgggttccaggcattgggcatgagttctcgtgggagccatgcaaacattgtgagaaaatttccaaataggtcataaaacggataaaaatgcttgggcctaaactcacagtttttagcaagcctaatcctttaggaatttccatatttgaaattggacgattttggagagtaccattatgtagtcttgtaatccctctgtttcatatcataaggtgctttgattttttcctagtcaaactttgaccaagtttatagaaaaaaatagtcacatataaaacagcaaactagtttcattaaatctaacattgaatatattttgataatatgtttgttttgtgttgaaaatactaccatatttttctataaacttggttaaacttaacgaagtttgactaggaaaacagtcaaagcgacttataatatgaaatgtggggagtaattgcgtattggacatcaaatttgaagttactgttactggatcatgtacttgattgtatgggactatgggtcgaattttaatgtaatgttcgagtttaaaatttctagttagcgtcaaaataagcccaacaaagagttaagggatggtttatttctcaggttaagtttaaagcttagtccattgctccatttgaaaatctgaagccagttgggatagactatagagcttattaccagttcctttgcattgcaggtttctgatgagagagtaaaccatgatactgtgacctcacatgaaagtgaaattgggtctgggtccatctccacagttagctcaacagttagttcagtagaatcagagaaagcagcttatgaattccttgctcaaactcctatcaagtcaaccgatgcacaccttgttgagttttcagaagctatgagaagtaaggagacaaaagctttacatggcactaccaaattcctgattatctacagttatatatacctttcagtcctttcacttgcattcaaaaaacaaaatattgataaatatagtttatttttaaactgaagctgttgcaaaagcattgcgaccagttgcaaaagggaaagctgctgctcaagctgatgcggaagagtggaggcgtaaatatgaattagagatggcacacaaacagcagagaaaaatcaaaggttagttttgtatacattcgtagttgctattccaggagctatctccaaaaatctaaattggaattctaccttgtgcaggctatggcagttgtgccaataatgaattagaaaagttggccagccaactaacactggagacgcctgcatctgatcaagcgggatgttgtggaaatcatggtatatgttcacatgaggttcttcaggatgaaagtcctggtcctaacccccgatctagtcacaagctggtgagtagaaaggcatcatttagactttcatggggatgcaatggggataaaaacggccagcacaagcatgattttgtatcatttgaaaagggagatataacaacagcagagcgcagcaacaagcaggttagtcctcctgtgctggaacagtcaagaatattattctaattatttcactccagtagctggaataactagaccaatgaatcgtctcttatgcacatctatttctgttacaacgattttttttatttcagattttgctgaaatgggaatcctcgccacaaactgttcttttcataaccaaacctaattctaactccgtgcatgttctttgtgctgaaatggtcaggtgtgttctttgatttttatattttaaatgccctaaatatctgacagatgcatgcacgttttaagtattgtgtttgcactgctaaatgtactatttatttttctgcagatggcttaaggaacataaaaagataaatgttgttgtagagccacgtgttagcaaggaactcttaacagaagattcctactacaatttcatccaaacatgggatgatggtaaggcatttctattgatttaatacattagtttcatgctgattcatattttttcttttgaaatacttcatatgcttaagagaaaaaaaaatggtgtttcagttatgaaccctttccttgtcattgatattctgaaaaatgaaagaactttcatgataactaaattagttgattactgccgaaatggcatgggtatatagtacgggcatgcttttgctttactttatcacccttatgtatcctatcttgttttacatgggggcaaaatttacaatgagaactgaattagttgattactgcttgaattcgagatgtttattacctatgtctagatttttatgaaatcatccaatcacatctcaataaagatttcggtaaaaatccccttctactgcttgaatttgtgatgtttattacctctgtatggaattttctgaaatattccaatcacatcccaataaagtaatatccttgtactagatgtcggtacaaatcattcttggcattgaattggatacacattataaagttgtattttgtatcaaatgggaagattagacatcttgtttgagtaaagtagttctattcattcacctagcactctcccttatctgtgcaactaattagataattctgatagatgaggagaaaaagatgttgcacacaaaggttgatctcattgtaactcttggtggtgatgggactgttttatgggtaagtaaattcaattctttgtctagagttctgcctcaaccactgtatcttttgatcgaatcagaccaactagaggattaacctttttttttttccaaaggtccatatatttagtcaataatcaatattgcttagtttaatggcatatgtggggtagaattggctgacagctgaaatggaaggtctgtcggtgcctgcagcataagttatcatgagaattgcttcttcacagttaggcagagttcttttctgattctgacctatcaaaatcaaaagttggaaggttctagtacaaattagctatcaaaaccaacttacctgatatttattgctttgttcttccatatttaggcgactgattattcctgcatttgaaactataattgcttctcaatttgtactagttactagtttttgtacattgctctgctgggctgacatttaaatacatggtgaatcaatctcttaacaggctgcgtctttgttcaaagggcaagttcctccggttgttgctttctccctaggatcactgggattcatgacacctttccgtatccttttattatggatgttgactgctttctcgatatcgttttgtgtagtgactggttcttactgttttgctatccaatctacatttttagtaagtttggatttggtctaaaagaaacctgcttgttagacgataaatctcacatgaagctccctgctctcctgttaacatttgtgttatccatgttgtcctccttaacatgcttttcagcaagtgagcaatatcgtgattgtctggacaatgtgctgaatggaccatttagcatcacattgagaaaccgtctacagtgccatgtaatccgtgatgcagcaaaggatgaacttgagactgaggagccaattttagtgttaaacgaagtcacaattgaccgtggaatatcatcttaccttacctacttggaatgctactgtgatagttctttcgttacatgtgtacaaggggatggactgatcatatcaacaacatctggaagcacggcatattcattggcagctggaggatccatggttcatccacaggtatgccctacatcgcatgatacatccttagcacttgagtatttactgattaattttattggattatcttcttgggcatttcctaatcacacccccttagatttctgcaataaatcgtgaagcttttttccccttggttctaaaattgtgtaatgtggttcagaagtttagataagttgcactgaacaccagaatctgatctgtttcacaaacataggctaccctgtactacctgtaattcttgtagcaaattagcaatgtctataaattaaccttttgaggcctagttacaatcatgaaatgttgctatttcctttgtccatctgctcaacataacttgtcgactctattttggtggtctcaaatgttgtgctggtatatgcaggtcccaggaatcctattcacgccgatctgcccgcattccctgtcattcaggcctttgatactgcctgaatatgtgaccctgcgcgaacaagtgccacataacagcaggggccaagcttgggcatcatttgatggcaaagatcggaagctgctgtcacccggggatgctctcatctgcagcatttttccatggcctgtgcccacggcttgcctggtggattcaacatccgatttcttacccagcatccccgagggtctccactggaacctgagtaagtcccagtcattcgacggcccgcgtgattgatcccagctcctggatacagtccagtgtcagagttgagagtttcagctggccatcagaagagtttcccacgagtccagctaacaccgagcggataaatgtacctagcagagtttgttgcttgttaccattccatatacatatacatatacatatacatatactagaaggctgctgcgtgtagatttggggtaagtactggggactgaagaatgaatcgaaatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgca

SEQ ID NO: 34911 - DNA, 6222 bp, Oryza sativa
aatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgcatggatggtgagagcaacaacgcatccctgatttgaacccgtgcgtgcacggtcggtctcggtcagtgatacagtgatacagcctcagttcccgtgcagtgtcgcgttccggcgagagttggattccgagtggccggcgaccccatccggcagccaccccagcggcggaggaacgtgagctcttttgttgctttctatctgtccaacctaccccccctcacgggccttgcccacgccacgcacgccaatccaaccagcgtcccatttccctcctcgtctccccccgcgtccacttctccactcccaccaccaccatgcaacgcagccgctggcactagatctcccacgaccacctcgcctcgccaccatatctgcagctccactcccctcctcctcgttactgctgaaatggcgacgcctatcgcgttactgctgttcgtgctggtggtggcggcggcggctgacagtacgatgccgatgccggtgaacgaggaggtgctggggctggtggtgttcaagtcggcgctgtcggacccctccggcgcgctggcgacgtggacggagtccgacgcgacgccgtgcgggtgggcgcacgtggagtgcgacccggcgacgtcgcgcgtgctccgcctcgcgctcgacgggctcggcctctccggccgcatgccgcgggggctcgaccgcctcgccgcgctccagtcgctctccgtcgcccgcaacaacctctccggcgagctccccccggggctctccctgctcgcctcgctccgctccatcgacctctcctacaacgccttctccggcccgctccccggcgacgtcccgctcctcgcctccctccgctacctagacctcaccgcaatgccttctccggcccgctgcccgccacgttccccgccaccgtcagctttctcatgctctccggcaaccagttctccggcccgctgccgcagggcctctccaagagctccttcctgctccacctcaacctgttcgggaaccagctctccggctcgcaggacttcgccggcgcgctctgaccgctctcgcgcatgggcgccctcgacctctaccacaaccagttctcaggcaccgtcacccccggcattgccaacctccacaacgtcaagaccatcgacctcagcggcaacaggttcttcggcgccgtcccgagcgacattggcatgtgccctcacctcagcaccgtcgacataagctccaacgcgttcgacggcaagctccctgactctatcgcccatctcggctcgctcgtatacttcgccgcgtccggcaaccgcttctccggggatgtccctgcttggcttgccgacttggcggcgcttcagcacctcgatttctccgacaatgcgctcaccggccgcttgccggactcgctcgggaagctcaaggacctcaggtacctgagcatgtcagagaaccagctctccggtgccatcccggacgccatgtccggctgcacgaagctcgccgagcttcacctgagggccaacaacctcagcggcagcatcccggatgcactgttcgacgtcgggctggagacgctcgacatgtcgtcgaacgcgctctcgggcgtcctgccgtcgggctcgacgaagctggcggagaccctgcaatggctcgacctctccgtcaaccagatcaccggcggcatcccggcggagatggcgctcttcatgaacctccgctacctcaacctgtcccgcaacgacctccgcacccagctgccgccggagctcggccttctccgcaacctcaccgtgctcgacctccgcagcagcggcttgtacgggacaatgccgagcgacctgtgcgaggccggcagcctcgccgtgctccagctcgacggcaactccctcgccggccccatccccgacaacatcggcaactgttcgtccctctacctactgtaagtcaacaaattgctaattacatttacaatatcgtcgttgcgttgaggttgaagacgaagacgacgaatcgcgtgacacgtttgatcgatgcatcgggtttgccatggcaggagcttggggcacaacagcttgacggggccgataccggtgggcatgtcggagctgaagaagctggagattctgaggctggagtacaacaacctgagcggcgagataccgcagcagctgggcgggatcgagagcctcctggcggtgaacgtctcgcacaaccgcctcgtaggccggctgccggcgtcgggcgtgttccagagcctcgacgcgagcgcgctggagggcaacctcggcatctgcagcccgctggtgacgcagccgtgcaggatgaacgtggccaagccgctcgtgctcgaccccaacgagtacccgcacggcggcgacggcgacaacaacctcgagaccagcggccgcggcccggcgtcgccgaggaaacggcggttcctgagcgtgtccgccatggtggccatctgcgcggcggtgttcatcatcctcggggtcatcgtcatcaccctgctcaacatgtcggcgcggcggagggccggcgacggcgggacgacgacgccggagaaggagctggagagcatcgtgtcaagctcgaccaagtccagcaagctcgccacgggcaagatggtgacgttcgggccgggcaacagcctccgttccgaggacttcgtgggcggcgccgacgcgctgctgagcaaggcgacggagatcggccgcggcgtgttcgggacggtgtaccgcgcgtccgtcggcgagggcagggtggtcgccatcaagaagctcgcgacggcgagcatcgtggagtcccgcgacgacttcgaccgcgaggtccgcatcctggggaaggcgaggcaccccaacctactccccctcaagggctactactggacgccgcagctccagctcctcatcaccgactacgcgccgcacggcagcctggaggcgcggctccacggcaacggcgacggcgcgttcccgccgctgacatgggcggagcggttccgcatcgtggccggcacggcgagggggctcgcgcacctgcaccagtcgttccggccgccgatgatccactacaacgtgaagccgagcaacatcctgctcgacgagcagtgcaacccgatggtcggcgacttcgggctggcgcggctgctgccgaagctggacaagcacgtgatgagcagccggttccagggcgggatggggtacgtggcgccggagctggcgtgccagagcctccggatcaacgagaagtgcgatatctacggcttcggcgtgctcatcctggagctcgtcacggggcggagggccgtcgagtacggcgacgacgacgtggtcatcctcatcgaccaggtccgcgtcctcctcgaccacggcggcggcagcaacgtgctggagtgcgtcgacccgagcatcggcgagttcccggaggaggaggtgctgccggtgctcaagctcgggatggtgtgcacgtcgcagatcccatccaaccgcccgtccatggccgaggtcgtccagatcctgcaggtcatcaaggcccccgtcgctgcatcgtcagccagaatcgaagctttctgaattctgatcgatctgacgacgccacatcattactcctactaaaccacagggttaatgattccaaatcatcgaatcgatcacttgcattgcattgcatgcatgcatccgcaagtactacgtgttccctagtgcaaaaattgaaaggtctgagcagtaggcagtaatagtagtacgtacaactgttcctgccgtgctaattttctcagggtctttttttgtctctgcttttggatgtcagataaatctcattattattacgtggtgccttgttcgatctacacttctacagttctactactactctgctactgcaagtacgtgacccattactgctgcatcgtttctaaccgttcttaatactgccattggaccattggtgcccagctctggatggattctgtacatgcaacgcatggaaatatgctcacttgtgactgggctgagttgtaacaaagttggcgtgttgcattgcgcccccactacttacatatggacacggttccatctgggagttaatttgtttgtgccatactgccatagttgtcacattagcttagcctgtggttgacgagatgcccatgacttggagctgcatgaggcatgtgagtgcacagctaaagtgtgagtgaactcgggggtccactgcacaaaaaagcatgagaaattgagaagttttgtggataaataaattaatcctctcgcgcacacatgagccctggatatggtcttggaaagaaaataatggaggttgatttggcaccattgataggattggatcttggcattggacagatgttcattgctgcatgcgtacgttttccctttggtgcaggacattgggtgctacgtgacaaactgaccgagtactgtggtagctatcgctctttgctggtgtcatattatatatatgtttctgctaaatctggattaactaatcgattaatcaacttggtttcaagtttaactaacacatggaataaaaatgtcacatcaatgcgttgtataaggccgtgcaggtcattctcatcttaccaatgaactgcgagtctgcgaccccgtgagtgcacagtttttgtaagctgcaaccaatttggtactactatactactattcctacatgtcaaaatgtgattttgcttgtaacataaattttacaatttgggggcacacagttcagatttccgcctttcacctttttttttttgacctgtcagtttactcttttgacgtgtcagttgggtagtttactggtggccccgtacctggaaagattatttggaatgtgaccctacccagctgcactgcttgtacaggatggtcacgtccaatgggggtcggagattaaactccgaacccctttgcctcagctgattatttcccatccctttacggtttggtagctgaaatgctgaatgatgtatgcgccgttgtgttgaaccctttcctaattacaaactgtatcctatacgtagtgtacaacatatgaacagaaagtcagaaactagcgttgtagactacttatatgctagtgcatagatattgtcagtgaatggtgataaatcaagtctagggccatctcaattagcaccttaatttgctgaatcgctgtgaacaaaacaaactgatgcccggttgccaggtaatattgatgatgatctctcagtatgttctgctactatggagtataccacacgttctaatgttttttcatagcccagatctgtacaaagagactttgcagcaataattgatgaaagtcgacaaatacgaagcaacacagagacagaggcatctgcaagtcttgaagctatacacaaactgatgaattcctacgcataaaaacacgtccttactggcaaaaactgttggtttctgaagcacgagaacgacaggagaaatggaagagaggatgactgcatttctcggtaccactgccgtaagagtgaattcaaatgaagaacaaaacatggatcacttaacaagaattctcactgaaatgcagacaagagagtaatcccatatcgaagtgccactagcagtaacacttaacgaggcggttttgtctgatcttggactgtcttgttgttccttgtccatatgctgtaggcttttcattcttttcggggtgagagtgatgtgtccaggagtagagccttagtttaaccaaccgcatcttccagataaattaccaactcttgtttgattttttttttgagggcctgatttgaatttcgaactcgaattgccttctccattctcctagccatcaggtctctctctttttgataaataatgctgtagcagaaatggactgaccagccaactgggttcatggtttgtttgaa

SEQ ID NO: 34912 - DNA, 2799 bp, Oryza sativa
  unsure (1)..(2799): unsure at all n locations
gctcggtacccttgcttggggctgtttctgtttgataccaaataaccaaaacttgccctaccaaatatttgccaatttaaaatagtatctgctagatgtttgaattggtgtcaaattttgccaaaactaacacaactgatgcaaccaaactctatatgaaaacttgttcagtaggttgggcattgaaccaaataacggccctttgctttcaacatggcacataatttgcttccggcccatatgaatgttggcagcccacatatatatgggtcgtcctacaacagtgcgaggcccatcaaatcatgccctccctacaacaccgcgcgccacgacgcccactgcaccgggtcagcccattgacgcgacgcggaatcggagcgaagaaattcagaatccacgggccgcggtcgtcacggcaacatccaacgggaagtgcgcgtcacgtnccaccggggcacgcacgcacttcgncgncgncaccaccaccaagggtctaggctccaacccaggcaggcgccgcccaccttgacgaggaatcacaagaatccctcggccgaatcccgtggattccaagtttccaaccattcggcgggcggccgcaccaccattccacccgtccacctcgttgccttcgccctctgtctcccggtcttcgcttcccctcgcatccgcgtctccaaaaacccccaactttgcactgcaccgaccgcgccgagaggagagacgagagcccccgagaccgcgcgccgccatggccttccactacgcagcaatgccctcctcctcctcctcgtccctttcgggcgtctccccccagcccccgcttcacctcccccgtctccgatcccctcaccaagcgtcccgccgcctctccgcgctccccttctcccgcgcgctcccgcttcccctccgcctccgcctccgcattccccgtccccaacttcctccgctgcccctcgcgttctcccacggtgggggcggagataacgatggcgacgataataataacaatggcggcggagatggcgagggggatggcggcgcgcccgacaaccggagggaggcgctgttcgtgctcgcgcaactggggaggaagctcgagagcctgccgtccgacctcgcggccgccgtggagggtggccgcgtcacgggggagatcgtgcggcgcttcgctgagatggagggctcggcgctgctccggtggctgctccagttccaggggttcagggagcgcctcctggcggacgatctcttcctcgctaagcttgccatggagtgcggcgtcggcgtcatcgcaaaggtcccatgacgaattctccctctacgtacttctattttggcatcattgcactgtgttatgttgccaatctgacgttttattcatgctgctctcgttgtttagactgctgcggagtatgagaagagaagggagaattttgtcaaagagattgatatcgtgattgccgatgtggtatgcttctgaaagtatttctaacaatttctgacaataaaacaaaagaatctagctcgatgtgatttcacttgtttggtttacattgggtgttactagaacaaccacttatttagcaaataattaccatgtggtataccgcttcatgttcagatgactagtactctaataacatatacatcatggaatttatttattgacctcgctttgtaaattagtcgctaagatcgttagctgatagacctttttttaaaaaaaaaaataatcatatgctgagtattatgttatcaggaactaataaagctggtgatctaaaccaaatagacttgaaaaaaaaatcttataatgtggtgatgtttggttttggaactatttctgaataatactaatagatactatgtggttgattaactgaattcagcattgaggtttgtactattaagtccatgtgagtaccacacctgattctagttgctattgaccatgagcgaacctatttttgctagcctaattttagtttaggaagagagtttatctcatgccatgggttcaattttactttctttctgaaggtaaatggataatgaaatttgaagttttttttttgttatgatttgtgaaatctaattttgtgttgcttctgatactacccatacaggtcatggcaatagttgctgatttcatgcttgtctatcttcctgctccaactgtatctctgcaaccaccacttgcaacaaatgctgggcatattgctaattttttccacaattgcccggataatgctttccaagtaacctaaactttctctcttttcatctgagtagaacattcttcctagaatcctccatgttttgctaaaaacacttcatgccaactgttctccagattgctttggctggaagatcatactcaattctgcagaggctaggggctattctggtatgcagttcttttgttgtggttattatgatacttagaccgtcggactcatagtggcctcagtctattcagtgtgctatattgatcaactaatgctagtggcttctttgcagagaaatggtgcaaagcttttcactgtgggaactagtgcttctctggtaagcttgccattttggtttgctgctacatcatatgattgtgatgatcatgtgttagcaacctcttttgatttgtgttagggtttgcatttgtttttattttctttgagcaggaatcctgtcatgaagttttaatcctgtcatgaagttttaaataaaacatttcagcaaggcaggaataaccaatgcgtcctggtgttttcattatgtctacctatctctgtcgttaag

SEQ ID NO: 34913 - DNA, 4859 bp, Oryza sativa
  unsure (1)..(4859): unsure at all n locations
ctctgtcgttaagttttaattctagtgagtctgacaaagtatatgttgcacaaaagactggcagagtactgaggctgagatctaacctttttaaagaacagggtaactgttaactcatgtggatttctttcacagttaactgattttctgtagctcctagttggttctaaactgaaatttgaagcatgaaaactttacaagtgggatatattgaggaaaaaatggcattcataatcggtttcctagggtggctagttcaattgtttcactatgcaggtgttgttgccaaaaataaaaaagatcagtgatatacgtttctgttttggatggcagtaatctatcgacaccttttacccttctatccataagacaatttgttatgcatactaatcttcaatccttccagattggcaccggtgtcacgaatgcactgataaaagcaaggaaggctgttgacaaagagctagatgacgaagttgaagatattccagttttgtcaactagtgttgcttatggtgtatacatggcagtatctagtaacctcaggtaaacattatcttcaaactactcaccatttgtagcatacttaagtcatgctaaacgtgtgaataaatgtcctgtcgttttgttactaagggacctggaggacttaccccaccgttgaaattgttttacctgtttctctcttcaaacaggcaaaccgttgtagagattatacatgaacaatccttgtgcagataaacagttgcttcttttttaaatggattattttttacaacaaaaatcatattcatcaccaggtaccagattttggctggtgtaatcgaacagaggatgctggagcccctactacataaccacaagcttctattgagtgctctatgctttgctgttcgcacgggcaacacattcttgggttctttactgtgagtaatatttacctcgcatgaagtttaactcctgaccttggggcagtaatgttacttactgatgaacttttgttaccagatgggttgactatgccaggtgggtaggcgtacaaaaggttcaagaagaggcctaatgttggcataccgtaagttactacgatatgtattctacaacgtcacgacattcttctcttcatagggaacatctttactggtaaaggcagaagataggcatctccatatgtcgaattcatatcaacagtgtcaccgtatttttcttcatagcctgcaacttgtaagacttgtctttgtaatatacgagtttttgacccaacgagcactcggagggacctgtttattggttgtctttgttctaggattgtcgtgccttttattttcacttatggggactgttgacagcactctgccggagtttactcatgtaatgttgataaaggactgtcagtctgtcaccatagcattcgtctgaagaaaaacactcttcccgtttcactttgcctaattcgcatctttcgtatggttcgattgattctgaaaattatgcaggatcacacacaagatgaggggtttagcacaagtgtcgtctcaaagatacctttctcctatattgctatttgggccttacacacatcataggctgggccgagggagatagcaagatagcccattaacagcagcaaataaaccctaataaaccatgacagcctctcgatctcctcgtatttccccaaacccttgccgccacgatccagacgtccatcgttcccgccgctggtgcagcagccaattgcgatgtcgtcgtggccgccgccgccgccggtgcaactcagcatgcagttcctccctccccggccggagccggccgccgccgcgcgcacgtncatctgctgcacctgcggcgtccccatggcgcccaacgcggccaacacgtgcgccctctgcatccgctcgcgcgtcgacatcgcggcgggggtgccgcgccacgccgacgtggtgcactggccgtcctgctcctcctacctccacccgccgcggttctggctccgcgccgcgccggagtcgccggagctcatgagcctcctcctccgccgcgtcgaccgccacatcgcccgcctaggcgtcgccctcgccgccgcggagttcgtcttcaccgagccccactcgaggcgcctcatgctccgcctccgcctccggggcgaggtcctccacggcagcggcggcggcgtcacgctggagcagggccacgtcgtggagttcggcgtccacgaccgcctctgcgacgcgtgcgccatggcgagagcgcgggccgccgagccccccgaccagtgcggctggtccgccgtcgtgcaggtgcgacagcgcgcgtcgcaccgccgcacgctgctccacctcgagcagcaggtcgtcgcccacggcgccgccggcgacgccctccgcgtcggcgcggcggcggtggcgggctcgacttcttcttcgcgtcgcgctcccacgccgcccgcctcgtcgacctcgtcacctcgctgtcgcccgcccgcgtcgtcgcgtccaaacagctcgtctcgcacgacacgagtagggccggccctaggggggtcaggccgtgcggccgcccgaggcccccaaaatctagggccccccttatatacacatataatatatatactacgtactatataattttagtctatggctatggatctatattaagtttgacagctaaatagcccaatatagaaaatgaattttagtccatcgtcacgcctatttcagcgaagccgaagcgatcttcatttgactcccgttgcttcgcctcgatcacatcacgccacttgcgtcgtgccgcctcaatcacgtcacgtcgctcgctgctcctgcactctcggcgacttctcgacttctcggcgtctcgcaaacggaaacaagtcggcaaatcgtggctcgccagtagccacgctcgtgtcgatcatccgccgatcgccttctcttctcactactgctatttatttctctttgaagttttaaaatgttatatatatagataattttatcacatcgaatattaaatgttgtatgactatataaatatatatattagtttatgtgtatatatataggggcctccatataagtttttgccctggggcccaaaaacctaggaccggccctggacacaaggcacacctttgccgtggagctttgccggtgtgccgcgacgacctcgtcttccttcccaaggaggcgtcccgcgacctcggcggcctcggccccatcgtcctctgcgtcaaggtcaccaacgcgctcgcgctgctcgacacctccacgctccgcgtcgtccacctcggcatcaaggagtacgacaggtgcaggctcgagcccgcgctcaccagccggcagctcgtcgagtacgtcgttctcgacgtcgaccacgagccggagccggccgccggcgtcgcgtacgcgcaggtcgcgcgcgcgtcggacttgggcaagaacgacaccatcttcaccgtgaggacgcacctcggccacgtcctgaacgccggccaccgtgcactcggggacgacctctacggcgccaacgtgaacaaccatgacgtcgagagccatggcttgccggatgcagtgcttgtcaagaagatcaatgagaagggtagtactcgtaggcagctgcaggatggcgacggctgcaggagaaggaagcgagacggcgatgagatggaagagatcgccatggggatcgggtgcattgatctgaacccgcctgatgagaaggagcttgatgagttgctcagaggacctcacaatttgagggcatctgcagtcacttcaccgtgcctttgtcaggcccacatgtccccacatgtcagtgacaatggcacgatgaagtcgactacggaggatctcaatccaatttgaggctactgctgctacatatagttgcgtttattttctactaggaattggaaggtcctttttcctttgtgaacgactattaactttcagatataatgttactgaattggcaagctataagtgcaaagagagattcagacgagtgaatgtgcagtgaaattgctagaatgaatgcattgttagcagattgccacaaatgttttgcaagatgtcgcagggttatattggttgattaatttaagaaaattttattccctaataaggaaatatggacaactgatgaagctaaaaatgataaatcaactaccaaaaagatatgatgggtccgatatatgaagattatccttatatgcattcatggtgagaatgtgtttgattttaaatggatatccttatatgcattcattgtgttgtgtttgattttaaatggatatgaagcatttttaaagtaggcaaactttgataatccacttacagcaaaatctgatgggtccgatatatcaagattatccttatatacactcacggtgaggacgcatccgatttaagatgtgcaaccagaattaattcatttgttaatgcactcccactacatataaacgtcatgttagcattcacactattttcactcctagctagttggatttcccgcgcaattttacatggctatgtaatttgaacagaattatgtttgctatagtttacatacaactttaccactcaatcttcatctttataaattataacctatatacctaagatgatcaaattgtgctattatttttctttttattcaatataaacatggtaatatcttaggcacttggagtaaaacatggttccatttaactctattttaataatataaccaataaatagatggacactcatatattttaacgttggatttactctgagacacatcatatataagtttttggggttggaatagaaggggagtagtgatgtatttaagagagaaatagtgacttatat

SEQ ID NO: 34914 - DNA, 3446 bp, Oryza sativa
  unsure (1)..(3446): unsure at all n locations
cggtagttttcaagttttcactacatatgcggtttgcactgtatatttttccgccttatatagtggtgtagagagaaaaccttatagaaactagaaaaacaacaagtgtgatgatatagcatgacaacacataagaaaggtgtaatgaaagaggatgagagggtgacggcagctctttggcaatgcaagcagcaccatgtgcaggtatatataaaatggtgcggggcagatccaagaaaggataaaaggaggggctaaacaaactatacaaaactatagcacccctcttctaatggatatataataagaagtggaggctcctatggttacaacgccggcaatgggggtttaaggggtcaccctaatgggcgactagtcgcgtggaggcacagacgcgcgacgagcgctcagtctactagtactactgactactcttctactacagtactactagtcttactagtttactactacagtactactactagtagcactaatactacactactattactactactgttatactattaatagtattactactataaaatatatatatttttatatgtactatatatttttttatgtataaaaaaatatacacatatacaaaatttgtatacggcgtgtacaaactttgtatatgtacatattaaaaaatgaaaaaacaaaaaaaaacatcatgtatattcgtatacaagtatacaaactttgtatacgatatatataaagtttgtatacacatatacaaactttctatacacgtatacaaacattttatacgtatccgcatatgcttaaaaaaccgaaaagaaaaaaacagaaagaaaaaaccggaagaaaaaaaaacaaaagaaaaaccgcaaaataaggaaaagaaaaaaccaacggaaaaaaccagcgggccccaccgtacagacgcggctacgtgctgccacgcagccccctccgcgcgcgccacttgcctcgccgcgcgggggcgcgcgcgcggatgattgccttttagcccttttggggtttgagaccccgtatatctcatggtggatccgccactccgtaagcatgttgtgggtgctgaatggtgagattggagaaggggattaatagcagctagggtttaattcttcttcttttttttagaaaactagcgtttaatttggaggagcagtgagtgaaggttgatgggccagagatttttctgttttttttcctcaagataatatgggcctggcccatttactaaggttggtggctagggtttcgaggaaaagatggtgtagtgaaagaggacgtccgtctgatgttgatccaacggctgcaaattagagtgggtgatcactgaacatgccagttataaccaagacaaacctctttaaatttcagcgacgcgctcaaacactcacctgcgccgcaacagtttcagacacgatctcgatcgtgtctgccatggcggcggcggcggcgcctgactggtccatgctcccctccgaccccatcgtccgcatcggcgactgcctcctcgccgccgacgacttcgactgctacgacaacctgcgcctcgtctgccgcatgtggcgctccggcaccgacgacccgaggacggccgacttcgaggacgcccgcttcctccccaagaagctggccatgctcgagctcgacgtcaaccccggagaccaccgcgccgccgncgtcgccacgttcgtcaacctcgacaccggccgcttcctccgcaagcgcgtcccgggcctccgcggctgcttcctcgtcgccgtcacgtccgccgccctcgtcgtgctctccgacgcggcgccgccacacgggacccgcggggaagggtcgccgtttcagggcgcccatccatgcggangangaggtgagggangttgccctgaagacgttcgcgctcatggtgttcgtctcgtggtaccaagggaggtccgtgaggtgggttgatcaggacaccgagggcttccccgatgtaatggtctatttccccgacaatttcatgaacctgacgcccttcgccgccgaggtgtacgtcaccaaccgtggatccatcgtatccaccgtcctcctcaccgncgncgacgaggaagaagaagaagaagaaggtgagcagcaacaaggtgttcgtccgcaaccccgcgccgcggacaccatcgcgatgatccccatcattcgtatgccaccaccagcggtgaagctgtacgcctacttccaccacctcgtggagtctgccgccgagctgctgctcgtgagcgtgctgtggcgcgtgcacatgaccgcacaaggtggacaccgtgaacaaggtgttcgtcccggtccggagcctcggcaaccgctccctcttcgtcagccaggccaggagcttctccgtcgacgccgacaagttccccaccgtggaggccggatgcgtctacatcgtggagccgggcccggcgacgtacgagcgtttccatctcgccgacgggaggctggaggaggccataccaatggtgaacaggcgccgtgccgctgaaggagaaagctgcgtccttcctctcaccctggagcaagtcatggtgaactactgcgtcgacacggagaattattccgagctcgagatcgcgctcgacaccgatgatgacgaagagttcttcctgcctgaagctgaaggccacggaaccaactgatcgatccagatgctggtgatcaaaatatatgggtgaaaattaagagggcttacgatataattttcagctccaactatatatcctgatgatatatgatcctctctgtagctagtctctacatttcatgtaattttcttcaattgtattccttctctgttcgatgacatcgatactgtgcgatctcgccttgtttgcttttgcatccagaaaaacatgtcattcgcttaatccgtactatttaattatttttttagcttcgctgtgccttggtcaaattaatgttacaaaaaagaagttctggtatggtgtattggtgttaccatgactttgcacttcaattgcttatgtagtaatgtaaatctcgtgatctagcgaagctccatgagcatgcaagatgtactacatccgtccctagatataagggatttttgttgaatgtgacatatcctagtacaacgaatttagacaagctttctgtccaaatttgttgtactaggatgtatcatatccaaccaaaatcccttatatttagggacggagtgggagtagcttaattgggtgaagtaagcagcagtcaggccgaagcgcggctaagcctgccaatggggcaagatccaccccatatccaatccactagccatcccataaaatccaaaccagaccaatccattttcctcgtcagtccaaaccgaaccaacccattccaattttatggtctcaattcactttcaaaaccatttaaacccacttcaaatccactttgtcgatcct

SEQ ID NO: 34915 - DNA, 17431 bp, Oryza sativa
  unsure (1)..(17431): unsure at all n locations
nnnnnnnnnnnnnnnnnnnnnnnnnnnnnnnnnnnnnnnnttatttttcataccatctaaatacttataaactttaatatatgatatatcaatctataaatatgtgccttcaaatttgatcatcataaattatagaaaaacaaaaagtaattaaactctaactcacatatatttgctaatagttattttcttaatactgtaaaagtcatatttaaatttgcatattttgtgaagtgacacataaaatattaatctatctttttttaggaaaaaatattaatctatcttgctattttatttttaaacttttaataaactagtatatatataagaaacgagaaataccttcctgatagattataagagtttcccgtttcatgatcactctcttatctcttagtccatctaaaactctaaatatatattccttccgtcctaaaatataagaaatctataattgaaagtgacatttcgtcaagctcaagctcaggacgaaggccttcttctcccgtgagaacactatcctccctccggtcccatggccactcccggtcatcggcagcatgcactgactgctcggctcgctgccgcaccacgccctgcctgcgccgtcgagttgctcagcccaaggcgcgcccgctccttccgccgcgtccgcgaggccgagccggcgaggctcgtgcgcgccgtcgccgcgtccccggcgtggccgctcgtgaacgtcgtcgccggcgagcatgtcgcggccatgatgaccgccgtcggcgcgcggccggtgcccccggcaggaggagtacctggaggagctgggcaaggtggcgaagctcgccgccggcttcaacctggtcgacctgttcccggagtcgcggctcgtgcgggcagcgcaagcggcccacgggaagatccacagcatcatggacgccatggtccaggaccatctgaaggcgatggaggagcgcagagaggaagtcgcagatggcgtcgtcgacgacggcgacggcgacggcgccgatagggatgaagagctccttagcatcctactgaggtttcagagggatggtgggttagggatcactctcacaaacggaaaccatcagcgcgacagtgtttgtaattaattaagcatgttaccatctcactctagctcatttgtcaatgtcacccgcgaaaggtttgtctcactctttttgtattttgcgggaacgtcctttttttcatgctagttaaatagttataaaaaaaagcaaagatagtttgatatttgatatatcacctcacaagtatatatacaaattcaaatttgacttcttaatgttgtaacaaaataatgtaatatgatttaatagtaccagataataacttctagctagtctagttttgtaaagtcctgtgtagataccatctcatatctataattttagggtatcttggctggcggctctgatacaacaactacaactgttatgtgggctatgtccgagctattgaggtgccctcgcgcaatgcaaggtagaaacaaggtggatgaggcatacatattggagggtcccttcaatattacatgcaattggtcatcaaagaaacgttaagattgcaccttccattccctttgcttttcccaaggttatgtaccgaaacatgcaagataatgggatttgatgtacccaaaggaacgatagtcattgtaaataattgggcgattagtagggatgagcgatgctgggaagatgcggaggatttttgacctgagaggtttgaacatgacgataccgattataatggtacatattttcagtttctttcaggtggttttggtcgaaggatgttcccagatttcatatttgcacaatttaacatcgagattgcactcgcaaaccttctataccatttcgattgggaattgccatgtagtgaaaaccgaatggagttggatatgactgagtccgctgggttgacagcttctcggcttactgatctttttggctaaaggcaactcccatcgttgccacagcctggattgttggatttcttgatatttctactaggagctagctagctctacttgtgttttaagaaagaactttaattagcacttggtattttgtaacccgttataataagtcatacattgtgttttttcgactgttatttttctggccatgcatgcatgcatggctacgactagaaatatcgaccactcttgctagtagccacgattatgtgccacagccacagaaactaggcatgcggctgcagcaactgctgcaaaaaatcgcagtcgaacaatgtcattatcatgtggatgtactatagaaaggtatcatcttttttgagggaaaataaagaggcgtcatcatccgtaacattatgactataggacccatttagttatgcatcaccatcatcattttcaataagtgcatagagatgagttgtataacacacgttaaaccagtgtaaatcaatcatataggtacatagtgtgttagctccggccgtggccattttgacatgcagttttatcttttactgaaccttttgtagttttgtcagcagttggatgtgcatgcatataagtgattgcatgggtcgtagctaatgggtgctacaacatgagtctactccagggtttatattttcgttttcactatttctatcggtccgaaatagttttatttttttaacaaaatttgatcaaatttgatgaacaaatttttttcaaagtctaaaaatttgaaaaccccaaaaaaacatttggccgaaatcatttcttatcgcagggtccgataaacccaaaattttggaaaactcaattcaaaattttgaacccttgtctagagtctagaccatgatctagaaatcaaacgcatgcagtgctagaaatcaaacgcaacaaacgcaagaatatatttaaatttggcggttgtttttttttaccgccaaagaaattagttggcaaaaaaaaatacggattcttgtagtagctagcactactacgaaaaggagtttttcgtgcggtcaaaaagggtttagcgtgcgggggggggaggggggtgtgaacttcacgcacccaggtgtttgcaaaaattgctatttttgtgtgcgggtggcgcacccgaatgcgaaaactgattttcgcgtgcagggtggttaggtcgcccgcacgcaaaaataaaatccaaaaaaaacaaaacctaaccctaaagctgtcgtcgtcgccatcacctcctcgcggtcaccgtcgtcctcgccacgcctcctccccaccgcccgcaggccgctgccagcgctgcgccggccgccaccgccgctggatccacgcggatctgggcgggggatggccgtcgccgccggatccgagcgggggccgatcgccgttgcccctcgccaccttccgcatgcgcccgccgacgcgagcacgccgaccgccgcctcttgcctcgctcgccgccacgcccgagcggccgttgagccgctcaccgccagtcccggcgccacctcgtcggtgtcgccaccgagccgcggagaggagaggagagaaagggacagagaggagaggagagagagatgagtggaaataaaagggagagaggtgaaaaatttaaagtgaatgagagggaaaagaggtagaggtatttttgcgtgcggacctctgcgaaaataatcttattttcacatgcggtccatttaagaggattgcacgcaaaaatcgatttttccgtgcggttctattaaagagccgcacacaaaatggatgacgattttcgtagacgtgacctgttatggtctatctgcaatctaaaaaggttcatgtacacaggaaaatcgtttttgtactattgtagatatcattatatattgctccatcccttatcttggattgatccataccaacaataattgtcgtagcctgtcggatgaatccatacttgaaagagaaacatagatactatgtgcagaaaatgatatgtcaactattgcatagtaattgtattattgtaagcacaagttaggtcgattaacgcaataatggacccaaatcactgataattaagaacgaacgtgcttttgtgcttgatactgtgagtcagtgaccctaacatgcatgtacactgttgtttgttgagagcaagacaaacacgtctggattaaactagtagcaaagcaagtatcacgaggaccatatagaattataaatcgtacgacatagctatcaaactttctgtaaaaaaaaaaagaagaagacattgctccgaaattatttttcaccgggggaaaattcagagtactagctagtacgtgtatatagatcgatatatatctatagccactgcaacttccaactatatatatatgcagcacagatcgagctcacaaacaataaagatgataaaaatggccggaatagtggatacagcagcattctgcaccttgctgtgcctactcctcaccctcgtggtcttcaagctcaagacggcgacctcttcccggcacaacgccggcgtgaacctccctccggggccatgggcgctgccggtcatcgggagtatccactgcctgctcggctccctgccgcaccacgccatgcgggagctctcccggcggtacggccccgtcatgctcctccgcctcggccatgtccggacgctggtgctgtcctccccggaggcggcgagggaggtgatgaagacccacgacgccgcgttcgccacccgggcggtcaccccgacggcgagcatcctcacctacggcgcccgcgacatcgtcttcgcgccgttcagcaagcacctccgggagctccgcaagctgtgcacgctggagctgctcagccccaggcgcgtccgctccttccgccatgtccgggacgaagaggcggcgaggctcgctcggtcggtggcaacggcggcgccgcccgtcgtcaacgtcagcgagctggttaagatcatggcgaacaacatcatcatgacggcaatcatcggcgacacgtgcccgcagcgggatgagtatctcgaggctctagacaagaccatggatctcatgaatggattcaacctgatcgatctgttccccggatcgcggctggcgagggtgctcggtgcccgatccctgcgtgcaacgaagcgggtgcatcagaagctccatcaaatcacggatacgataatccaaggacatgaaatcatcaaggacggcagcgttggtgatgacaccatacaagaaacagtaggaacacacaatatgcatgggcatggccataagtgtgaggacatccttgacgtcctgctgcgatttcatagggacggtgggcttgggatcaccctcactaaagaaattgtcagcgccgtgttgtttgtaagtactccctctgttccaaaatataagcattatagcataataacgagtcaaatatttttaactttgaccattaatagaaaaaaataaaaaagatcaatcacgtaaaattaatgttactagatttatcattaaagaaactatcatatatgtaattttttttatttaaaatatcttattttatagatattgttagtcaaattagtatctcggagaccgtgtcagagtccataaatccttatattttgggacggagggagtactcaaattcaaacttatgctcaacctccattcctacaattacttgtgtcgtgctatgtggtaatggatcatatacgtaatatctctaggagaatatggttgtagtcccactggctaagaatatttgattatttgattgatgtttagtacaagatttagtcgtcaaatacttttcactagagggagtatgcatcataattacaaagtttatggagtattttttttaagaaagtgtaaatttgaatttatcaggatcttttcgctgctggctcagagactacatctacaacaataatttgggccatgtccgaactcgtaaggactccccatgtgatggagcgagcacaatctgagattcgtcaagtccttcaaggtaaaaccgtggttagtgaagccgacatcgaaggccgactccattatctacaactggttataagagagactcttaggttgcatcctccggtaccatttctcataccgaggttatgctctgaagcaaatagtaagatcatgagatataatatacctcagggtgctatggtgttagtgaacatatcagcgattggcagagatgagaagatttggaaaaacgcaaatgagtttaggcccgaaagatttaaagatgatatggttgattttagtggtaccgactttagatttattcctggcggtgctggacgaagaatgtgcccaggtttaacgtttggactatccaatattgagatagctctcgcgagccttctttaccactttgattggaaattgcccaatgacgcaagctcatgtaagctagatatgagagaaacgcatggagtcacagcacgtcgtcgaactgagcttttactcaaagctactcctttgtacacataattggattggtccataaaaaattcatgtacgctgtgaagacgaagaattggtctcttaataaaccattgccaattaatgtttgcctaaatttgtttctatcagaactgaaggataattcatgtacatccgttgttttgccaaccccttgtcacaagtcgatctgaaatctagactctattttgaatgatgagccaagcatgaaatttgcatttccccggtgcccagactttctagattaaggagttgaaacttgtgctcggtgttctttgacattgcgcatggtaggccaaggaagtcgtgtagagtccgctacttgcgaatttccgggtaatctggtctggctctccgatgcctaagtgaacattccggaccgcttcccacaggacaaccagttgttcgacgaggtctagtgtaataggcgagtgtgattccagagccaggtcctgaacctagacgtcctcctcctttccatttcgtagagacctccctctgtttttagagatcgcatagatcagcggtataagttttttgggtcttacttgtacttgtacactaagttaaaaaaactcacttgagacgatataagtttaaaaatttactccttttaattatttaatattagatcattctttaatattcacgtgtttttaaattctttaatattcacgtgtttttaagtactctcttcatacacaattaatcatcatatttggttccgtggccgcagtgacggttcggttcctgtgcatgccgcgcacatgacgaacgaaagttgagaggggatttagctaatcttgccctaatcacatggcattaaatccatgcggtaaaaaagatgccggcgatttaactgatttcgggaaaatctcaaagggctaaacggtatgtgttttgtaaaaatttctatagagaatttgctttaaaaaatatttatttattaagtttgaaatagttagagctcagttaatcatgcaataatagctttaaaacgagagaaatcttgcttctttctttcagcaacaaacgcagccaaacatggataagaacgaatgaacgtccttttttttgaaacaatatggcaggctttattcattcaatataattacatcgttcagtactagagaatcaaggattgggctcatcatcccaagtactctctccatatcttacttttgtcaccaaaattaaggagaaattaaataatcttacatgttacaaaatcattgactgaaagcaagcatgcaaccaatgagtatttagatgacttcttgggttctaatcaaacatttaatttatctcttcatttaagtcttgaatgcataaagactacaaatagaaataatttatttaaaaaaactcaaatgtgaaatatgtctaatttttgtggatgaagggagtacaattttgctttgactgcatcgctctccttgctaaattatgtgctgcttggttcgcctccctattgcaatgctcaattgttatatcttgaaaaccgctccaaattgtagagcaatcatcatataaggccgctgctaaatttgtcgtgaaacctccatccttcattgtctatacgacctccatacagtcttattggataattagtcgattacaccctatgtgttgtgcaagcatcaacccttctttcaaagcataggcatccgccatcggtgcatcaactaagtacggcacatagctgtgggaagcagctaggaatccaccagtgttgtcccttgtaatcgttcacacgctgccgcaccccctgtcctcatcaaaagctgcatcaacattgaccatcactttcccctctggaggcttcatccatccttgccttatctgcgagcttttcttcattgttgctttatatatagttctttgttagtgccacaatagacatagctgatcttgaaggtcgctggatgatctccccgtgtacatgttgccggcgttgccaccaattataccatccggcagtaagtactaattcaaccaatcccacgtctagtgcgtcaacctgctcttctcttcttatgagatgtcttcgatgattactgagcctgaccgatcggtggcaagaaagcgttgtaatttctcctagatgccaagtgatctccagacttctcttgcacggtgacacgtggaaaatatatgtttgatatatatcctctcctccattcagacaaaagggggccgtgtttagtttccccaaaattctcaactttccatcacatcacatcacatcaaaaactttcctacacacataaactatcaacattttctccaaactactaattttctcctaacttcctaacttttccaccatgcatcctcccgattctccgatatatctattctctagggtagctcggcaaggtataaaccccttcaacgctggcgcgccatccaaaaattttaattttccccagcaacacttcaatctccacaaattcttccacagctaattccgtgaagcagtactagcttgcacttgggccctatttagatcccacataaaaattttacgccctatcacatcgaacgtttgaacacctacataaaatattaaatataggctaaaaaaataactaattgcacatgttgcgactaatttgcgagacgaatcttttgagcctaattacgccatgatttgacaatgtggtgctacaataaatatttgctaatgacggattaattaggcctaatagattcgtctcgcggtttattgacggattctgtaattagtttttttattagtgtccgaacaccccatgcgacaccctatataataaccgatgtgacacgctaaattttacacccctgaatctaaacagcccatcttgctgttctactgacaatgataggcagaccgcagaccgaacgtcctttgatcgatacagtgaaactagtaacgcatgcactgttgtttgttgagacggacacgccatctgaattaaagtactatagctacgccaggagcaaattaacaaagtatcatcatgactatataaaattatagacccttaattatgtttttaaggtaagacgtcaccactactaatactctctctacccctaaatatttgacgctgttgaagtatatttaacaataaatcaaatgataagaaaaaaattaataattacttaaattttttaataagataaacggtcaaacatgtttaaaaaagtcaacggcgtcaaatattcaaagacgcggggactattagtagtggtgatgtgcattatcacatcacctctacaactaacatcgggtctcgcaatttataatatcacactatatttcaataagtcctcaataaatattggcttctccaaattttaaaatcatctatttgttcaataagaaaaatcatagtattatttacgttaaacaaatacttattaattgattttataaactagaaactcaacttgtttgccgttggaatgcgcgggtttaggctatatataggcatatggtgctgcaactgcaacttctaaacggtgcagcaagcaatagattgagctctcgatcgaaccagcaaataatggccggcatcatggacagtactactgcatcctactacaccaccttgctgtgcggcgccctgctactcgctgccgtcgtcttcaagctcaagacggcggcagctttttcccggcacaacgccggcgtgaacctccctccggggccatgggcgctgccggtcatcgggagcatccactgcctgctcggctccctgccgcaccacgccatgcgggagctctcccggcggtacggccccgtcatgctcctccgcctcggccatgtccggacgctggtgctgtcctccccgaaggcggcgagggaggtgatgaagacccacgacgtcgcgttcgccaaccgggcggtcaccccgacggcgagcatcgacatcgtcttcgcgccgttcggcaagcacctccgggagctccgcaagctttgcgcgctggagctgctcagccccaggcgcgtccgctccttccgccatgtccgcgaggaagaggcggcgaggctcgctcggtcggtggcggcggcggcgtcggcgtcgtcggccgtcaacgtcagcgagctcgtcaagatcatgacgaatgatgtcaccatgagggctatcatcggcgacaggtgcccgcagcgggaggagtacctcgaggctctagacaagaccatggatctcctcgccggattcaacctggtcgacctgttccccggatcgccgctggcgagggtgctcggtggccgatccctgcgtacgacgaagcgggtccatgagaagctccatcaaattacggaagccataatccaaggccatggaatcaaggacacggttggtgacgaacaccatgagtgtgaggacatcctcgacgtcctgctgcggtttcagagggacggtgggcttggaatcaccctcactaaggaaattgtcagcgccgtgttgtttgtaagtactcaaaatttcagtcttaattatacccaacatgactctttttctacaattacttttggcatgttctgttatagtcttatgtatcatctttgggggaataattgtatatatcgtacaaagcttacggaatgtattaatttaatcgttaggatctttttgctggcggctcggagactacgtcaacaaccatactctgggccatgtccgaacttatgaggagtcctcatgtgatggagcaagcaaagtatgagattcggcaagtccttcaaggtaaagccatggttagtgaggcggacattgaaggccgactccactatctgcagctggttatcaaagaaactcttaggctgcatcctccggtgccaattgttatacccagattatgctctaaaccgaatagtaagattatggggtatgatatacctcaaggtacttcggtgctggtgaatgtatcagctattggaagagatgagaagatttggaaagatgtaaatgagtttaggcctgaacgatttaaagatgatattgttgattttagtggtacggattttaggtttattcctggtggttctggtcgaaggatgcgcccaggtttaacatttggagtatccaatattgagatagcacttgtaacccttctataccattttgattggaagttgcctagtgaaacagacacacatgagctagatatgagagaaacctatgggctcactacacgtcgtagatctgaccttttactcaaagctactccttcctatgcacgattgggttggtccaccaatatgcagatatacagtgtcaagtgtttggtctatgaataaaataatattgtccatatatatttatttaattagttttcttctattataaatggaggataagtatgagttaattaggaattataaatgtggtggctacaatgagctgatggattcgagactttgatgtttcttctgtctgatttgtggaaaccaactttacaacacttatttgatttttccgttttgcgtcgcattgtctaagaaaactagctatttcactttttgcattgagctttgacacgagagatcttaagctcttgttgtaattaagcacgtctccatgctcagagagtcagagagagcggcaatttttgtgtagttttcatggtttcgttaacttgttctcgtgcaaacaccactatttcatacttaaatttaatgctaatatcacataatgtcttggatgtagtgtagaaactatgtctcgtgcaaaacatagtttccttctctttcctcatttattcacttgcaacatcattttttatcctaagtgtcagcttatttaatgctatggacaccatcctagtcattgggttgggaatggcctaaacaaccaatcgaacgggggtgcaaaatccaaaaaataacggagttgctagaaatatggcgccatatgttacaatcgatttttttcagccacttacacagtagttacacctcgtttacaccccacttacatatgtaattagtatgtaattttcgaatttacatatgtaattttagtacttacatatgtaattttgatacttacattgtaaatacactaaaattacatatgtaatttacggacttacagtataaatacatgctgactattttttgatgaaaaatatggcgccataaatatagctacacccaaaaataataataataataataatcccgtactagtagtagctatagttaggcactgttaatacgtccaagtgttggacttgcggcccatgagatcgtggacgatgggcttgagtcgacgcggccgtgctccgggccgggatcacgcggccttgtcgtggtctcctctgatgcttcctactggcccatcacgagtattgatgggccgttcttccatctggatttccccttaggcccggtcctgcttgacaaatgagaaactgataatttagctgctcatctgaaacagctggtacatctgtgtataaactacacgcaaaggaatactccgagtaactaataaaccgatacataatagcgtcgcggctggcgaaaggtgctcagcagccggtccatgcgagcggcgagagaggcgcacgcacgcacgaattcactccatcttgggcgccatgatccaggaccacgtcgtggacatgtagagcaagggcggggcggctgccggtgacgacgcggacggtggcggcgcgagagaaagagtatcttctcgttgtcctgctgcgtcttcagagatgggagcatagagacaacccatactacggaggttatctgcacgacctttttcgtacgtgtcactctcttgtacccccatctatatctatatcgtcctccctccgtcccatgaaaaaccgatattctaataaataattttagatatgttccatgtcaaaacttattgtactagaaaacattacatcatattttagattgatttttatgggatggatgtagtagtccgcatgaatataaatcaggcaaaagacgagttttttctttgaaggagaggattttttttaaatgtccatatagtaagataagattaaatataggcaggtagtgccaggattaaagttttagcatcacacatgtgttatatatatcatgatttggatttttttttctgcgggcttgaaaccacaaccacagcaactatatgggctatatgagagtttatcaaaaatccacatgcagtggagaaagcgcaatcagatatacgaaaaatccttggaggcaaaagcattgtcgaagaggcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgtagaaaagacatataatacgacgtgtgttttattgcttaaatatgtgaatgtcttttttacatgtgtttttcaagtgtatgtaagtcaaatcaaaactatttactagaagctactccttttatacctttgtccacatgattatgtgggttttaaaatattaacatcatgtgtgatgatatatgatgtatgattggtctttgtgtgatgtaagttggcaataatttcccttgccattttgttttgtgccaatctacaagacaataagagcaagtttaatagtatagcccactgctagctccaaaccatctataattaatgtaatagacaattcatacaacagttgcttactatactattaatatctggtcccatctgtcatacacacattacgtcttgtagtccgtgctgcagctggctacagatctgtagcccgctgctcttctctctcttcctttatctctttaaaatatgtttatagttggcttatagcctgctattgtacctgctctaacctgatttcccctcttcaccttgttgcacacgaataatgtattttcctgatttatctcgaccatattctgtactttaaaatgtgattttaaccaccattctcattagaatgatatagaaacatatcctaaaatgaattatatgtaactctattttctatctggacatgattgacctcacgtttcaccgtcggacggagggagaacgtgaaggcaatactgtaattaacccagaagaacaggggtataatagtctcatactttaaaccctagagcaggtaaatcaactccgccgccgccgtcggcgagtccaaaacccttctccggccggtgtgtcgcgtcgtcggccatgaagcggaagcagaagcccgccgccgccgacgccgccggcgaagtcgacgccgacgagccctcccaagccccgctccctctcgaggccttctcgggtgacgtctgcgccgcctcaccgcgcgctacggccgctccaccgacccgcagcaccgtcaccttctcgacttcgaccgcgccatacgctccattctcgtcgacgacggcctccccgtgacgccagcatcctacctccccgccgccatttcggccctccaagccgccggctcggctgaccccgccgccgcttccgcccttgcctccctcctcgtcatcctcctgcccaatatcccctcgtccccatcgtctctcccgccagcgtccgcctccgaatctgcctcagcgctcgccgtcttcctctcctcgcccgatgcatcccagctacccaccggcaccgtgcgctcggtggtcaagtcccttggccatttggctttccatgtcgacgctgcagccgattggggctctgtggcctctcctctggaggctctccttgctgcttccgtcgaccagcgggccaaggtgaggacgctaagagcttttgccacacatacttgaggaccatgctcatgtggttgtcactctttgcttggtaggttcgaaggtgtgcacaggagagtgtggagaagctatttgcgcacttgaaacaatgtggttgtgggaagaaagttagtaatgctgcaattggcatgtttgataagcacattgcatctgtgaaaaatcatgtcaatttgaattcagatgcttctgagggtaaggagatggaggctgcaaatatgctaagtgcaatggttgttgtagttccatacctatcaaagaaggcaatgaagactgtgttttcagaagtttatcagctgttaaccccttgttttagtccacttacaaggcatgtcttgaagcttatggagaccttgttggaccatctgaaggctgagaatgttgagtcagacttggtgaatcttatcccattgttgttggcatacctgaattatgatgaaaagaagcctgatgataccattgtcgcagcattgaagctgatgaaaaattgcttggcgaaactagttggtcgaccaaatttgtggatggaggttcttccatctgcatttgaggcagtttcaggtctgtgcatctacagtttcacctgtcaacatttcaatatgataatgcttcttttatgagttttcagttgacatacttgtgtttgagttattatggttatcattgatggggcacgttgaacctatggtcctcaaacatgtttcctccagttccattttgcactggtgcatctgagggggaaaaaacttatctctttgctctttcttgacaacgacagttaactaactttgagttaccacatgctaatgttgtatgctgcctttcttctaatgaatacttatgtttatcagataagagttggtattcctgcggatcaacccattttggtggatttagttcactgctattgttctgataagtgtatttagacattgtcttgtctatatatcatatatggttggaaccaataggtcaacatgcattgagctacatcacccgccaaaacaagaggcattggatcatcttcatgcttaatcacaaccatccattccgtagttactctctctcattaattagcatatatctcaatattcattgagtcacttagtgtagttatttctataaaaagtcatggcctcatccttttattaacacccttggatggtgcttttacaattcaaatcagtccataatattttgtgtgtgtgtgtattgaaattttgcaactgcattgcacagaacaatatcctgctgcaatgtgtggggtgtcatctagttcattatatgtattgtaatggataacagtcccagagctaacttggtaaaattttgaaatgggcaggatacctgattctggacagaaaatgttctgaagatatagcaggactgctacaagactgtattgattctcatattgaccggaatattattttgactggatcacagttatgcgatcgtgattatgagagcttaagtgatgcggctgctgttaaatcaatctgttcatcgattaataacatgctttgcgcatgtgcttctcctcccaatagtatcttaacaacggccttggttttgtttctgaaacttggtatggcttcaataatttcagtaaagtatcttttgcctataactgtaccagtgtatataataaccattcgagaatatgtagaagactagaactgtagaagtaataacctt

SEQ ID NO: 34916 - DNA, 5273 bp, Oryza sativa
caatgctagaaagtcttataatatgaaacagagggagtatatacatattctctataatctatacatgaaacactagataccatttattctatctcatgtgaattccagcatgcaccatttcgtaaaatatgtatgttgattataaataatcacatcttgcaccacaaaaaactaaaaaaaaattgtttaccgctccctttgttccaaaatataagcactcgtagcatttgaaattttaccaaaatataagcactcctagaatattacttgtcccatcaaccactcattcaattttcttcccatattacccccaaacatacctcatttaataaggggcatggtctttcctactcaaaccttaatctttgctaaaacacctagaaatgcttatatcttgaaatggagggagtatttactagtgcaagtacctacaaagctaatttagacatgaaatattgacacactctcccagtaccttttgactttctatattgtcatacattggtcgacttttttgatgtatgatattgcctgctttttatgattcatttgcttaattaactcatctatattgtttggttcttctccaggggagagttcgtatgcctttatgaaaaatataatacttacattgtcacaaatcgctgcgaaaacagacaaagaatcagagcggaagaatgtaagtttatttcttgattgttctcacatcaaagatagagcatctatttgcttctttgtgtgtactgcgtacatataccatgtacatgagcattgaaactatttcatggcaatgcttatgtttcagttcctcccatgggagaatccagacctcagaaactttcactccaaataggaagctagagccataatgcctgtgaaagtttaagtacagaataaaaacgagaagtttataagattattgtagtcatatcataactgaaaaaggcttgagcattgaattattgaaatttcatttaacttgtcgtgttttcaggttgaagagtgcattggggcagctgtcattgctttggggccagataaaatcctttcactaattccaataggttttgatgaggaccggctaacatgctcaaatacttggcttctgcccattttagataagtatatctatggggcctcaccacaacaattcctagagcgcattgtacctctagcagaatctgtacaacaagcttctaacatgggtaggtaaagccaattcattaggtcttaaatacatacgcaacatgatttcctaaccttctgctttaacttcagccaagtcagcacggaaatgtgaagacttgaaatcatgttccaatcagctgtggaatttgcttcctgccttctgccgctacccagttgatatatgtcagaatttcggttctctatccaagttgctactagagatgttgaaatgtgacaagtatctgtacaaatccgctgttaaagccctgcaggtgcagttttcatttacagatatactgcatttttcttatcttatctatactcattttctttctggaatttcgaactacaaggctgctccatgtcttctctcagacaacatgttttatttttctcagcaacttgtagatggaactagaagattaagtagcagtgagcaaaacagagaaatatatgtggagctttctactttgttctcctcgaaaattattaacttaagctgcccaagctttgagaggtgctctaaaaaagatgctcgtaagaacatgaaagttctggcatcacattctgtgtatcttctttctactgtcacagattattttctagattcttcaccagagaagcgttctcatttgaaggtgtgtcacttaatatttctaattattatcagttgatgagcatgttagatgtcttcaaaccaattaagtctaaaaaacccctacttaaatcagtcacggacggactcacatattgaaacattactgtattttctattatttggcatttgaagtttgattgatctatgcacattagagtaccactgatttaaatgaggttttgtgtcacaaacttgagaaaggcttaacgccgcttgatgcagcccaatattgactgctgcaggctgtgccctacacaattaaagagagattatattagtagaacatggttattttgttgtgtttgtacttttttactatcatttaaccatgtttggttgatatagataaaaccaataaaggtgtatcagggatgagttatataagtaaattttataaatgcacttttgcatattattatcaatacataagaaaaggaaccacaaccttatttcttctcagcaaggcgcactcaaatgactaaatagcaaataccaagtgaaaaatgtctgagagattaatatcctggtccagttggttattccatatccatgtgcacggtgtgcccatgaatggctcagtccaatggcactgaatacttgttacagttggtttgatactttgatgcactgtattcttgtagtgtatattaacaaaatacagttttaccttgaatacatgatttctccaacttccttagctgtttgtacctgggagaggttgagctgtactagttgtgtcagtaaattaggttatgtaccctttgctctagcacaccttctatttatccctgaaaacaacattagtttttagactacatattgcacaatatttatcatatcatctttgtcttcttgcaggatgcattgagatgtttggctcaactttctggtagcacgaacatttgcaaccttttcctttcactggttaaaagatttggtttagaagatactcagtcagagcaagagaatattgaatgccaaactaatgaggtagacaagaaggatgaagagggtactgatgtagatgaggagaaaaataaaaagaggtctgctattattcctttatgcatctatgatgtttgttttcaatgtaggttactcattctgtagaaaaagaacataaaccatcaaacttgcctggctctcagcggtacctttttaattctttttggtttgaaccatataagcaattactcctattaatgttagggaaatgctcattaaatttgcattctaggatgatatttatcaacaaacctattcaaattgcatgccctacatttttcaatggtgggactatatgattatttccgtcatcatgtattgattcacacatggttactttctgctagcgtgtgtgtattatacatggtatgattgtaactctacttgtgtaggtctcttgtaatggaacttatttcgacattcgctgaagctgctgacgaggatctgcttgatttgctttttggatttgtcaaatcttctttactggtacagcttattaatttgttctcttgttaacccaactcttatcggagcattcatgctcataccagtttatctgttcttcacagaacaacaagcaaccttgtgagggcaaagctctatttgctctaagcataattttgaaggtcagtatgactgtgtgggaccctcttgcgtaatttttatgactatgctttttcttattagccaccatccctttcttctttttttcaggaacacaatgaatattctttggctcggttggatgaaataatgatgcttcttcatggaataaaggcagacttggataatgaagttttagaaggccaattattatgctaccagtatttgttggttcacatgattaaggtaggtttgacaggttttcccccctcttgcaataatctttgatgtagcacattatctagatctttcctttttgatgacttggattgtggaatttcaaggttgttctatgttgatctctgaaccattgtgcagaagccaaagcctcacaccttgtttgccctgaatagaaagcatctgttgtagcaaaagaacatgttgttctgcctgcatgtcatgtttagtacttggagagttttgttgtttagtcaatttgtactgttcgcgcataaacatgtaaattatatcctacttggtgctaatataatatccatacattgaaatttcagttaagtaattaaacaatttgttcacatctacttcaaagcagcaaaattttatatgtctaataatataaatgctcagaactattcaacttaaattgcacagaaagtagacctctagaatgtatgtaattgctataactgtaataaacacacgactagaaaatatcaaagcactacaatatctgtggtagctagaggtgcattgtacatctataaatatttctttgaactgattataataacataatggattagttcggatgtcttctggattggatgagtctactgcaaagagagtattgaaccatcaacactttgatggcatttatcccaccttgtctatgatgtgtacctatagtctagttctatgctattttggtttgatgttaccaatcctgcttgtatatttatgtaatgtatgtttgtctgacttcttttctgcgttgtaaggctaatgaagagaacacgagcaagaaggcgttcctgattctaaacgagttaatagtcgcgttgaaggtttattccctacctttttttatcagttaccaattatgtatcaggaggatatatcatgtcagtcacaagccttttgctattagatggatagttttcctctttcaaaaacttaaaagcaaggttcttaaaatatacacacgaccactgatgacaattgttcttgccctgctgtcatcatctgctttattttatcctgacccaccttttctccgtacgcagtccaagaaggaaagtagaagattggcatatgatgtactcctggctattagtaatagcttgagaagctctgagtcaaacagtgaagattcagatcttcaacgactattcacaatggtatgttaaagaaaagttctctctgctctgaaggtatcccttatgttttatgattttatctggcataattggtgaagttaccttgtcagagggatgcaaatacttcttttttaaaaaaaaaaaatcatatccttatcataacacctaaaagaatcattttgcttttcatgaaggaaatctgggaacatgttctccatttctattgtttgaacttaatgtctatgtaatctgaagagttgtaccactaggtcctctcatccttatgaattgcttagtgcattcagcttgtagaaaaactctctcagactccaatgtacaaaggattaacaattcgcagctgccaagcttttgagtgtatatctaattagttatatctgagagagcctcaagccctaggatca

SEQ ID NO: 34917 - DNA, 13297 bp, Oryza sativa
tccttatcataacacctaaaagaatcattttgcttttcatgaaggaaatctgggaacatgttctccatttctattgtttgaacttaatgtctatgtaatctgaagagttgtaccactaggtcctctcatccttatgaattgcttagtgcattcagcttgtagaaaaactctctcagactccaatgtacaaaggattaacaattcgcagctgccaagcttttgagtgtatatctaattaggtatatctgagagagcctcaagccctaggatcattacaatgattttctgccaataacttactaactgacctagaagactagacttttattggaatttgctttagtcatcagatttaaatgtgaggccagagttttacttgggtcttgaggacctgagagatatagttgctttgcttgcagattaccatggtaggagttgagatcatgcaaactgtttgctgttttgttgctttagcaccacatgacagatttgtcatgcccaatcagtacatgctagagacttgtcatgcctaatgtttttttttattaaagaatgtgtccataatatatactagtactaagaattatctgtaaagttgtgatatcaatatggcacaactttattttgagttagcagtaccatttcgacaactttattttgagttagcagtaccattttcgtgaaaaacaagcaatataatttcatatgggaagttcataggaagatcatttacatgtctaatatgcaggactttccttgttgaacttggaattgatttacaatcaaccatctgtgtatttaatgctgtaagatttttatagttcaaacttggagttgatttaaaatcttgttatttttcaggtgatgggatatctttcaagtccagctccacacatagtgagtggggcaatagctgcactatcgctgcttatatacaatgatgctaacttttgcttggaagttccaaatctgataccatcagttttagttttgctgaagcataaagctattgaagtaatcaaggtgagtaatgtttcattgtgtgcctctcttaattgttttcatattattgagagttaaatcggttcaatcctacatgttttaggcatctttgggctttgtaaaggtgttggtaacatcattgcattcagaaaaactgttggaattgcaagcagatatcatgagcggcatattaccatggtcgtctgttacaaaacaccatttcaaaggaaaggttagtcagtaaaattatcctgtgtcttttttcccattcaatcttatttttcttaagggtaattaatatgacattgtgttgctctgatatttaatttgcaggttgtgttaataatggaaatactgattaggaaatgtggctttgatgctatcgacttagttacacctgaaaagtacaaggcttttgttagaagcgttgaagaggtcagattccctttacttgcttggtctagcttgggaaactagtagctatagtgaatttagccaatacgcaattagccgctggtgctccaggtcaattactgatgcacatttatcgaatataaatataaatgctttatagggtcaatttcttcaaaattttactttatttgggcttcttggcctacttttatagtatacaacactagaatgtggggaggtcaactgacccattttggagagcttctcattccttaattaatatgaaaaagtttagtacagctgcacaggaaagtttagtacagactgcataagctataaagtcaatgcttgatctaagggatgatgattacatgactattggctactgtctgaaggaaagacagcaaaccaacgaagtaataaattagcacaatctttaatcataatttactatgcaaagctatttctggtatgtgatctcacaaacgtttgcattaattgtagcataacatacacacatcaaggagcaagttttttttttgttttaaggacctatttaacccacctcttgtaatgttgaggctttacttcactcttgatcctgatgtatggactggttagcatgttatcaaatgtgtggttcaactggattatccttaaatgcagtattaagctaaatttgtgtagcaatgagccatgtttctttactttgaccgcccttaaagagaggaatagagaagaactgtgtgcgtttaagaagtttggtaatatttttcccctccccccaacataatttcttgtttgggttacaatgttacaaaaactgcatccttcgacaatatgaacttgtacctttgcatgatttatttttgaaactgatgtacatcctagttacaaaggcatatctcggtacttctgaaattcagcctaagacaactctgatattgaactcaatattttcttgaggcaactgatttggattctggacagttccttgaacggctctcattctttcaacttgcagggccgcaagggaaatcataatccagcagatggcgcagagtctgaggcacaacaacctacgcaacatgctgctaagaggttagcctgcagcacttagctaatttcccttccccccttaccattacatgttaatagtagttaattgtatgttttatgaattcgtatgtatgcagaagaaaacggtctgattctgatgttggaactggacaagagggaacacacactcgggcgccatcgaggagtttgccagctggaaagaaggaattcttcgttaaaggggccaggaatgctcgctctcctggtgtgaaaagccaacgaagcaaaccatcaggccgcaatggtgatagaactaatttcaaatccaaatctgaaccacggccaggaaatggccaaaataccaagggcgacaaacctcaaggtttcaacaaaagaaacagaactggtaagttcgacaagacacaaaatcgtgggggtaaagcatctgatcgctcttctagattcaagaagcctagaactgcagcaacaacatgaaagccaaggctgtcatttgcaccatccagctatcaagctgcataaacgcttcttgttagcctcatatctttcaccggcaaggtcaggtcctttagttgagtccatgccgggaccttgaaatttgcatgcaccttgattcctttaggacttttgagaactgcgatagagaaggtagctggctaaaaggagcaattcttcagggaatctgcgtcagttaaaaggagcaaatcttcacttcagggaatgcgcactgtctgcgttagtaaaagagagcagtggtgtcgattgagaatccacctagttgtacattaaaattttgacttgtgggtggattgaatcatacgaaactattgatctagggggcatcccttcagtgttgtattacaatttatacgcaggtgaaattttgacttgtttgtttcagtcatccacaagccggacaatatgctgtcatttggctggcgttgtcaatcaggtttactcattacttttgcacagtttacatccagagccatacagatccaaattgatttttttttctaaagaatacaactccgaattatgacatttcatcctgttgaagtgtagagcaagctcggtttaggtcctaccccaaaatttttcaccatgtcatgtcaaacgtttaaatacctgcatgaagtattaaatataagttaaaaaataactaattgtacagattacgactaatttacgagacgaatcctttaagcctaattgcttcatgatttgacaatgtggtgctacaataaatatttgctaataacggattaattaggcttaaaaaatttgtctcgcagtttacaggcgtattctgtaatttgttttgttattatactacgtttaatactttaaatgtgtatccgtataaccgatgtgatacatgtgtatccgtataaccgatgtgatacgataaaatttttcacccctgacgcgtatcatcgcactgtctgtctctataaactacacgtaaaattatggaatgtgttttttagcgtgtttttatacaatttgattcgaaaatatctttaaatttacccaacttagaccaaggcccttttatccatttcttacatggaaaagcctacacactttttcttactaaattattactaactctttcttaccagtaaattcttggggtaattgtaaatttactactactttgaatcgttattgcaaaaacgccactaaaaaattgcaaaaatgcaattagaactgtcattcgagtggcatacttgcaaaattgaaaaaaacggtggcaaatttgcaaattcttaggcttcgttcagtagcaagagactaagaggagatttctctcgttcttcacgcgcatgcttcctgaactactaaacgatgtgtttttttaaaaaaaaatttaaaaattgctttaaaaatcatattaatctatttttatatttgaaatagttaacactcaattaatcatgcgctaagagcaagtttaataatatagcccactactagctccaattcatatatagttaatctaatagccaattcatacaatagttgattactatactctttatatatggtctcaccatatatagccaatttatacacacactacgtcttggaatccgtgctgcagctggctacatatctgtagcccgattctcttctctatcatattttatctcattaaaatatgtttatagctggctaatagtctgttattgtacctgttctaatagctcaccttgttttacgtatcttcttaaacttctctttttttctcctctcaaacacaaccttagtaatgctgtgagtgcatctagaatttttataactcatctacctaagtaaaaaatttagtaaggaaaaaaatagtagtaatatagttgtgctctttctgcttttccgactcagtcagacaggtctagacgcggagggagtccgactcggcgacttcgggtccaaaccaaccttgcggcttagctagggttagctagcacaccacgcagcttcagctcaggcgtcgagaggaaggaggaggagggggtcagcctcgctcggttccggcggccatggcggtggcggcgcccggccagctcaacctcgacgagtccccctcgtggggctcccgcagcgtcgactgcttcgagaagctcgagcagatcggcgagggcacctacgggtaaaaacatttcgctcaaaccctagccatgaatcgagggggattgctcgtctgattggattctctctcgctcgcccgttgtttaggcaagtttacatggccaaggagacggagacgaacgagatcgtcgcgctcaagaagatccgcatggacaacgagcgcgaaggcgtatgaattcccccccccccccccctttttttttctccgccccttcttccaatttttcctctctgatgacgtgttgctgattgcctcggcgcagttccccatcacggccatacgcgagatcaagattttgaagaagctccaccaccagaacgttatccagctcaaggagatcgtcacctctccaggttagtttcatcgtcgcaagcacggttggttttgatgtatcagaaccgagtccatttttggtgctaattgaatttggaaactatatgccttttcaggcccagagcgagatgagcaagggaagccaagtatggcacattttattcctgcaattccttggtttgtgggagtggttctaggttgtaatgtctgatgcattgtcatcttgttgaaatagtcgagggtaacaagtacaaggggagcatctacatggtcttcgagtacatggatcatgatcttactgggcttgcagataggcctgggatgcggttcactgtgcctcagattaaggtagaaccacctgtttgtgtgacttgttcttgtttggatgtgatatattttgttatgacagactgatcttctgatgtgtgatcttctatcgtcccagtgttacatgaggcagctacttacaggcctgcactattgccatgttaatcaagtgctgcatagagatattaaaggttccttctttagagatatcttgtttgttcctacttcttgcatgtatatcagttttttccctgaactaatatgttgtatccgttctttcttgcaggatctaacctcttgatagacaatgagggtaacttgaagcttgctgattttggccttgcaagatcattctcaagtgaccacaatggaaacttaacaaaccgtgtgatcactttgtggtataggtatggaaacttcccatgaggaggttcttccattcatatttctcttactttcttttcattgttctctctctcttatttgtgtatgcagacctcctgagttgttactcgggagcacgaggtatggtccagccgttgacatgtggtcagtgggttgtatttttgctgagcttctcaatggaaagccaatattgacaggaaagaatgaggtattgcatcttgaagctttgagctatcaattggataactgaagtgccgttgcattttagtttttcatttccctccttagtgcattatttgtgctgatacatgtttattgtttcttccctcattttggggattggaaaattgaactgtcagttatcatgcagatgcagtcttgatttaattttgtaaaaccgtttcccctacgcattgattacatgcactgcacattgtttgtccatgcaatagttataactcctaacctcatctgattttatgctattactgcagccagagcaactgtctaaaatttttgagctttgtggtacgcccgacgagttaatctggcctggtgtcacaaaaatgccatggtacaacaatttcaagcctcaacgaccaatgaagagacgggttaaagagtcctttaagcagtgagtgctatgcttggcaatgtttttcttatgcagctttcgtcttgccattgatgttcactgttttacatatttgcagctttgatcagcacgcgctggatcttttagagaagatgttaactttggatccatcacaggtatgctgcattaaccagttgtgacttttcagacgtgtcacttatcatttctgtttgctttttgttctatatattgacaatcattttggttatacagaggatatcggcaaaagatgcacttgacgcggagtatttctggactgatcccttaccgtgtgatccaaagaggtacatatgatggttaaatttgtcacgctgctaactagcttaattctaataactttgcatctgatacagcttgccgaagtatgaggcgtctcatgagttccaaactaagaaaaaacgccagcagcagaggcaagcagaggaagccgcaaagcgccagaaattgcagcatcctccaccacattcccgtttgcctccaatccagaacccaggccaaccacaccaaatcaggcctggccagcctatgcataatgcaccacctgtggcagctggcccaagtcatcactatgcaaagccgcgaggacctggaggccctaataggtacccacaaggcgggaaccaaggaggctacaatccgaaccgcggtggacagggaggaggctatgggagtggcccatatccacagcaaggacgaggtcctcccccttatcctggtggtggcatgggcggagccggtggtccaaggggtggtggtggcagtggctatggtgttggcggaccaaattatcaacagggtggaccttatggtgcatctggtccaggtcgaggcccgaactataatcaaggtggttctcgcaatcaacaacagtatggaaactggcaatagcacggcggtatcatgagcagcaaatgcccttccggtaggactctgtatgttgaaagaacctctgatgttgtatttgagatatactttttgcatggtgtattcagatccaggcatctctcggaagtatgatgtttatgactagctgtatagtatggcactgatgtgattcccaatgtttgatgtactagtattattattactgcaagaatgtggaaagacatgaaaagtttgttatcaggatcaaaacttcgtgttggtagtcctgccattagataatggcaatttgcccataatcttcttttatgagaaaactagccgggtgtattgtgcggttagaacccatataaaattatttattttttaaaacatgattttttttatttttttaaaaataatcatcttcttgtcttagcattaaaaaaatatatctagtttctaattttatagtttttaaaagttacttcaccccttactcctttgtctttacttcaccccttactcctttgtcggctttttatttacttgtccatgacacggctactattcattactacctccgtcccaaaataattgcaattctatgttatttagcatatattaaggtttgagaagaaagactacggtgcccctcattaaatggtgtttatgtgagagtgggaagatggttgagggtaaaatagggagaaatttgaatgagatatgattgatggggcaattagtactctagaattacaattattttgggacgaattttaaataatagaaatgcaattattttgggacggaggtagtattatttagacctttcaaaatcggatcttatagcttcgcgtttcctttttatatttttagaaatctagtcaaacgttgttattgtactattttacgattagtctgttgtccccatttttattctcatttcaaatctggtcatcgttgaggttcccttttttactttctaaaaatcctatcaaccaccatgacccttagcatttgccaccattatgttttagatctcctttcaatatttcttaatttttaatccaatttttttatctataccactttaaatattggtagtggtgatgacagtaaatctgccgctaccactcctatcattgacgtgtggacccctatttatcattgaaaaatttgaatttccttgcctttgagagctgaaagagaatagacttgggctagctgccaaagagctgcttttcaattgtgatggactgagtttttttttcaactgtaccaaagatgaacttgggtctttggagtggatgagaatgattaaaataaacaatggtcacaagccacaataaagtcgcattgattactttttgcaacatgcacatctaattaatactcatatactctatatttacaatgataagcaatataattattccacaacatttgattttctcctttaatcccataaagaagtacatgcattctactggttatttctatattgtattttctacttagattgtattcctacatagatcctcatttttttttctaattttctatttccttgcacctttcgcaccttagatgcgagcacggagcaccgtcatcgtaagaatttgtgacactctcatcttttggccggaacgggatagcatatttgggcttaaatgggattcgccgaaatcatgggtcatatgttttctaaggtgatattcttttctcctaaagatgaagattaagttttttacacaaaataaggtggtattaacgtatgattgattgagttttaattattacaaacttgaaaaatagattaatatgatatttgagagcaactttcatatagaaagttttcgcacgaaacataccgtttagcagtttgaaaagcgtgacacgaaaatatttatctttatccaactcttattggagaaaattacaggacctaagggatggtcagcctatctcgaccgcgcgctgaaaggatgagcggttaaatggactgcaaactgactcgaagaattctactgatttttaccatagaacacgtaaaactttggttaatttgtttttcagaatttatatgctgttttgatttgaagcccaacaaatcttgtgacagtatggtccatattttaagcccaaaactgttagatacttgttcatgcatgtgcataggcttcagtcagaggatcaatgggagaaaccagaagtgacacaacactgaacaaaactgtgatggtccaaaattttgcttctaatttcctagcatgttagcaaatatatattacatgaaaggatggacacatagtgaaattgtcacaggagtgaaaaaccagaatgatgtacaagtaagcaaacatgctctctccgaaacttcaaattctccatctcaaaaaacaaagcgtcctagctcaaggaaaaatggcttcaacaaatgcctcagcatcaaaaggctgaagatcctccatcccttcaccaacaccaataaactttactggaattccaagttcatctacaacgctaacctgcaatagatcaaacaacaaaattcaggtgaaccactaaaatgttgttgtttataaactgcatatggcaaggaatatgtgtataccacacaaccaccacgagcagttccatcaagctttgttaggacgaatcctgtgactccaacaacctggcattaagccaacagagttcgttatatcttgatgaaaaaaaaaagaaaaatcaggagtaccaaaataaccaggaaatggtgattacatcattgaactccctcgcttgttgtagcatattcaagccagtcgtgccatccagaaccagcaagatctcctgttaagcaaggaatatatgctagtagttaataacaatgagagcgctatgaagtattagaatcataaccgtgcttctctaagcttgccctcaaaagtactgcacatgccaaaatgatccaatcaacacaaaatcaagtcctttgcatgtaaacacagcatacattaggagcacccgaaagggctttagctatgactttcttgcaggaaaccaattcttccatcagaccataatttgtatgaagtcctgaaaaataagtgctgaaacaaagtcatttcaaccaatcagcaaatcaccaaacatatgcatattctgctctcagtcactaaaataatcatacgtcctgacgtgtcgcaaagaacaagatcaaatccttcacgcttcccgcgcttcactgcctgcgagagaactaccaagcaagtcaaattagatgaaacatagaagctaacctccttatgagaacagagtgtgatcacaatgcttggcagatcaaaaaatcatacctgatgcaggttttgctttcttatcattatcgataacaatctctgaacctgttctctctgcccaaacttctagctggtcacgagctgctgctctgaaggtatcacctgctgccatcaatacctatattattgttgaaagcatgaacatgaactcattattttgatctattgtacaatattacatgttcagagaatgtggtgaggcaatatgtacatagctgaatttaattcccatgcatctagcctataaaccagggtatgtctagaaaatagcctcaccttcactccttcattcttgaatctgtaagcaagttttcctacaaatacataaaaaaggagtaagatcaatcttccacttcaaagcatcatgctgtataaaacgttccaaactaaatagtgatgccagatgcagatggtagaaaatgcccgaaccagaactgcatattgaggagctccttactatctaggtaccatattagctttaaagcgacaagataacctgcagaagcttaatccaatgctatgccacaatccaagcttaatatgcaagtagttttgcattgagctgaaaataccttacataggcgtgataaattcacttcgagtaactagtacattggtgtataagagataatcttgtgatggcctaattacagtattgtgcttttataaccaaatatcttttccttcacaaatgcacttgcgtgcctatataaccatgtgttgtgcctttagaacatcatcataatgtcaattgtccatatagtagggtactagggtaggaccataggagagtgtgttaccgtttattgaccatctatcagaatggaacaaaaacatctaagcttaacaaagccaagcatgcaagaggagtacctaatgaggtagtctttccacctccattcactcccacaatcatgataactgccggctttctgccataacgatgaacaacattgctcaaattacaaacagcaagcaacaaatggcactgagcaggaattcaggagaaagcagaacctgaaaccgagctgcagctccggattgccgcctttgctcgtcagcagttcaagaatacaccttttcagcgcttcctgcacaatcaaccaccacagatgacaaaatgaatcatcagaccaatcacaatgccgatgtcaatgtacactaagaggaaactgaaatgacctttatctcagccccagacttgagcttgccatcgcggatttcctcgcgtagagtgtccacgatccggaacgaaatcttggggccaaaatccgacaccagcagagcctgcgtgcacgagaccaagcaggaaacattcaaaaaaaacgaagacagaagcagcgccgaacagtgaagaaggagagaacagcatgcagagcagtggagcaggggacgcgcctcctcgagctcgtcgaggacgcggtcggtgtcggcgaggttccagtaggtgaggagctcgtcgacgacggagaggctctcgcgggtcttggagaagccggagaagagcttctcgacgtcgctcttggccttctcctggatgaggcgtcccaggcgggtgaagaaccccgcctgccccgccgccgccgcgcaccgcaggagccccgcgcggccgcggcggcggtggccgtagggggagcagcgcgcggacgtctccgccggggagaggaaggggatgacgtgggagtgtgccgccattgtagggatgccaaggctccgctctgggtggatagcgcttcgctgccaaaacggcagccacgccgcgtttactgtccggtggctacttcataggccgaaacattgagcccatgggctcaaggcccatgtaaagcccacttgtctctgaaggactatccttcacgctgcggcccatgaggcccacgatttctccttgcgtagcccatttgtctaagaacgactatccttcacgctgcggcccatgaggcccacgatctctccttgccggggcgagacgctgactgctacttccgggctgggcatttgctgccgcggtggctgctgctttcccgtgtgcgcagcggcgcggtaatggatttttcgtttcgttcttggcgtgcggatgcgacgcgccgtggcgtgctcgatcaccattgttagccgacacccaatcgccagtggttgccagagctaagctcctcgaaaaattgttaacaatgacaaacgaatctagggcctgagagcaagtttaaggacagtcacaacccagaa

SEQ ID NO: 34918 - DNA, 1236 bp, Oryza sativa
  unsure (1)..(1236): unsure at all n locations
acatgccgttcccggcgcgcgcggcacgggctggtgtcgctgcgcgacacggcctacttcaacagccacgacaccagcatgcgaacgctgaagagggtgggcaagacggcgtgcaagccagcgtgtttgggcgactgcgcgtgcatggcggcgcagttcgtgtacggattcgaccccaccgacggcttttgctacctgcagtcggaggtgttgtcgctggagacgatgcagccggaggtgtttcactacaactcctccatgcatatcaagattgcccagggcaggttgccaagacgattctgatcgcctttttacagtctactatactatatcaaggaggagaaatccttgtaaatacatacatgaataaattcacgagaactagctaggattctcgattcatatgtttttgtattcaacatttgtttgtgggttttaacaaaatataaagaaaacatttttttttattttttcatttttattttttaatatttacagaaatattataccatccaaaatatttacagaaatggcccctgccgtccaagtggagggaggcaaggtgtgtgcaattttcaccctgctaaaaatgcatttttctagttttttttcatcttgtctgtcacctgccgccctcagtctacttctgtaaatattttcgccggtaaaatatttctgtaaatattaaaaaaataaaaatttaaaaatgaaaaatattctttttaaacaaggacacagcagcgtgccttactacgagttgggctggaacgggattcccacgaacgtgttgggccttttaactcttgggccgtgggccgtggccagtcatccagtcatcgcttggtggcactcgccgtcgccgccgggtctgcgtgaagccccgtgcgtctcccctccggctccgcttctcccctcgccggcgccgtcgccggcgttcctcggctgcagatccaatcccgcgccccgccgagtgactctcctgattccctgacggcctattgaagagctgcctagaccaccgccgctcgcgactcgcgagcgctggggcgcccgccggcggccgccacgcccttgttggctaggctgctagctctctgcccctctcgcctgtcggcctctactccggctaaccagagctcctcctcccttgctcccttggctacacgggtataccatnnnnnnnnnnnnnnnnnnnnnnnnnnnnnnnnnnnnnnnnnnnnnnnnnnnnnnnnnnnn

SEQ ID NO: 34919 - DNA, 572 bp, Oryza sativa
  unsure (1)..(572): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgttcgagagcacgaggaggacgtggccgagcgactccacgaggtagtgccgcctca

SEQ ID NO: 34920 - DNA, 1741 bp, Oryza sativa
gacccgacccgaccgaatgggttcgactcagcggcgtgctctctctctctctctctctctccgggtctcctcgtgcacagcgcacgcacacggccacacgcctagcctttgtatgatcccgcgacgccacgcccctctcctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggaacggatggagtatatttatatgaataaaaatgtgaaatggggaatttccagaaaagcaaacttgaaatctaaaattggatacaaatgaaatggtttttatttcagtatagtgaataatattgagggagtctataaataaataaataattaaagagctttcaagagaagtggattaattatttaatgttagtctatatggttattcaacaggtggtgatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgctacgagagaaagccatagtccaggatgtaccatatctctaagaccgcgtcactactcactacccaaaacaacatattttctttatataaaagaaatatgtcttatgtgcttgcgtaagctctattgtttgctctttggcttagcagcggcaaccaaaaaatattttttaaaagttgattttgatgtttttatcgtatttatttgtcagcattggtttttaagcaagtaaaaatacatataggaaattttatgtatattttttcgctaataaccgttatgattagatgtaggcaaaacgatgggactgccaatcgcttgatcaagtatcttgtaacgaggtggaggtcgaacaaataatttatattttcttttgaagattttgatgctgttttaatgtagtataattttgcatgatctccaaataaatgcagggtcttgtctatattggtatagcaaatctgctgctttgatttgcagcaataactcgagttggccttttcacatccattccaaaaccaaattcaatgtatgcagtatggcacagctaagcatcctgcagccatccagccaaagggcgtttcagttctcgtttgcatgcaaacaaaaggtcaatacttgtagtgcactggcatgcatacacggtgctagtccaaaaacaaaattcaaatctcccccaattcggggagaaatcaatttgattagcccaattcggcctggattcggagcgttcagagcctggttctcggactgacgtggcggctcatgaaggcccacccaaattggatcactgctaatcgaaatccatattgggccggaggagaattttggaggaacagcccacgttaattgggtcttagcaaaaaggcccaggacaggtggcatcgttgtcgggcccattttagcccatccaaatcgagacacatagattggcccagacatgtaggcccacataagattgatcggcggactggtacggcccatataaaattgcattgtggcccattttggaaa

SEQ ID NO: 34921 - DNA, 59786 bp, Oryza sativa
  unsure (1)..(59786): unsure at all n locations
ccctctgacagagaaaacaagctaagctatgttgaccttgatgatgtcctactgaacaatcgatctccaatcctaccaactaataaacaatctaatcctttttatcgtcttttgcacaatcactcgaactctagggaaaagtgagacgatcaaattaagcaattcgattcataattctctcgagaaagcataaggtcaaaccatttttttttttaaaaaaaacagaacatcctctatcctgtgcattaatggcgggtacgtgcaatgcacgccctctcagtactagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgcttaatattgtattcaggcatgctccccttgatgatggctgtgcctcccgtttcatggagttcatgtttctcatgctttggccaatgcctgtctctagccattggagtcattctgacgaggtttttaccccggatttagcatgtcttttctgagttttggctgcacttcttccacatttcaagtttctagatactaatttcatgttgaatctgcttttttttttaaaaaaaaagggggaacaccagtgacattatttctaacgaaaaagggggatacagtataattacatggaatagtgtaattcagattgtagcaactagcaacaagcttgctgcttaaactgaaaactatcacttcaaataggtgcagttaatagcaaactgtaaatgatgctctcagattacgtgtaggtaagaaaatggaagtgtcattaggcttggaaatttatttatttttttaaaaaaaggcttggaaatgactaatgagcatgcagttagtacaatattgtcaagctatcagcatagctaaacatgcttgcacgctggggcctaattaaactaaaattaattaaaagcagaggcacaccggccatgcaaccacgctgctgcgatcccaacaacaattttcgagagcttctatgctgctcgtgcgcagctgcaactttctcccctcaaaagaggcaaccggcctgaacattctgaacgtgcgagagagaagaattccattgcagtgccaatttgtcatttgtttaatctcctaatccaaaagaaaccatcctctgtttagccgtccgtaatctctgcaccgtccattcaaatctcctaatgctaaaaaaaagagttattttgcacgtcacacttctatcctactctgaatctctgaagaatttcaactctgaatttgtaaagttcagagctgcgtgaggttgcacgaaacagtgtattaatggccgtttgtgccgtgcaagatggaaaggtcgatcagagttcttggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttggagatgacgacgacgatggcaatgcatgcatgcgtccaattgcacaaaccctgtatgtaaagaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgttaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagctcggaggcgaacggcggcgggtgctgctcgtcgtcgacgacgccgagcatggacgcggtgaacctgagccggactttctccgacgtgtcgtccttctcggaggagcatggcggcagcggcagcagcgtcgaccacagtggcccgttcgagccgccgtccgccgccgccgtgtcgaggctgatcggccgccgctcgccggctgcggcggcctccgctctcagcctcagccgcctcagcatgaagccccgggccgacgtgctcgaccggcgctccaccgacgacgagctggagctcgtcaaggagaggttctccaagctcctgctcggcgaggacatgtccggcggcggcaagggcgtctgcaccgccgtcgccatctccaacgccatcaccaacctttacggtacgcagcgcgatcgacatgatcgccggcgaacttgttcttgctaatccgtgaccaccatgactaatccgacgagctaatgcagccacggtgttcgggagttgccacaagctggagccattgccggcggggaagaagacgatgtggaggagggagatggactgcctcctctccgtatgcgactacatcgtcgagttctacccctcctcacagactctccccgatggcaccaaagtcgaggtatccatccatgatccatccatggacgattcaatggatttctacttaccaaacgccatggctgattgattgcttgctccatctccattgctgttcatcctgcaggtcatggccaccaggccaagatccgacatctacatcaacctccctgctctggagaagctcgatgccatgctcattgtaagatcccaacaaatttgtcgcaaattaaaaacatgctgaatttgacgaattttggatgagctgaatttcgaatttgtgcaggagatactggagagttttcagaaggcggagttctggtacgcggacgccgggacgaggtcgttcgggtcggcgacgtcgtcgtcgacgatgtcgtcgtcgtcgttccggcggtcgacgcaccggaacgaggacaggtggtggctgccggtgccgtgcgtccccgacggcggcatctccggcaaggcccgcaaggagctccagcagaagcgcgactgcgccacccagatccacaaggccgccgtcgccatcaacaccggcgttctcggcgacatggaggtccccgactccttcatggccatcctccccaaggtaattaaacaacatcaccaactccaatgcaacagtaacatcaccatttttttccgataatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattctaacggagcttactcccggcctccgtatgaaatgcacacggccacaaaacaggatctaactagaccctcaacacaaaacaaaaaaattagtgactatcaagccgtagactagatcgccacccatattccagagtaaaaaaactcctatgccacctgatccaaacaacgcgataccaccaacaatagtatttgtcgtcatcatcttcttcttcgtcttgttcatcatcgtgttcttggcagagtgggaaggcgagcgtgggggacggggtgtacagggcgatgctgggggcggagaagttctcgccggagtacctgctggactgcctggacatgtcgtcggagcacgaggcgctggcgatggcggacagggtggaggcggcgatgtacgtgtggcggcgcaaggcgggcgccagccacgggaggtcgcggtggggcgccgtcaaggagctcgtcgccgacgacgaggagcaggacaagaacgtgatgctggcaggccgggcggagagcctcctcctctgcctcaagcacaggttccccggcttgtcccagaccaccctcgacaccagcaagatccagttcaacaaggtaatcaaactaactaatctacaattcatacaaatgcaacagcattagcatccaacattagcattcaactaatcaaagtacgcgaatgcaagaacagcattggctttcaactagtaagagcatgcaaatgtaagaacaaaattggtactcttgattcagctgatcaaagcatataaatggcaagaacagcattggtattcaagtagtaattcagagcatgaaaactcaaggataccattggtattcatgatccagctgatcaaagcatataaaatgcaagaacagcattggcattcaactaattcagagcatgcagatgccagcattggcattctgtgatctatatcttcttttcaaattcaaaatttgatacgttcctgaccaaatgagattggcaaaatttttcatgtaggatattggtcaggcaatcctggagagctactcaagggtgctggaaagcttggctttcaacatcgtatcatggatcgatgatgtcctttttgctgacaagacggtcaggaaacagtgagcgacagccagagcgtctggactctggattgaagcttcccaacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgcctccatgatcctactcaattacatttcatatacttgcgtccatcgatggattgtgtctttgtattcaaaatggaaaatccaccgagatgataagttaattgcatagcacgagacaggtaaaaacaggataagatctggttaaacaaatatagctcctcccaagagcgaattgctgacatacaacgatgattctctcaaacttttgctcggctgtatggcatacaactcgaagttcaacccaaatataaacgtggtttataaacattacaacggtgaaaaagtgtgataactaacacaaatactaacttagttcaacttgaaaataataaacataatagataatgcatactactcataataatcactcgaagcaacatggccactctcatacagtgttccatcttctggatgcttaagctcatctccacagaaatagcagtgttgtttgtcaatgggaagacctggaacacctcttggataatgaactctggcgccatagtaaccacctgtaaaagcaacttgtatatgttagtaacattttaaatagaatatcaaagttttgagttctatttttggactaaccaattttttctttcccttcaagagagaccatgcaagtgggtatatatccattgttttcccagcgtacttccgcgaaaaataactcctccgagttcttgcaatcgccctttgcaataaaatttacatgaccatgaaaaccttcgtccagatttccacagctagtgatcgtcctgactaactcatatttgatctatgtttcaacaaaaaaaaacagataccagtaattaggccacaaagatatagtgtgcataatattgcattaagaaaatgaaaatataccaagggccaatttcaaacaaattattcaccagactattgccacgaattatctacttgattataaggataaaatcaaatattttaagaaataaacttaacaaacgcacacaagcttccggtgtacacacaccaactaataaatgttataaaaaattccagaaaaaaatgtatacaagtacttccaatagtagtacacatgtatgaagtctaagcatcaaattatttttagccgtaacaaaaaaaaaagaacatatgacagcttgtaagagtataaatctgccagatttttttcttcttttctctctccatatgatgaatttaaagatgagactttacgcataggtgtaatactattaaataaatgtacatgtacaaaatttgctagaattttttgtggaattttttagttggtgtacacgatccatgcagacaaagttgttttctcaccggcggtacaaggaaaaggactgcgagcgcgaaaagacggaaaaataaaaaactgaaacttgttgctcctatagaggagagaggtggtggaggaacctcccaatctcccaacaggtcctcaaatatgctaagctattctcgataggggggctagctaatttgaggatatgataagtacctcgagctcggacttgaagatagatttacagaatgagctgttggcaactccacctcgacctccataagctgtggtttgtcatcatcaggaagtggaggacttttaacgaataaaagaagagaaaatcaatatatatataatataaaagggaaaaaaaaggaatcagcatcacttttaatgaacgaacaaaaggagaataataagatcaaaatcaatgaatagagcaaagggtaaagaggcacaacttgagatccaatccgtgttgggtctccgaggggatcagcatgttgatgtgagcggaggagggaagtagaggcggtggtacggacgcgctgcggcagatttgattgattataagaccaaatccctccaaattaacaacgaacttgtggtgcttataagggtggagagggatggatgagctagtacaacttacgcaagaggttcgtatccacctcttctgaaaaaaaaaaaaacaagaaggccttctttggttatttttcttcggagtaagttcactttttgactctgaatcggattcgtataatttgacttgttttggagagcggtttggccttcccgacctggggacttggggagagtgcttcctcgatgccttccggacctcaacgaggagggctgcggtggcggaagcggatctcggggcagtggaaaaggggggagctcagcggcgacgtgcgacgggcggccggtggcttgggcggcgtcccctccatcgccggcggcggacgacctccttggcccgccaccgccgccgctccgtccctcgctcgccgcccaacgccgccgccgctccagccctcttcagcccgccgccgccgatggccgattggctgaagaagaacagaaaggagagacagagggaggaagaaggaaagaaagagggtgatatgtcagtgggtcccacattttggtgtgaatgacagtgtgtcccacacgtatttttttaattttaatacactacgttaacttcacgttaaacaaatcaacacgtcacatagacatcacgttagcgaaactatccttttaaatcaccgaaagaatcaaattacaccggctttaatagttgtggttctaataaattcggtactagtgtttagggacacgaatcagatcggtcaataatttagggagtcagagtggacttattcctttttcttctaacaattccattccaaaaaaagcagtacgtacacaattgggcttctttcttgggcctccaggcgcttccgcagccccagcctatagcacttggatttgtggattcatagtttcgggagtggaaataagtctattttgcttccatcgaccgtaaaaccggatataacccgtctcttttaactcccaaaaccgtctcttcttggcttcccaagaagagctttagatggttctgttagtgtagcttccaagagataaaattaagggataaagtaacagtaggtagagtacagtaggtagagtgattttgctgacctagagagggaactaagctttagcttgcaacaattatgtcttgtatgaccagcagtgcttgtatatggagtactccctccgtttcaaaatgtttgacaccgttgactttttagcacatatttgactgttcgtcttattaaaaaaaatttgtgaaatatgtaaaactatatgtgtacatggaagtatatttaacgatgaatcaaatgatataaaaataataaataattacttcaattttttgaataagacaaatggtcaaacacgtattaaaaagtcaacggcgtcaaacattttaaaacggagggagtatgaagtaatctgctctgtatcaaagcatggtagtactacccaggtttaagagagtgaattctgtggttgctaagaacctaggactgactgactgaacatgaatgaaaatacctggatacataaaaaaaagtttcagtttaaatatagagagcatccaatttaactgaatatgggcgaaactaaaaattaatcaccagtcgtggggataacaacgcaaaagttgatggatcaaatgccttctgcatacaaatttagttgaccacaatgtaaataatgctactagttgattagctacaatgtaacagatacctgatttctagcactttttatgctctttaatctttagtaagccatcagccatccctgcacaagccaaaaacaaaaggaaacaaaaatcttcagtgatagcagttacaataaacatggtaactcacatacatcacaagcgtggatttaaataaaacgctagaaatatcttctcatcactgacataacatgacttgcaatatacacacataacaaaatatctgaaaaacttaaaaaagtagtcatcgatagaaaattgcagataaatttattgatcagagcagccgaaggggcacttttacccaagttctcccggttttgtcctaaacatataatagcaaaaatgtactccttgttgtacttcaaccaacaattaaaaagagtaagatccatgaatacatggcaaaaggaggccaccctgattcatattaccaatggattatgggagacccaaatcttactagtatacaaacacccccaaggagaactccgactaactatataattatctatgtcataaagctaaatttgagctaccttgcaatgcagcctactaagcgcaacccttaagaacaaaggagatagtttcaataaattacatctaggaactatccactccagggttaaactgagtccatcttgattggaaaatgctatagcactcttccacaccatgtttttaaagtacagaagaatgctcgatgcattgcacatatgtatttacaacctacgggtttgcaacaaaattatgagggggaggtgataattgcgccggttagctgtcttcatccagagagccaatgtaagtcaggtcagtcctcctcacccttacagaatccttgagaaagctgcaagctttcagattggcatggtcaccggtaacaccatttgcagaattgctgccactgttggtatttggacagcttgtaccgtcttccagcaaagtccaaggatctatttccatgttaggatcctgtgaaggcaacgctgccttgcatcttcttgagagattggtaggaatccaattgaggggaaattgttggtgaggccctgcagcagatgtactgcactggaatggtgatagtgcagcagaggacagtagaggaggaccacatgttatggaggagaggcgggaagtaggtagaatcggcatagccacttgaatccgccgcntgattgttgctggcaactccatgcgatttaatgcacactgcaatagagcagataatgcaaagaagccatcagaccaagtaaagagaagtcacaggcttgaataattgcagaaagcaaaagagagcaataatatgcaaaaactaaacagacctgcaagctcttagtgacctctttatcaattgcagaaagatcacgcaaaaatttaacagctggcttggagcttggcttagtcttcagccaacttggttggctattgccaagcaaagcttgcaggacacataaaagcctatcgaataggctttcacttggacaatcaagcaggacatcatccatgtaaggttcaagtgaatctgcatcttcatagaccacacgtgttccaaccaagcttaataaggaggaagctagcgtttgcctcatgttactacaaaatatccaaagccaaaaagttagaatatagcataaatatttcaaggacgtaaagtgcaactctgtgaacttaagatgtcacacaactaacaattaaagcaaaagtatcgcaaggaaagattaagataacttatttaagcatgcttaaactcatatttatcacatttctccagctattcatggcaatctagaggagccagaacccactcagctaactaatccagtcaagctcgtaatgcaagtgattcaattctctatctaaagtcgatgacatgattgtcataaccactgaaggcttgatttgcaacaacccactacccaagtactaaccatcctgcttaaatatttattaagttctgttagttgaattccagatgccactcgctgatatctactgataattgaaaagtagccctctattttcataaaggtgttcagattgaagtcccagcaaacagaaaaaaaaaaaactaaatcgctgactgttcgtcccagaccggttttctaatttttaggacaaatcatgtaatgctagaatgtgccacaaaatcattaaatattacctgtctgcaataattactggaagtagcctaatgatgaattgcaggcgcaaccatattgatgatcgtaaagctgatgcggaaggagtagttgaatcattaggtacagggctatgcttcctgatattcggactaccactgaagattcctttgcggccattgggtttactcaaaccttcatttcctgaaggatttgaactattcagtttattaataccgttccacactgctgctttaatatgctcactgatcacacccatatgtttgatcaaatcaccagcaaatacaaagcgaaactcgctagaacttctgtctatgcatggcaaaactaactcagcaagggcttcctgagtaaatatttttgggtagatccatgcccttctgggcttgtacccacatttagcgacttcctattactggattttctagaatcaatcaagccatcaacttctctttcctcaattgaagtaacttctaacttccttttggagcttttattagcattagcatatccgactaattctgaccatccccatggcttccaaaactgtgtcttcattggaaatcctttgcgctgagtcaagtaacaagctgttgtcttacagagttgtttcccaaaagaacatcttgcccttgtaagaaccatttgatacccatcacgaatgactcttgtagctttccaagaaggtgaataagttctgagtatagaggagcagcatcaggtctgacaagtagcctagacaaaataacttcagtaagccccttttccctttcagagagggtaaaattctcagcattaggggatagggatcgaagtgcttttacatatggcacattctttggtttctcaataagagattgctcatccaaaagcagcctcaactcaacccattgccaatggaactttgcaggctgtaggacattcagaatttctataagcctctctggaaactttacatcattcttggtactagcttctgcacaaccaggctctaaagcatatgtaccatcgtctctcattgttactggtatttcacaatcaagaagagcattcaggaaaacccgggcacgaagaggtgaaagagctttcaaacattcatcagggcttcgaagttcaacgattgcagcaaactctgaatcaccaacatccgcagccagaagatcatagaaaagatgcatgttacggaagcagacatctcgaaaaggctgatgtcttgtgatatcactaattgcacccagtagagactgataaagctgaatgtcttcatgattcgatgtactggtgtcatataaatatggtcgccaaaggaccatagcaaatattgaataagctggaggaagaactatacccaatggaagcgtccgttgcaaccttgaaaaggcaaggacataagaatcacctagaatctctgcgatcactccattataaactgtcttacagttccctattagaatcttaaaccaatgtaccaaaacttcagtggaactgtcaattttgaaatttccaatggagtgggtcacaccatttgtgctagctttggaaattcttaagaactgcagaatgtccaaaccttcttttaatcttaggaccaccatcatccgctctagactgacaaccccataaataatagctccaacaactagtgcagaaacagcagcagaaacttttacagccttaacattaaaacattttgacggattacttggaacttcatttgcatgatttccactttcatcatgggtctcagaagactgttgactgcggtgagccttaggaggagcaaaagatgctgcaacagctgaagaagcttcaacagcaagagatatttcaaatattctactaaatcgatcacctaaagtttctcttagcaaggccagagagtttatgtggatatccaaaatgtgttgaatcaagtttaatgaattaattgaggtaacacctggattgttaccacctgaaatatccaagtgtttagctattgcatgcccagcattgtcaacaattgcagaaacagcagaagcaactaaagaatgatctccatctggatttgctcctccattttgtctgatacagtctgccaatcccaaaacaatgtcatgagcagtttgatagctatcttccgtttcagaaaaagatgggttctttggtgctgtagcattattttcccttaggttgcgtaaaaactcgtcagtttgccgttgcactatctccttcatacttggaagtactcctgctttcccattcaattttttatggacatgcccatcaagttcttcacctgatgaaattccagaaataattgaatcaccagtgattgactttccactatccagttcagcaagcagccttttatcagatgtggacctaaaatttctttcccacctagcaacactagtcacatctctgtatttccttaagaaatatcgagcataagcaaaagctactgaagtagactgcctttcacctgacttatgaacagttctattcattgaaacactcaaaacctcgggcaaaagatccattgcaataaggatgttctcatacctgcaatatccaaaagacaaagaaaacaataatgtgaacagcaagattgattttttagaaacaataaaatcattagtacagttataacaaaatttgaacatgcatgtctggttccaactacagttgatccattggatactttgtactacaagatctcacatactcttcagcaaacactaagtttacatctgcagctgttgccactgcagtgtatttgcccatttttcacttcacacaaagaaaaatatgcatggcattgtagtttacacaggtcattgataggactcactaggtcatgatgaagtgatgaactacaagtagatgcaccaagagtgttttccaacaaagcattcaatgacgcaaaacagtccaaacatgattgcttgaaaatcagatgcattgccctcttcaaacaatcaccattaaaccatataaatgctacgtgtatataatgaaaaagaaacgccttaaaatattgcacaacacaaatacagatgtattatagtgtgtttctgtacagccaatgacatacgatgacttgagacacaacttgaaagcaccacaaagtatattggtgaatctgccatcccctcgagttgatgggatcttctaagggtgtgttctatactacatgttcccaacttctactccctcgttttccacgtgcacgctttccaaactactaaataggaaagttgctttaaaaatcatattaatccattgttaaaaaattttatagctaatacttaattaattatgtgctaatgagccgccccattttgcgtgcgcgggggagaagttcccaaccttctctcccttctcttccagacacaccctaaggatgaataaatatttcttttgtgcatgtggcttgccttttttggttggatgttcgcttgctaattctatatattttttccgagaaagatacaatttccaagttaaaaaatttgatatattatttgaaattcattgcagtgcatgggtattttgctagtttggaaagcgtgcacgtggcatttcagtgtctaagaagggccaaacagagaacacaaccgaactatattagtcataaatagtagtggcagaacagagaaaccaatagaaccatagaagccataaaaaaatagaatctgcccagaatattttgtgcaaagatggatgcaaaagtacaaaaccaacaaacagacagagacaacacaagtaacagtttaattggtgttttcacgcgtttcttttttttttttgcactcttttaccatttgcaaattcatgcaaagacaaatttggaaagaaatttcttagttacattataagtgaatttaaaggacgaaagtcaacagtacttcagaagaaaacaatagagaaaaaaaaagcagcttacctgagcaaggatgagaacagaaaagcttcggctacttggaaaacttggttttctttatgttttgggtgcataacacctcttccaacttgaccagatgtggtccttccaatataaatctttgatagaagccatataagcaaccttacagaggagagtaaatcacaacatgtatccattatgtacagcactgacagaagttcatcttctncaaaccctcatccagatgcaatttaccactatgctgcacagtggaggcacttatggagttattagccttagaatgtttcacttcatctccttcaattagttgntttatggacttcagcagccagattgaaatggatcttctttcaagcaatctaagtctcttaagtgatttgccaacttcagccagagtcaacatactcatatgatcagcgtctttaagaatgtcagagttagtgccaggtttatggtggggacacctcagattggttatcacacacgtgactagtagatgccccctggctaccatcgattctaccagctgcaaagtgtgctatattttgtgtctttgcactactgttgccttacctccacttgtttgttcaattgactgatgtattgtttcaacagtaaacaattcctgcttctgctctttccttacccaccaaaaatcttcctcatctgattgaaccaatggggacccttggaaaggaaacacgttcttatccaacttctgtctcttggtcctactactatccttacagccagtttttgcatgcccaacatcttcttctgagtctaccaaatctgtttgtcctttcttggttttttttgtttcttctcttcctgattcagccaagagtgtagagtatcccaaattcaacagacctgatatcataagttttacctcttctacttgaactgccactctgccatgattatcatctgttgaatccattagaagatcaggctgtttctgaaggcaggaactcaaagggaccctgccttcaacatttgcatcagtagccagaccacttgaaagctcagaaagcacaagtcgacgctcactagaatatgttgacacaatttcataaaggacttgatcttcagcaatcttagcttcctcaaggatattaaataagcaaaaccctggcaggtgcttcagaattttgtaatgcctcgttttcttttccagatcaaacaagctatcattccaaatggtgattccactaacaattagttgtctcacatatgtctgaggataaaatataccactgcgaataagttcagtcatgaaaacatccacacttttaaatcccgaagcatcactaatctcatgttgatccaaccagcatacaataatgtcatgcagtggacctgggctgctgaagatatcctttttgttattctcatcaatgctacctgtactgtctctaaatccagaagcagtctccattgctgtcaccttgatagaagaatgattcagagtagcacttttaaggtgatccttcattgcaagctgactgctgctcttggaagaagataaattatttatctcattcattttatccttcaacagggaaactgccatatagacctgagagaaatctttgcttcctgaaaattttacattttggcattgtgatgtacggcaatcacggaaagtacatgttgcccactcacaaatgaaaaacacagagcagacaagggataactcaacagctcccatccacatcagagaagatcgcaagcaagggctgacttctttaatccatgtttcttccatcagggtatctgatagataattgaatactgatgtatatgctgctgtcaagtttccagttacaagtgctttgtccaaagcttgcactacgttggctgccccacgaacttgaagattaggattagcaactaaagaaagatcagatgcacgtctttgaactgaacaaatggcataaccacaagagaggtgtcgagatgcattctgtctcctagagctagcaattttaccaccacctgctattttcagaagagcacctttaccgtatacatcaggagccacaactgatggaagtggaaagcaatccaaagaaacaaatgtatcgggaacagcaagtatcaagtactgcagtaactcaactaaagcagaggtaatggatgacctttttgggttattcttaacacttaagctgccaggagaagcatcactgagacgttgaatcagtatttccaccagcatgtggatatatgtctgtgagagggttatggtatcaaccaaagaaagtacaataggcaagagtaattctaaaacctcagttgagtctctctcctgaaaggaagtgggttagaaaaaaaattggtattagaagatcaacatagcacttgagaaacatcactaagcatgaacctactttatcaatgcactctgtacctggagctgattaaatacccattcgataagtaacgacggaacaagtaattgttccatgagatgacattgaacaatacgaatcatatacgaccatttaaagtgtagcgaaggctcctcaacatctgcactagcaggtgatgccccggtttttaacttaattgggctgtctccagcaacaaggcatggcaatgactgttcttgagaagatggaagtccaaaaaagccatttttagaacacaattcgtccaaaagcagctgcaagtattcaataacatcctttgtccagtgctgagatcgcaaactatcaggagcagcagatgaaacattattggatgatgtttgaacctgcaattaaagaggcatcatcaagcgaacatcatataattttctaataagcatgaaataacagaactaaattctagtgagcagtggcagtttggcacagaaataacggacctgattaaggtaagtaaccttcacaagccatgatgctcttaacagtgggacattatatcggataagataattaaagagtaacttcctccgaaaaccacgaggaacttgctctgctaatgaccatagacgcctgtttggttgcacaagggcctgcaaaggaatgaattacacagccatttcaagtcaggtggaagattaaggttgcaatgagatccctcgcagatcggcaagacaaaaaaagaaaagactttagagaaaatcgttttctaattatattgcagttagtcttcaattctaccaaaaaaaaagttggtaccaatgtcgccctaaatctgtagtttcttaaatgaaacattaggtgagatggacggcacagtgctcccgtttatacatagtgagtccagtttgaaatgcatcagtttgatacagtatgaaatgtttcaagaactcataatatacagaaagatagctacttaagatgaagggttatttggatggcacactcgccgcacttaattgtagcaaacttgcctcactttattcaataaagtgcataaatgaaatgaaatattacattacaggaaaagaagatgaaaatgacaggctaatttgattgacctcgatccattttctgcgtgtgtcttcattgctatgcatttgctctggatacatcccaggttttgtcagcaacgagccagaaagagggaccccataaacttggccagcctgttaggaaagagtatttggaatattttagaccaatattaactttaaaaagatcaaagttttgcaggaaaaatgtaaatagatgctagctatctagaattaggtggtaaaaatctaattaatgcagttaagtccccatttgtcaaattttcaatacaaacattttgaagttgtgaaatggtttaacaaaaaatatccttatttacagcagagatcctaatcatagtaactacaacaaatcaaaataccttcctcttctgagcacgagattcattgatcgctctgaaccgcttctttagtgccttgataaataaaaaataaaattgttagtcaaagtataagttttttcacaagacatatcagttagagaaggaaaacacaataatcgggtaggtcaaagggggaagaaaaatattagattcaatccattcaaccattcagttcaatccatcaaccttagggaaaagaagcaattcttcagcatcttccatatggatctacgtattcacataatattaatcctaagtttctgacagactatgcagccagtaacaatccaaaggtggcaattatccaaaattagcaccaagtaggctgtagagtattggctgttaacccccctgtgatgcatatctcagcttatatataaaagatgtgattcccataattctacccatcttagttcctgatctccagcagcattcaatcatgccgcataccaacctacttctcacttcactctgacaggaagaaatgttctaacaacataagattgcatgaaaaataaagctagttaggttgatgttggttgcctttttacctccttgcattttgtagcaatatctggtttgctcaagtatggaatctgactgagtacaatctctctggcttcctgtaaaaacaccaccaggaacaaatttcagtcaaaacaaaacaaagaaattgcggtcctaatgtacacaaaattatggactcaagattttaatggcatgagactcgtgaaaatgagacaaacaatatatgaaacaagattaaccctagataagcagtgtcacaaaaaagggataggatttgaaacttttggtttctggagcacacctcaattccttcaacggtatccttgtacccagattgcacatattctttggttaaggtctcttctgcacaactcaatgtctggggatagaagtcaggtgcaccaagcctacaaaatccatagtacaaaggaaacactaacttttagttgttttcgaatacaaatatgcaacttctccatgcaaatgaaaaaaaagtaagaatattgaagaatagaaaagctagatatgagaaaatggaaaacatttatgtacatagtcaataagacaataggaacaaatcagttgttgagtaaaacatgcctggcattgagtgattccttgtcacacttcagcttgtaaggagctaccagtggttgccgcctgaaaaatagaatcataagcatattaggaggttcatatgctcatcagtcagcactaagttaatgtcttaacaaacataggtagaaccttagtctgaacaaaatgtagaaaagtcctttgaaaaaaattaaatgtggaagatcatacatttgaaagtgctactcctacaactaatacccccattcttcctgaaagagagaaaataaaaaaggaaagagctaatgttctcctataatttcttgctgagattttaaagcaaaattgatgcaaacagaactattcgacggtgttggcgatagctgtttcctagaatcaatattctagcaattttctcaaaaaaaatattccagcaataaaatattatccatgtgagatgtcacagtacagcattggccatggttacattctcagctggtgcaattgtagtttacccgccactaacaaataatcttcccatcttcagctggaaaataagaagaatacaatcttgtcatccatgccaatctaaatgcatttgaagtccccataagaacaaccatcctataaactacccgtcagttacttggttcaaccatattgcttagcaaggtgcaggagagatgtgccagagtgatgtaacaggatcttgtgtttgttatctttgataatggaacgtggggagttaccctcatggaaaaagcattatctattgatcaataggtataagctgatagttacattatgcaaacaggttttttgtctgttccgtttgccgacctctcaaactgctagtaagaagcctccatcagccagaataaggtaaaaagtactccctccatcccattttgatcatttcctaaagtttttgaagtcttcctaaaatgatcatcatctaacaagtgtctttttgtttatttgtgcaaagagtacatgtgcatcgttgaatgtgttacatgcaaccaaccaagattaatttctattggtgcaatggcatgcaatatttaaaacatgagcaatccacgggacacgaagcgatgaaacactttaatcgatgaggattaatttgagaatgatgaatattttggtgtctttggtcttggtgtcatttacttagaggatgatcaaaatgtgatggagggagtaacaaccataaaaaagagcactgtacagtgaagattgtttgacctactaaagaacaaaatgttttctctttcatttaccataactaacagtgatacgttttcaaatgatatcacaccataaaaattaaaaaggcaatttttatgatattcatctagtttttgaattaaaaaaatgtccatctgattcaaaggacaaatcccactagagtagactgcgactgattttgattgaatttttgttcagaacacaaccatctctagtgccataattttaaaaatggacctgatcagcagacagtgactcatccaagttggacacaagataatcgaagcaagtaagcaactctgaactggtgaaaatacaattcgatgagctagtttcatgatatattgaagcagcggcggattcagggcccagccagcatgggcagctgcccgggctcccagtctttgccgcaatggacttcggtgctgttcctctgctagccaatggcatttgctcccgggcaacaaacggcaccaggcgtcatgcttctatacggtgcagtttgtagttagtatggtgtcctgcacgactatttgagcaccaaagcaggcttttaattgtgcactagtttaagacaggtagaaaaaaatggcaaacaagcagaacatgttattggactcctgatgctgatagattattgtcagaggtcactatctctcttctgctttgttatattttttttaaaactatggataattaatacctaattaaccataccctaatcactcgtctcgttttgcatgtggaccataatctcatcatagatgtcatctcaaacacagcctaagcatgctcaggctcaagaaaatttctggatccaccactgtattgaaggaatcaattggaccgactacttcacaaatcacatcaaagggtttacatgcaacatgggtttcgaaactgggacaatgagcttgaattaactacttattcataccaggaaaattgtgactgtttctaccaaataacaatcaagtatcatttttccatcttttcattaaaccaacagttgagctgttaaactgaccaaacactgaacagtcaataaattcaccaggatgaacactggcaagacttttgaagcaacaacaatggtccaaaagtttgctattgtttttctgaattcctttttatattttgagatgttccttttaacttctgtaagaacaaggttttgtaacagactacatggcagtggccaaagtattactgaataatatacttaaaaaaatatcagtatgaagttcttgtcttcttgatatgagatggctttcttcaggttaggtcatcacgagtaacgacaaatcacagtaaccattgccgtggtcacctactggttgctaacgttgccacattatcgtcacatcatcgtttcttctaccgtaacgagttaataacttcacagcaatcactatcagcaaatatcacagtctacaaagccgaatgcattggaaacaagacaacttgagaggggaagaaaaacagcaaccacctcaagttcgcggggtaattggcaccatggaacgaagaaggctccagcctgcccttctccctccctcctgccaccacccccctgcctggcacgccgccgccaaacccagcattgtgcccagcgcccgtgtacctttgcatcttccctcgcaatcaccacaacactggcccagccatggcgacagagctaacgcaggccatgcctgtcccaactgaactcccatttttattaaaagaaaataaaaacaaattggtattagtaactccaagcatcgaagcaatccgggggaagagaactgcatgtgctgtgtttggaatggagggcgaagaaatcaatccatgtcggattgatctccattccatccacgcccgcctcatggaagcgttgcgggcgaagaggaaggaaggaggaggaggaggaggagaatgaccttgaatccgattcgagccgaggcccgcgccgcgccgcgccgccccctccgaacctgttcgccggcggcgcgcgcgacgaggccgcacagggtggggaggaggcggctagggcgggcgggcggccggcgcgggcgggaaggagagggcgagccggttttctcgccgtgactccgggcctactcgccggcggcgaaggcggcggcggcggcggagacagagaagggcgggggcgtgtgcctccggcactgccgatcggaaaacgcacaagggagatggagagaggtattggagtggagagaaacaaaaatccaatctctttgaaattgtgataattgattttaaattggtttctttttgggttatttatttgacaaaaaatggcccctttacacgtcttggttttgttttcttgttttctttatttgtttgtattaggtgctttgggctaaaaacaaattagtaaagtataatagttggcgtagagatattgagaaaaatgaagagtctatcacgcaacgagagagaggcccgtttgaattcacatggatctccgtagcacgcacaacaaactagtttcaattcatgtgggtctctatagcacacacaacaatctagatagattggagcaaccgtgttgtaaatagatgtgagaaagtgaaatgcttgttatcaatagataaactaatccaagtttgtggggatctttatagcgtacacaccaaaccaagattatagatctataggaaccaactcaataagaaagtagtaggaagtaagcgaaaagtcaaccgtcaaaacaagaaatcaatactattttggatagatctcaacaccattggaaacaagcttaaagattagcgattgccagggtaaaaataacatggagaaaaggaaaaatccataaaaaaagataaaccaatccaagttcatatgaatcttaacagcatcaataacaaactagatggatcaatgcaacaaacttgagaaattagattaaaagcaaaagcctgtctcctctaagagaaaccaatatgagttcggatagatctccaatctatttcggttcaattacggagtagagggcttgaaaaactataccttttagtcagacatcttggtggaagaggctttgacgatgtaccagaggagagaaagaggaactgatgcgagaaatttgagatgaatagcgaatagaagatggagtgacagtgagagagagagagaggaagatagatacctcaagggaccaaggaggggtgtatttattgttgttgctagtgctaagcatgtattgtcgcctgctatcatatatgttgctctgacgtcatatgcatcgttcacgtttgccatatcctctaccggtgactcatattgacaccctctcatcatgctaagccaagcttctccgtcatcaagcgcaccgttcatgttaaaacatttctaaggttgatgactcaccttgacaatcgtcccattagatatgataagtatgtcatgatggcaactttcacgtggcgcatatgagagtggaattgcatccctcattacacatttgtaatgtgctctctctatatataaaaagagctcaacatcgtcaatttttttatttaaagtgcaacatgctaactcccttttctttcgactttggtaatctaatatatccttatatctttcatctttgctaactccttgtgaatttgttgaatagattacataatgatcaaaataatttgaagtgcccatacttttaatctcttaggacatttttttttgctagggacatttcaaatctctcagactcttactccatccttcctaaaatataacaacttttagccctctgggtttgtcccaaaatataacaacttatccaccaacattctattcccaaccaatcacaaccttccaccattcacttttcccacatacctccattactcattcaatcacaaccctccaccatttaattctacctaatttcttaataaccgtgtctaactataaaacttcatatattctggaatggagggagtaccttgttaactgcagttttttttttaagaaaagaagaagaagaagaaaagcctgttgctgttttgcacaagcacaactgcgaacgcgagaggtccagtgactagtggtttaggcccatcttgcagcagactgaaaataaaataggcccagtagcccatcctcacaagcccataaatatccggcagggctagtggtttaggcccatcttgccgcagaatccgccagctttattaattattaacctcttctccgccattttttcgctccaccattttcgttctcgcgctctcgacgaaccaaccatggcggacaaagtgagaggatcgtgttcgtctcgtcgcccaccgaggagaggagtccgctccagcctccagctgcagaccagccgactaggtgagtggatcgatccccaaaatccaatgaatccgcgttctcttttcggggtttattcggttggggatgtcgaaaatcggcagcggcatttgggagtagtagctgcggctgccctcgtacgtgccgattgaagggagggattggtgtttggagtgaccgatttgccgttcgaatgcgtaaaatttgggtgaattacgcgagagatttgataatttaacactcttttcaatgggtttctattatttgacatcctagcccactttcattcactcagatggtcccatatattatcctcacaaatgtcaattaaagtaattggacaacgaagaaagtgtcaaattatcaattttttcgaattaagcaccgattggtccattttgtaggaataatttgaatcgcttcattttattttattttattttttgctgggttgttgggtttgggggcagtttaaacccaatgcggcatacatggggatctcacggtgtctggaattttgaacaacggatgaactgcgtcctgtgccgactgccgagtgcttgggtggtgtgtagtgaactggttaatcccaagctcccgcctcccggaacttctggattgggtggttttgacagctgagccgcgttgcaactaatgtagtttgcactttcactcacattaggagttggattttggatctacttgttttaccggttggtgtgcatgttggcaattgatttagtagggatgcttatttctcatcctttcagttgcacaaatttagcgcgcaagtgattctgttatttgtgctgtttggatttggcatgctcatgcttcttggaggtttacatgtattttgaagcataattcaaataactgaatgcatgaaaactgtaagcttactgagtgttgttcaggaaaagaaaaaacctcagtggaaatgtatattgtgtgatttgtttagaaagccttttacacatgtacttacaaatacaaacatgtacattgaagtgatctagccctctttgttgacaagcgtatcggggtaaggttcacaaacatgcacacaatggacaagagaaaaattcggactgctgtatgcctgggtgcctagaggcatggctgttacagactggccaatttcatccaaacaaactgaacaagtcagatattcacagcattgtaacttcagctgtcattcacaagaaactgtccactccagtcagacatttggaccagtaaatgtctccccaatcacatgatactttccttgggccgccagaacatagtgcccttgttattcttccgcataaaatgggttattgtcagcatcaaaatcaaaacctctacagttcatctacatactgcctatactcgtcacaaagcaacactgataagggatctgatcagaacttcaaatccacaaatcaaaaaccgcctcatctatcaattcatctaacacaaactcccatatctccacgacaattccttctgtctttgatctaatgtccatccatgcctgaacctccaaatcccttttaattatctgttccaatgtacttgggaaactacacttgagataaccatcaacatatttgtcaacttctgagatgagtttttctcctaccggaggtgtccgtatgtcatgtttgacaaaagataaccaagaagagagtctaaaatatctctcttggatctctgttagtgcttcacagatgcaatcaaacaaaatcttcatatcatctattcggtccccttgattctgtagttcttcgaacatgcaagggctgattaattcatcctctagataccacacctctaaattttgctctgcacataattctgagagctctagcaccagcattatataatctaacctggcattcttatcctcccaaaagacctttacacctgattcattatctgggaagtacagggtcccacaggaaacttcgtgcagctcatctgtatgtcataaaatggtgagtaatacagatactagagtacataatattttttatctgtgcagggaaagaagataaactaatttaaaccattgttcttgcaaacaattgtattaattggacttacattttttcattgttttgcattcaggagagctgtcatcttcatcgaatgaatcaagaaccgatacaggacttggctgttctttcttctcattgctttgctcaggacaaccatctggtaattttggtgatgattttggttcaggtgtttttggatcttgttgctccaaattttcaaccatgctctcaggagagctcatgaacatttgaacaggttcttttccttcagttccttctaatatttcctataaatagaagtatgaacatgtacatcttaaaatacactaacaaaagatggaataaggctaggcattcatttgagcttactggcaaggggctgtctgtgtattgttctgctgggatgcactgtatgttgcaaattgttttggaacaatccaatttgccaactccttcaacaggcacggtgtctacctcatcagtagcatatatgatacctgctcaatattcagagttatttctatttaaagaacaaaagagcactacgcagaccactctgatgataattgtgaatactaaagttaccttcttgggtgtcttctttgatgccacattcttctagaaccgccacctgatcatcaactgctacactagtactatatgcattgctctctgagttatcatgcagttggcttctctcttgggctggttcttctacatcaacagcttttacaagacaaacttctggctcttcaggtgagaaggcattgtggcattttcccctatggtcactcctaggaggtgacacgttgtaatgaggttgagaaagcattccttccaaagattttgatacttgggctgtcggatagctggcagattgactagtgttctttagcatatctgctaaatgcttcttggctttctcatagaagatagatgctcctgttgtatgatcactgatttcactctggctgtcattttgttgcttttgcttactgctggctgaaggtttgattccattcttaaaatttgatgcagctttgtctggcaagctcccttcagtgagatgtctaggatccttatcttcaacgacagaatctttgagctgatgtgaatctcctggaaggttctctgcaggtattgcatttttctctcttttgctgtcaccagtcacaattttgaatctcctcctgacttccttgattgaaaattttgagctttcccttccactgaattctggagcttgcgatgtacatggttgctgatgtaaatatcttgaacttgtagtctctgtctcatcaatccgtcttccttgatttggctttagtataactattttgctaacaggctggggtctattggctctttctggcttttgctttctatctgacctatcctttctccagaagaacacatgcttggtctctttaccctgtgcttttgtagccaactcatgatttgagccccttttctcttcaagaatactagaccgtccaagacttttgtcaggttctaacttggttgttaacctgctattttggtattttcggatattgtctaatatatgtgaatttggcttctgaagcagcttcaggaaaagttcattgtttgaactcagtatttctaccgcatccttgaattctttgaattgagctgccctgctgttagaacgactattctcacccagtagcccttctcccttgctctctggagattgctcattaccatgagtggcatggggattatttaaatcattgagcttgttatggattaaggacttcagtgaaggacacaattcacccttattcttgcaatcaccatgcgggcattcaccatggcacctataaatttcacctaaaaaatttgccaagacagattcaagatcatattcttcagaatgattcaagctcttggaaccctgagaatacactgatcccgataaataagacgcgaagatgtccgtgtgctgatttaaggctgccactggtttatttgtatgctctgagcctccatctagggagacatcatatcccaagtcaggtaatcctctttgaatctcattgcttggaatttttttcaaaagatttactttccccaattcgtcctccataagttttttgactgttcgtttctgtgaagcgcattcttctttgttctgaaaagaagaaaagtaaaatgatgtttaggaaagttgcgactttcagatgcacgcataatccagtatactgaaaacaatgatttggttgtaatacaaactagccattgagttgctttgtaacaagatgctgtccaataccaaattgtgtcagtgttgctattgataacaaagatgattttggtgtttatggttaaaacaacaccagatcatgagacagttacttgcttagttcttgtaacttacatcatcatcatcatctgtttccacaaaatcactggaattcttaactgaatgccttccgtctgaaaaatacagcgtacatcatcagaataatcatccaacagcataaaaattggatagaaaatttatgcgttactcagttgaactatcgtagcaatcaccattgactaattctcgactgtaaatcagatgcactgataggtcttatatgacttcaacaagtgatgcagagaatgaagaaactacgctgcacaggctcctgaattaagtaatgaagccagcaagaataaccaagtacacgcaaacaaaattttgataacattagcattttttttcttgtttttattgaaaagatagtgagcattgggtcaaatgacagcattttttgaagtaatagaaacttgaagcaaaacacgtagctttttccgtactgctataagaaactacaacttcatagcaactatgattactgaagaaattacctgccagctcccggaacgtatgcctcctgctcacttgctttgtatccaataagaattttgcatcacgccggaaataaagcatgcgcatgaggccccacacgcagcctacattgttttcctcttgttcagtggaccgcttgtggcttcgccttcccatttcagataatcagcgttctttctgtagtggaaataacttttcttgtatcttctattgattgttcagttcatcagggagttcaccgctagccggatttcagaaacactgcatgcagatcaagatcagcaaccggacatatattgatggaaaatggcaaatatctctggagaagccaaaacagaagaactgtgctttgttcagcagcataagggagatggctggccatggaaacctgccatccaaggtatcaatgtactgttcttgtttttcttatattaaaaaagctaatcgtttgtacaagctgttaaaccaatccaattaattaaaagaaaacatggtaaggactagggagaacccctgaatgcttgactgaataatcaatacagaaccatggtaaagagaaacctgatgtcaaaaaagaaaaaagaaaccgaaagtttcagttaaatttctgtacaaccaatccaactaatccaaacaattagttgcataatatttcataagtttcccccctttcgcaagcatgggagctcatcaaactccccacttcatggattaaaacagaactccaaactttcaagggttccaaacaaagcagagacaaaacagcctaacagtacaaaaccaacaagaagcacatccaagagcagggcttcatgcaaaacctacctgggaatgcagagatcatgaagagaagctccagcaaccggccctctctttctcccctcctctcctctctctcactcagcaagtcacatacaagaagagccaacagattactcagaacatgttcttgaccatgtgaacaggcgttgggacctgcaaccttgagctgtccatcctttcggcaatccggcgacgacgaaaggaatcggaggcttttcttgcgctgttagctagcctaatccaattcctggtcagtatcaggctatcagctttactctccctctcttcttcttcagtcttctcttccctttgttttccttcgctttgctttgctttgtggaatgagcgcagcacgctagctacggcaccacagcagcccaccacatgccatttctcaagtagaatggactttcggcaagtgcgccaccgctttccagtgcagaaaaagtggcagtagacaatagctgcaagcaagttacaattgctggacctaactctgattaatggctgtgtggttaatccctgtggtaataataatggactaatggtaagtagtagtacaatgaatcctgtgggggcacaccgatgaaaaagattgacaccactaccatggatggaatcgtgtaatactaggcaatagaaatctttcctttgaaaagaaaaataaataaataaattggtttgagataatatcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccagttcaaatgagtacattacaggttcataggagtacattacatcacaagctaagtggttaacagaatactgaaacatcagtttcacaaaagtacaacattctggaataaagacaacagtacaacacaaaggtcatcaagaattctggatagtggatactaaattactaatatgaggcaatattgcaatcttcatttcttctagtcatcaatcatcggtctcagagacatagggagagggagagggtgacttatcagaatcagaagtctgcattggaataccatcatcacaatcttctgagtcggatgatggagcttcaagatgcactggggcattgcgcatcaaagactgtaggcttctgactttcctcttcttagcgtgcacaggccttttccttttagctggtgctgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaaagctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgttgcataaacattacacaaattacaacaaaaatgatattcagcaataaaattaagttcacatgttgagatctgaacctggattgaaatttttgttctttcgctgccttacggcaatttcgtgtccaaaactcccatgctgatcttgatacaagttgagttcttcaattattttgtcttggatatcttcatcatcaaccaacttatcaatacaggaaatcacacctgctctaaatgatccatcactctcgatctcttgcttatttgggtagtagtagtaggggttcaaatagtacccagccaggtgtagtggagtcttgagcttgttgtcccatcttttatcaatgatatcccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatctgatcactttgctggctttcttccccttggcctgcttcaagtaacccaattgctccatctcatctgatttaaatagtcttactaactctttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttcctttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttcctttttactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataattcacatatagtaagatctacatcataaggcaagtatctgaaattagaggtaacaaatatggacaacttgttcacatattgtaagatctgcaacatacaagcaaaaaagagaggaggatgtgagaactgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgctcgaagcagcagccggcgccggtcgcctccacgagccacctgcgttggtcgatccgcttgaagccaccgccgccgccggacgcctttgcgccgccgccgccggccacctccacttttcttgcagctggagagtgagcgcttcgaagttggaatggatagtgtgctgctgggagcttacgagctagggtttgcagcactttacccacctctcgactctggtctagttgggccggtttcctcttgggccagaccggccgtgttttacaatttagctacgctaaattacggccagtttagcggctattgccggctaaatggcgctattagcgtcccgctattcttagcgctaaaaactgcatctcttagctccgtccgttcccagcagctatctccggctatagcggcagctatagccagagatttaaaactttggataatattgacatttttgtttctaaggcccttgctgaggaaaagccaaaaagaggagcgcgtgttacatgtcaaatattgagatggcgattgagtgctactttgctagatgcccaatacgacacagactttaattgcccagcgacaatctgcaggggcgattgatagtttgttacctgtccatccgagagagagatgctatacctcacctccgattttcagagagcactagttttaaggaaaaaaagaacttgcaatatctgtttctgcctacacgttctatacacagtgtagtgttgtgtactctgccttgtgcttaacaatattccagataagtctacaagttaaacaatcaggtaggagtaaaaaagtaacagtatgctaagaaaatatgctcttccaagatcagtttgtttgatatacagctaatttttgcaagatgcattacttatttcagctctcagacaggagttagtggtttagatgggatctatctggtgggccaaatcctgcagttttctatcctcgctttacacctggaatccgattcaaaaggcaacctggaccccacctgtcagcgactcccatccactattccaacagggcttaggttagtgtagggacttaaccctaaataatacagtactcctactacccttgcgttccacggaaggctgctgttgtgacatggatcgtgtgtttgtgaggtgtgatgcaggacacggagacagcggtggcctgacggatcaccggagcctttttgtcatcaccttccctccggtttggttggcctcacgtacgccaccaaaccaaatagtagtaaccaaatccgttaattaattaattattaactcctactttggggaccaaatcagccatcagatttctcctactgaatagtagcaataatatgttagctcaatgcgatgcagtattgaggtgtgtgttggtggtgattttttttctttttgaaacctaagccatctaccgctggttttatattaagagagggaaagactgtactgatgttggtggtgatttgattaagatattactttggttggttgggtggcattgtactgtacctgcaaactactcctacagctacatgagatattccctatctttgccaatcaaagttgggtgtacttaggaaatcaagttgtggccgtccactccaatattgttcttgtaagaaggaatttctttagttcttttgtagagatttcagaccctagatttataatgggtacctccaaaatatttttgttagaagaatcacatcatactacatgaaaatctaggccaggcataatctgtgagcatgtagcagatagtagtagacaacatcatagctgtctgcccttcatcaattgataagtctctctaaattatgaccatctcgtccccatgcaccactcgataaattcttgtcccagaagaaaaggggcttctttgtgtatcattggattcgattgtgagcggggcatcatgcctgcctggatcgaggtttcgactttaaagtatgctgtagcttggctgatcatggaaacacactctggatgagacaacacctttgcaaaactgttttcgacaatctctcattgagtcctgtacagtcatctgccaacttttcttggtacagtatttctttcaggaaaagtgagaattatttgtgttgcttacgatacgctactatttgtccttgggaaattttgatacaaccctgtatgggaggacgatcgagcaaaggaaaaatagtgtaatttttttcctacacaggatttctcttctgcttaacgaatgaatggatgaatgcaattacacatgcttcttgagctcctaaactttacaattctgtgaaaactttatatgaatttcttaagaaatggttttaaatccgttttgaactttataattaactcatttatttgtactgttgaataattatcacaagtcaataagctatttaactatttgcccgtacctcttttctcttcctttcagaagtctaagctacatggctccgaatccaattaaatagcaaaaacttgagcaaattagctatatcaaaaccctcctttcttccaacgtttataatacatgatatcttttgcatgcacaatcctataattccttcattttccccatcatgtggttttcaatcatacagaaaacgataataaaaaaaaaaatacatgcactatcctttttcacgaacatgcaaaaagattgcacgtcaatagaaggaaaatagttgttccacaatgtaattagccagacaggcttttgccaggggaagagagaaaaagcaaaacaaaaattgcagctagaaaaagagaaaaactactactgtggctaaacgtaactccgattagcacgaagggagcagagccatactacattcccaagaaacgccaaaaataacaatgctagctaaaaaccatagatgaccctccgagaggatggacaccataacaactgagaccgaagagagcgcagagtcaaaaaccctgaagttatgttccttccacaactgctaagagaccaggaggaccaaggagtcgaagccggcgcgaatatgctcaggtaagcaggccctagaagatgtacaccagacctgaagccagctgtcaggggggagagagggtaagcctaaccaggaggtgacagcacacagtgccagacctgtcgagcgaacacacagccgaggaggatgtggtttgccatctgaagatcctgattacaaaagaggtaggctgagtggctattgatgccacattgccactatctccaggtacaacaaaactttaagatgatggcactctttgtataatgatcacttctttcttgtgatcaatctgcaaagcaaagaatcgtcgtgctggcttacaacaagtgtcgacaggggctcgtgcatggtggtcacattcagggcgaagcctacacactcctgttaaatctgatgaaccccagcctatgaactcctattaattcatctgttcgttgaatccccctggtcctttctcccctgcctttatgtctcatccgtctttgttaaatgggggccgtgaaacgcaatggcttagacgcatagtcatcaggttcggtaagatcctaataaaacgattgttaaagcaaagcgtagtaccgagtaattataatactgacagtgcttttgtgtgcttagcttgcaatatactatgtgttcatgcagtatggtcgatcgctagctgtcagcactatactatactgaagtgatgcgataccgtaatcttggcgttgagtagagctagcgtctctgtctgtccctgtctttttatcataagtttctgaccggctgcatgtacgcattttgccgagcacaggtcacacaatgacaagagcgtagggtcgtcaacaatgcattaaggcataacgaatataaatcggatcagttgtgagctgtgatctggggtgtgggcccgtgggtggtgtgggttggtgagacagtgagtttctttgttaaatgcctgattcgctgtagtagaaggggagagatgggatggaaggaatatattgactatcagcagcatctactgctactatatgtatggccgatttaaaaaagataccagtcactctgattcttgttataagttgttttaattttttaatcaaattaataatacattttcaatataaaacaaatatattatgaaaatatattcaatgctagatttcatgaaattaatttggtgttttagatgttgataaatttttctataaatttggttagattaaaaaattaaccagaaaaaaggtaaagaaaaacttataatagaaccgcagggagtataatccatagattattacaactaatatctatctgataatatagataaattaagtatttaaaaataaactcaataaataggttagaataattggtctaaacaacacatttgaaacaactttttttagagaaaatatattttgaaaaaatgggctaaataatctacggtaataatccaacaaagtagaataggcctagttgtttgctgaccaattaaggcctcctatggcaatggcaagctcgggatgcgatcacgttgcaatttgatcgatctacttcaatttttcggaggggtccaaatccagggccaagaaggcaagaacatcatcgatatcaaaatcttttgaattaatttctttctttcttttcgtgtgaagacaatcaatgtataaatagcatacgggatcaatgtgtacgtgtacgacgaaacacatctaccatcgtcgtgtttataaattttggagagaaaattgttgcaaacaggcacacaaaactagtataaagcgtcatagtaaagcattgtaccgtggacctagctatgacctgatttgataataacagggaatcgtgacagaacaccttcgctagctagcctcagacagttggacccatatctatttctactttgattgcgtcatatttaagcctttttctacgatctacgctatattagtaaggaaactcatctatttttctattttgataccgtaatagctaggaacagcatgttgagatgaaagagtgtaaatggtgtaattaattcattttctagcaaaagaaagaaatgaccgtggccagccacgttgaggcaccgaaattaccgatccacgggaattagaccgtagactctgtaattcattaatttgagaacaaacaatgattgggaaaaaaatccatgaactatataaatactcctattgtttttcaatagatgacgtcgtggaattttgaacatacctttgaccactccatttgtcttattaattttttttgcgcaaatacataaaatataaatcatacttaaagtagtttttagtcataaaataactcataagaaaataaatgataattacataattctttgaataacatgatgattaaacatgtgtcaaaaatcaacgacatcatgtattagaaatgggtatattactacttaacgttcgtatggttagtttcttcattcatcattttgccggattttccttttttgtctgaataagagcacgcgcagaggctcccaaggaaaaagatgcagcagtgtaggtggagggccggtaagggcatactgggcctcggttgtctaggtattgggcctagctctccggacgattggtgaaactccaacaaaaccgacgaacgaatgtccccaatggcctaatcttttcttagtgtccggagaaggattatttcagcctttttaaaatgtactcccatcatcaaacaagtgttaagcatatttttttctaaaaaaaattgatcatatttgtagtttttatgtactaaattaattgttaatctaaaccctagaagccatcataattcattggttgcatgcatacatatagtttattggttttgttaaatggtggatgagttaattcctccttaattttgatgataaaataaaaggttttatactttttagatgtaagagtactccgtaggtacttcggtagagtgtatcctatcatcattcacgttggacgtggtttaggggtgcgttgtcaaaaacaactttttcatttgaaaacagtgtatatccacttattaatgtagaggctggttttttttatctactagaaaataggcgtgtcatgtgtgcatgataacgcggtcgtccgagtccaacttaataaagcatcgtgcgtgcacaagaacgcaactgagtgcgcttaggacacattttttttctcacccgcatcgcttccccacgcaaaaaccaccatattcagtcaatttatactattattatatttgagcttgctatgatctaacaagttaatagtaaaaatcattataatgaaaatagataaattatttttacctgttgcaacgcatgagcatttttgccagtacatcttaaaactgagtcactggatcactgaaccgatatctatactttctataaagttacagcccactaattctaaatctcaacatgcaaccatgccacatcatcatctattagcaatatatatatatatatatatatatatatatatatatatatatatatatatatatatatatatatatatatatatatatataatctcatgtaagcatataacattatctacaatttatttaattccataaatcaatatgcaagcatatccaataaccacactcacatcatttgcacaatattttaacaaatatatctattatttttataatatttaacatatacttcatgataagtactaataaaccctgatgttttactaacaaaatatattgagaattctcgtagcgaagcgtgaggaatcacctagtatcataaaaatgagcgtcaatataaacgtctcgctgtcgaccgtggtccgctctgcagcccttgccaccgccttggtgaggcaggcgccgtcggtcaatgtagcagccagctactcccttcgacctcatagaaaactaagctaatactggatgtgacatatcctaatatttcgaatctgaacataggctgattttttatggaacaaaggcagtacctaatcgatttttgaagttcattcactcatactcctagtggtattaatatctcatatctgtctgttttcaacacatagcacgaccactacgagtagaatcccttaaaaagaaaaacagatggaaaataaaaggcagcgatggtcttgggatgtgaatgtctcatgtgttttttttccctgaaaggctgaaactaccatcaaggaacttgtaataatagatccattacataaaatattcatattcatcatctagacctacgtatggaaagcagacatcactgtggccacccaaatattgagcacaagtgggatgcctaagttccaactcccaaacttggcacccaaaacaatgaactttaaaaaggaaaagaagaagagttattagtacatatttaaaccaacgaaagaaaattatcatgtcatgtgttcacaaaagagagaaacagttgagatccacctcagcaaagaacaatgtaagagtgccatctgaatctttcaccacaaagttgtagtgtgcatatactttcccatgttcatcaaaaagagtatattctttcagttccataatctctaactcggcaggctgaaataaacataatgatattagtccagatatgtaaatcatttccaactcccaacccataaaaaaaattttcaactttgcccaattagcctaggcaaaactaacacttctagaacaagacagatttagaaattttggattgatgatcgaaccaaaatatatcgccattaatttcgtggttccataccggcatatttttttgcttggcatacatgcgtagtggtattttcaacatcttgcattcatcctgtcgtttgcgtttttccaaatcttcaggcaatcgccacttctctgcgaagggcttagcatagcgttcgcaggcagcaataaaagcatcggccagttcctggtcatttttatatggcgatgatcgagtggaatcacgattgtccaggggctgtaatcccacatattctcccccactgcaagtggatataaataaatgtaaacagaagcattcctatagcttgctattctcctacttcaactaaagcatgcagtgaatagattatatttctaatactaggcctgttcatttaactattttgttgttttggtacacaataaaaacttggcttagcttaccaattgaaagatggaattcaagctaaggaggaattggctagttacacatcgagcaaaaaccttaacttttttccttttaggaattcaaggaagcttatggtcctagtttttatcgaggaaatagtagaactactcatatatatcattaaagaagaagcaaacaaaggcagggaaagaaaaatcagatttcagcgaatgccacaaagttctaaaataattatggtttcacatgtttggagcgtgcacagtctttccatctttcagtgttttactctagccactgtggttcaaatccaaatcctgtacaaatatttatgcacgcacagtgcgcgcttcaataagctattgaatattttaatattatggaattttccaagaatctgaatgctagaaagcctagaacgtttgctaagggtatgaaactcgtcagggtgtgtgagttcgcctattccgtgtaacaaacaaaattgggtgcctctttaatctcatcatggaccaggttacagcgagcacagctgcgtagagcctgcaatctttaagctaaaattgaaggaggccacatacctgtcatcatcaatttttgggatagaagtatccgaatcgctgcccggcaccgagttcaaatccatcaagattgcttgttccttcacaaaacgaaaaaaaaaaacccaatcagtaagtgttggcagtctgcaatgcagagatagatatagtccgcggctccgggcgagttggggatcaacaactcgtttggggcgggcaatcgcgttggcgcgaggggatcagcagcagcagcagcggatgtggcggcgagggcgtgcagtgctagggctcggtcgcttacactttggacggagaacggcagggcgaggaggggatcgaatcgggcggaggagtgacggatattttcctcggaagaagtatttatttcagcctcctgcctgattttcccccacatttgagtaggtttccttcaagtgtatccgatcaggattactacaccttttggtaagatacagattttacctttctcggtaagatacagattttatctttagttagcatgttttttcaactactgaacggtacgatttatgtataaattttatatatacagttgttttaaaatatcaaatatatctattgtcaagtttgtaataattaagacttaattaattaatcatatggtaatagacttcccgttttaaacttcggatttgtcttgataggagttgtccgctcattttttttaggtgtttggtagaagttgtccactcatttttttaggtgtttggttgaagcgcaagggtagcatatgatcaccagatagagaacattctatttagatactgaatgggtgcatccggtcgaattggtcggacgaggcacgccagggggtggctcgcccttgtcgctcatacatggtggagagctagtcacatcccgtaggttccagttccaccgctcggaacgaatgccatccccttacattcccgtaattagaattacattcgctctttgcacttgcaacacatggacattttactatgaacttaaaaatacaggtggataaggtcccctactgtgttcatcacatatggcacagtatagcctccataacagaactagtacataatactataacataaatttaacgagtataaaatgaatggaccaagggtgtgttcgcaacccctttttctaacccacctatctcgttttccgcgaacacgtttttcaaactgttaaacgggtgcgttttttgtaaaaagtttctatacgaaagttgcttaaaaaatcaaattaatccatttttgaaaaaaaatagctacagtaatacttaattaatcacgcgttaatggaccgctccgttttccgtggatactgttccggctggcaaccataaatggcgaacacagcccaagtcctgtggagttgcagcccctttatttagaccgtgtttagatccaaagtttttcttcaaacttctaactttttcatcacatcaaaattttcctacacacaaacttccaacttttccgtcacatcgttccaattttaaccaaacttttaattttggcgtaaactaaacacagccttaaatataagcggtctgcagcacagatatcctggatgccttaaatataacatgcaacttcatcatctatatctgagaatataatacagatatccctatggccaccgaaatagtcagcaaaagtgggatgcctaagttccacgccacacttttggcaaccaaagcatttacctgaaaaagggggaaaaggagaaggcattagtgcatgtcttatgaagaaaaaaagaagacgacgaaagagaatataattatcctgccatgttttcacaaaaaagcatagatgctaccattgtcattctcttccaaagggcagcacaggtaaatgccactgtcctctttgcagcagggacatgtctcagcaaagaacaaagtagttgtgccatctgaacatttcaccaaaaagttgtagtgtcggtattctttcctaccttcatgaaaaaaactgcttcctttcaattccacaaattctaactcagcagcctgcaacataaatgagatcagtccagatgtgtaaattgcatttccaacttccaatccacaaacgaacattcaaactttgccaactttcgcctaacacttacaaaataccgctgaattagtaatttatgaggttgactagccaaaatgtatcatcattatttttgtggctccataccggaatattgttttgcttagcataagcgtgcagtgctattttcgcgatcttgacatcacgcttccctttgagtacttccatctctttaggcaacgtgagtggcctcatatggcgtttggatgcagcaacaaaagcatcacgtagtttgttgaattcgtcctcactgcatgtgaaaatatgaaaacataatctaagggtggtgttcttgctgctattaaacaaaatcaggtagtgaatagattatgtttctaacactaggctattcattttgcagatttgttggtttggtccatatattctagcgaaaccttatttgttttctttgcaaataattcaaagggggtcatgaatctctctccctctcttatgaggaaccagtggaagaattcacatgtattattaaaggagaagcaaacaaatagctaaaagaatagaatagctttaagtgaaaaccacaaagctgtatataatagatatactttcgaatgtaaaaatagcttcaagtgaaaagcacaaagctgtataatggatatactcccttggacgcatcctacaaattatttgcatctttctctattgcatatgtttctcccaagcatcatattcataattgttttactccacccaccaatcccggaagcgtgcaatgcaatctttaacctaaaatcgatcgaagtaggccacatacatacctgatatacatcgagatcgatcgagattgctcgttccttcacaaaaggcaaacaaaatcagccctaaactgaaatcgcgcgcagatcgcgagttgggaatcaagagcggagatcgcgaggggatgagcagcagcagcggaggtggtggagggctggaacgaatcgagcggcgccgcgccgaggagttgcgtgtcccccaaactgtttgatatttacctcgtccggaacaagggttatttcagcctcctgactttcccctcatttaagtcggtttcgacttaagattcttgtaataatctgattatcgaatcaaattactataaactagaccttccttttttgaacgctcacgggggaaagactccccacctgaataagattaaccaaaaccaaatactgtacaagagctgaaaacaaagaaaggggcacaggcgccccagaaaaaaaaaaccacaacaggcagcaaaagaagaagaagacccaaaaacgggcacagactaagtttcagcaaatgcagcggaagcgagaaaatagccttccagatggagaccacaaagcaatcgttacttcggaagcggtcagaccaacgacctgcatcctagatacaggcctgagaaggcgatcgatgaactaaggggatcccttggataagctatagtagaataagtcatgagttatttgtttctctggattattaggtttaaaaagctaatgtctataagggcatcaccaatgtttactactttctccgttacccaatgtaagtcattctatcatttcccacattcatatcgatgttaatgaatctagatagatatatatgtttagattcattaacatcgatatgaatgtggaaaatgctaaaatgatttacattgtgaaacggaggaaatacctactttgtgaataatggtaggtcttgtttcagtgggtattagttattgttgtagctacaatattaaatgaacaaaagtgggtggtaagctgggtcccacaaccactagacatgagagagggaggagagaaattatttgtttatttcttatggctaggtagtaagcatattacctggtatttgttgcttactactcccacagtgtatacaaccgggcagtagtagtattttatttcttaccacccactttatatgcacattgtgaatgctctaatgctctcagctattgtggaataggtggaggatgagacggcgacgacctggggaaggagccagggcattggtgggggcttggagaaggattcacgcgcaaggttagggtttgagggaaggatccacgcgctgggtgcgggcttggggaaggattcacacgtgactagggagagagaaagcggatgcacgcgcggccgggggagacgccgaattcgtgcacgactaggaagagagaaagcaaatgcgttgtggccgatctgttggtttcgatgacaatgttgggtaatttgcataaaacttttaagggtagtggggctttagctatccaataatatgaaaaaaaacacattagaggagattaccagattatagtaatatggcttatagttaataattataatctacttgtttgtttcagattataataatcctaagctgaaataaatatgaccttagtataaaccaggatttatagtcagacgtgacgtaaagaatgcgtctcgtgggaacgttctatactacctccgtcccataataattttatttctaaaaaattaaaaactgattaacaaccaacataatttaccgcaatagcttttttttttaactatgctgtttgcttttcttcgtatcgaaccagatgctatattgtacatcgttgaatatagcgtccaggtctggacatttggcgtccacacctggatgctctggtactcgcggcaactattagaaatcgacctatgatttatagtactataagttaattaatgagttattaattgttatacaaaagcatacagtgtacatcacaatattgtagcaccgttccagagtagaacctacacagaacataaattacatgccgctttgctaaagcccatccgagaaaacgttcagcaacacaacctttctacttgcgggtgattctgaaactaatctgttataagtaggtacattaatattagtcaatagtcatcaaaacaatactctacatctatatattcagaacagatatccttgtggccacccaaatagtcagcagaagtaggacgcctaagttttatatgctgcactcggcacccaaaacaataaccttatataaaaagaaaaagaaaataagttaatattagtacatatttaattaaacaagatgaatgaaaactacaatttttcacaaaaagagaaatcttatttaccattgtcattctcttccaaaggacagcacaggtagacgtccttctcctctttgcagttgagaaaatccacctcagcaaagaacaaagtacgagtgccatctgaatcattgatcaccagaaagttaaagtgtgcatatactttcccacattcttcaaaaagactcctttctttcactttcataatttctaacttggcaggctgaaacataatgatattagtccagataggtaaattcatttccaacttccaatccacaaacaaatattccaactcttacccagcctaggcaaaactaaaacttatacagatataaaagtacaaattcagaaattcgaggatgtctagccaaaatgtatcatcaatgttattttcgtggatccataccggcatatctttttgcttggcatatgcgtgcagtgctatttccaccatcttgcatgcctcctcttcttgttcaggaaataaaatctcgtatgacgaggggaacacaccgctcttgtaagtagccattaaagtaacatacagtcccgtgtcagatatatatcgactaagtagtctaggagtgggatcatcctctatctgtagtcccgcaaaatcaccttcactgcatgtgaaaagatatgaaagcataatcatccccaaaatgcatgtgaaaatctcatgactcgaatgatatagtgagcatcgattatatttccataaacctttaaggtggttcttgcttctaaaatcaactaagcaggctgtgaatataatatatttctaaggctaggcctattcatttatctaatttgttgttttggaacaccagttaaaaaaatgattggctcaatttcatcttactcacaataattagaccgagactgaattgcttggtgtcaccgaatgcccttccctacctgcgggtcaaattgcatacccgcgctgctccgatagatcaccgggtgcaaaactggggtctgcaccagcctcaacggggaaactaccaccctaagctcaataagactttgactaaccaatatttttatcaccttgcattattgcataggcctcatgtctacaattatctaagttatacttttgaataagcatcagtccctgcgtgaggaaagccttcaatccatgtctatctacagtggcggacgcaggatttattggtcaggtattcactcaaacaattgcaagcatcttgtgcctgatgtttggtggactagggttagaagatttgaagcagttgactaactaagtgttgtgagctaggagtgcaggagtatatttgttgagaaaaaatattagacaatcgagtatatatacatgtaaatacctacatatattaagttcttttgtgaaatttttgggtattcccgattataaagggaatacccactgcttccatcactgtctagctatccctatcttgaaggttaaactccttcggtgtagtagtagtttatcctttggtgtagtagtagagttgtgggtgtatgactccactcactatggttgaaatcctagtgtcaacattgatgcatgtgaggtgggcttcaaataggaattttttgtatagggattttttaggaatttcctggcatccattctgtggaaggtttgttcaggggaagcacttgtcagtctatgtccatctataactaaaaagaaaaaaaatattctagttgcctctctaatttcgtttaaaactgacaagggggtggaggtagatctaataaatctcatctcatcaggaacctatggttacagccttacaggtagcacagaccatagagcatcagattatttaacccaacgacgaattaagattctgggttctaatagggtcgcacaaactatgccgcgagatataaaccttttgtcaacaactttgtttcgccttgcctcgtgttgtaactagctggatgtaattatttctcaattttatactccttctgttttatattataagactttttagcattgttcatgtttatatagatattaatgaatctatatatatatatatatatatgtgggcaatgctagaaaatcttataatatgaaacgaatgaagtaatacaaagatacgcaagccttgtgcgtgttctcgaaacaaaaagaaaaataaaaatggtcgcatacctgaaatcacagtgcttgcgacggcatgatgaatcgagggtcacatacaccgtgactgatcgttccttcacaaaacgcaagcaggtcagtatgtatatatatttacagtccaccgagaagagatatcaatcactccaaggacacattcacacgagaggaagaagagggcgctcacctgaatccgctggcagatcgcgagggcgagggcgagggcgagtcggggatcgacaagagcggtggaggtgacgcggtcgatcaacttggcgacggcgaacacggcgagggaagtagcagcggaggaggcggttgatggccggcggtgagggcgtgtagctagggctccctcggcgtcgtcgtcggggttgccgtcgcttggaatttgggggaatacatagcttccgcctcaacgcgcaacgaacgccgaccgagggaacggcggccggcggccggcgaacggatcaaatcgagcagcggcgagggaaaatcggggggagagagaaaggtgtcgatttatttcagcctccggcgagcgtgtccggaatatacgtagtgagctgcgagcgtatccgagattccgatcaggtttcacgccctgattgttactgctccggttaaagttaaactgcttttaaatttggatcaagtttatagaaaaaataataaaatatttataatattagattaattttatcaaataaataattaaatatattttcataataaatttgttgaaaatattattacttttttctgttaaacttcaatcagtttgactttaaccaaaatcaaaacgtcttgtaacataaaacgtagagagtaattacgaaaatactttacctcggacgactggcgcgggggagccggatcgggcgctccccctgcgcaccctccctccgtgttgggcccacccacttctacctcccttttttccacgaaagatattttacctaatgtacttataatgtttcactatttataaatctaatgttgcagtgaattaaaatattattttgcaaaaaaaaactcacatattttggaaactctctattaaaggaatttgatttattttttgttccaccaaaaatgtttcacctattgtactcgtaatatttcactatgtatagatctaatgttgcagtgaacgaaacattccattgcaacaaaaaaacccacatattttaaaaccctctattaaaagaatttggtttatttttttgttccacggaaaaatgtttcactatgtataaatctaatgttgcagtgaactgcaacattctttcgctatttactgaaacattgtttttatataaggtgaaacaacacccgatttaaacgagtgaaacattttcgatctacttagtgaaacaattctgatatacatggtggaacatcttgcaacatttaaaaataatttaataataagcttttttttttgttggaatatatccatgtgtggtcttgttttaaagatttaattgcaatgaatttaatggtgcaatcgaatcatgatttggataagtaatttagaagaaaaatcagtttaaaatagttttatacgtaaatcgggcgctgacgtcagcctgattttactccaaacggatcgatcgcccgagccgtatgctcgtccgagtaattaccaagtcattgataaaataaaaagtcattttttttgtgtgggatatctaaaataaaataatagaatattccttctccctcttcatttccttcccatacctgatatccatcgagattgagattgctcgttccttcacagaaggcaaataaaaaacaaaccgcgcgagggcgagttgaggcggtcgatcgcgtcggcgaggtagtggagcgctggcggtcttacacttgaacggacaacgggcttccgatccctgggaacgacgaccggcggcgaacggatcgaatcgagcggcgccggagaatcaatcgggagcggaggaggacccgttgtctgatattttcctcggaaagaatggattatttcaccctcattacattctcccgtttaagaatgtttccgtcggagtatatccgatcaggattatattcaagcccgatgctccgttcaaaaaaaagcccgacgtggtgtacaagtgcatgggaacgttgtaaacagcgtctatataaaccaaacgagaaaattatcttgccatgtgttcacaaaaaaaggaaaagaacaagagttatcagtacaaatttaaaccaaacgaaagaaaattatcttgccatgtgttcacaaaaaagagaaataaatcttcttatattcgtaccattgtcattcgcttccaaaggacagcacagaaaaacatccttctcctctttgcagttgatatccacctcagcaaagaacaatgtaagagtgccatctgaatctttcaccacaaagttgtagtgtccataaactttcccatgttcacgaaaacgagtatattctttcagctccataatctctaactcagcaggctgaaataaacataatgatatattagtccagatatgtagaacatttccaatttccaacccacaaacaaaatttctaacttcacccagttagcctaggcaaaactaacacttctcgaacaagatagaatttagaaatttgagattgacgatgagccaaaatatatatcgccatcgttttcgtggttccataccggtatatttttttgcttggcatacacgcgtagtgctatcttcaacatcttgcaatgatcctgtcgtctgagtctttccaaatcttcaggcaatcgccacttctctgcaaagggcttagcgtcgcgttggcaggcagcaacaaaagcatctctcatttcctgggcatttttaaatcgcgatggtcgagtgggatcgtaattgtccaagagctgtaatcctggatcttcttccccactgcaagtggaaattaataaatgtgaacatatatacatatgctattcccctacttgaacttaaagcatgcagtgaatagattatatttctaataccacgcctgttcatttaactaatttgtttttttagataatatttaactaatttgttgttttggtacacaataaaaactttagctcaccaattgtaagatggaattcaaggaggaatgggctagttacactacatcgagcaaaaaccttaacttctttttcccttttaggaattcaaggaagcttatggtcctactttttatagaggagatagcataagaactcatatatatctttaaaagaggagcttggcaaccaaaaaaaatcagctgttttcagatcctgcaatcttaggaggccacatacctataattaagtactatttgggtagaagcagcgggcttgcgagaagatgatccggcgaggggagcagcagctgaggtggatggctgggggtgagggcttgctgctgctggagctcggtcgcttgggagatacattatccttaaaccttccgatctccggcaacgacgaccggcggcgcgactgatctccggcaacgacgaccggcggcgccggcgggatcgggattcgggagcggagtgacgatattcagcgggcactgatttttttttccttcccccacctctttttaagaagggtttttttttttttttttttttttttttttttttttttttttttttttggggttgagtccgatcaggattcatgtccgacgtggagtgcaagtgcgtcgctgggaacgttgtccagaacagcgtttgtactccgcccggcggccggacacgctaacggcaatcctaaccggaatcgtagaaaatataaaaacattaaatttttataaacatttatctagattcgtagctacaaatatttatattttgttggggacggaaggatatctaatatatgttagttggtttctcatgtttaaaattaactagcaagatacacatgctttgcaacgggttgaattatatgagtatattcatatgtgttaagaattttgttcttttttgctgtatctggtggcggaaacagcatatgacgaatgttgggttgttcgatttcttttcttgctctcaattagtttctctcatgttccatttccactcttagtgatggaattcaaagaataacggatcctccatttttcccacggttttccgactccactcttagtgattgaattcaaaggataacggatcctccatttttccggcggttttcctccagttcgaatgagccctcattaaggtgaagggatatgtatagatggccacccaaatagtccgcagaagtaggatgcctaactttcacatgctgcactcggcacccaaaacaatatctaaccttaaaaagaaaagggaattaagtattagtacattttaaaaaaatgaaagaaaaacataattgttacaaaaggagtgaaaattctaattatactaccatcgtcattctcttccaaaggacaacacagatatccgaagatgagattgctggttgctgctgggccagtggtggtggggggacatcccctgaccaaagctccgtgcgcgactaggttggctggcgaagttgcagtgtatgctgggcgtagactaggcgaagtggtttgttgacgcccctggtagccacaccaccaacctttaacttgctcctctggcaattgtcgtcagcggaggtgaaactgcttgttgtggcagttggatgctttgaggaagacccgcattcacttgttgaggaagatttggaattgtgcctagaggatcgatgctaggttcaacctagactgtgatgtcgaaacctatgtcgtcaaagcaacacctgggactatagtttggggcggtatcatgtgagcctaccagagagattggacttgggattgaagcatgttcggcataggtgctcgtgcagctacgccgactcttgccgacaaagctactgttgttgctgcatctagtgaagcatctcttgcaacttgactacctcataacctcatactccggccttgggaccaaagcagcttagctcgtagcccgtaggcactcaactttatctcctcttgaggcttgcttgtccgagttcattgccagaggtccctcgagctaggctttggcttaggcttctaaggcatactcgacataatcttcgacagcacccgcatacctctgcagaaccaccctccttcttgtcaatcttctcttcagcggcattgactttggctaggctccccacggacggcgccaattgttgtcgaaagacaaacacttgtcctggtgtacggaacaaaaaaaaacaatagttgtattttttttattgaacgccctttacaatacactacctgagagctatctataggtttacaacaccaaatctaaccctatggtttaccatgtataggcttttacatttttacccctatatgataagggtatctacagggattttttttatgtccttggctcacttgagtctactaggccttagcaggccaggcttaggccgccagataggcgttgtcagcctactccaatgcgtttcaccacagctcagctcgccttcgccttgactcgatcttggtaagagctccacttggcttcaccatgttccatcgtgcttcgcttgcttcgatgggctagtgaaagagcctcctaacctgcctccaataatacgcatggacaaagtccccatacaatcttttttttttgccgggtcggcagaagaaaggcttttttgccgggtcggtggaagaaaggccgatcaaatttcattaagatggaggctatgtacaaatccccatgcagtcatgacaatatcacatactagcaccaatctaagtagaacccacaacaagcatacgtagaacatgaattgactatagctagtacaaaaggaaatggtccagtctggtgaagttccatgcccctttgcttaaattaccttccaaacatcgatatgaacgttcagcgtcacaaccttcctacttgtgagtgatcctgaagccgatgtctttagtaggttcattacataaattcgaaatattcatcatctgtatctatgtacggctcacagatatccttgtggccacccagatagtcagcagaagtgggatgctgaagtgccacgtcccactctcgacatccaaaacaatgaccttaaaaagaaaaaaaaagtattagtacacattttaacaaaatgaaagaataaatacaattattcacaagaaaggaaagataataccattatcattctcttccaaaggacagcacagataaacgtccttctcctctttgcagtttagatccacctcagcaaaaaacaaagtatgagtgccatctgaatctttcaccaagaagttgaagtgtccatatactttgcgacgttccgtaaaaagactcctttctttcagttccatgatttctaactcagcaggctgaaacataatgatattagtccagatacatttccatcttctaatccacaaacaaatattccaactttacccagccaaggcaaaactaacacttctaaaatagggtgtgtttgaggagaaggggattgaggagattgaaaagatacataaaacgaggtgagccattagctcatgattaattgagtcctaactattttaaatttcaaaaatggattaatatgattttttaaagcaacttttctatagaaattttttgcaaaaaacacaccgtttagtagtttgaaaagcgtgagcgcggaaaacgagactcaacctcccctatctccccagaacgaacgatgcaagatttagaaattcaaggttagacagatattcgtggattggtaccagaatatttttttgcttcacatacaagtgcagtggtatttctaacatcttgcactcattctgttctctgagtctttccaaatgttcgggcattggcatcttgtatgcccagggcaagttacaatttttgcaggcagcaataaattcatcctgcagttccttgaaagtatattcatcagatggtccagtgggatcatcccaggtttgtagtcccgcaaaataactcccactgcatgtgaaaagaaatgaaagaatattatcccccatgcataggaaggtttcatagtcaaagatattgtgagcatggaattctatttccgtaaacctgagtgtggttcttgcttctaattcaacaaaagtaggtcgtgaatagaatatatttctaaggctaggcctgagtattttggtatgtcagtcaataaaaaaaatgattggctcagtgtaacaccctgaaaattcgaccgacaaaatcaaaactctaaaaatgcagatattcaaaaaaaaaaacttttcaaactaattgcaacatgccgattttattcgcctattttacctggatttgatctcgaagaatattaatagtgagtaaagaacagttaatcaggaataaaccttaaaaacaaattggtaaaataaatataaattaaaaataaagattaggtgtggatagtaataaataaaatattatcgcgaccataattggatcaattaaatttaattgcgatggaataagaatttaccctaattaaaactcaaataaattatataaaaataaaatatgagtaatattaacctagggtgaattcattagttgagataatacacatattg

SEQ ID NO: 34922 - DNA, 34754 bp, Oryza sativa
  unsure (1)..(34754): unsure at all n locations
ccatctcccccttcctctcccctctcccctctccactgcgccgccattcccgtgccgctgcgccgccgttcccgtgccgctgcgccgccgttcccgtgccgctgcgccgccgttcccgtgccgctgcgccgccgttcccgtgccgctgcgccgccgttcccgtgccgccgcgccgctgtttccgcgccgccgtgccgttgctccggtgccaccgtgccgccgcttctgtgccgccgtatgccaccgtcgccaccgccgtcgtcgccgctgctgccgtcggtgagccgccctccttccccctcgcgcccaccgccgccaccgctcgggtaggagggagagccgagagagagagagagccgagagaaagagaggaagaagaaaagaaaccaagggagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaagaaaaaggaaataaataggaaattagagggagtttggggaagtttagaaaatttaaaataattagaatttaattatagattaattatagtcgtagaattacaaaatttaatataaattatggattattcttagtaatttctataagaaatcaattcgcggtagtaatttagatgtaattaataactaaacaaatagatgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaatgaaataattatacccgcaaagtagtttaaatcgaaattgggtttgccgtagtttgcagatagtaaagttaataaaaaggaatcgactttcgcattcgactttcatttggatttatttggatttttatttgaattctaatcgaattcaaatcaatttttgcacgtaactatagagcccgagggagttgcggatccaagcgaaggccaagacccgcaagactttaagcaaggcaagtcatcactattcgttgaacatgttgatcctaattgcgaaattgtttgtttacaaataaaattgcatgcaatgatgaacgtcctacttgtgattatgccatgccttgattattgtttacccttaaaatccttgtacccatgattacgtatgagtccctagtcaattatgacaactgcttagaaatgctattctaaaatcatgcatactcatatttatcaaatgctatatgcttgggcaattacctttgggaaggtaattgagatgcggcatgtgaagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgagacatgtattatacttggctagactctaaattctttaacgtgtgtgggatgggatgttgcatgatgatttttatgctgatggagccacttcctgagaggcgggaaggtggacatcctcagaaaaccatgacgaatcaatggcgggaagctatccttgggatcacaatggatggtggacagaaccgtcgttgtttaaatacaaactctggtactaaaatttgatcggtcaatgctaggtcttaggcttgtgaaaagaattacaaaacttgctttgcgcaaaagaactatggccatcctttgaactcccctttcatatgcattgttgctgtggtggcttgctgagtacggttggtactcatccttgcaaatataaaatttatcagatgcgggagatgaagcctcggaggatccctatgcctattatcaggagagagatgaagacgatggcgtccagtaggtcttagtacgttcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgattacacgattgattcctgttataaaaacgggggtccacactcagtatactctgatgaacaactcagaagagagggtcaccaggaggaactagcaaaagatttactatattgtttcgataaaagagaaacaaccaaactaaaaaaaagaaagttttcagtgaatagcacaaagttgtattgtaataaataaatatagttttgacatatatggagcttgttcattttcttcgctcttctttctcttgcatatgcctctccgaggcaccccatactattggccgataaaaaaaaaactcaaaatcagtcactatcatcccaatgaagctcaatgagacttgataaaccaatagttatattatcacctaatagcaggggtaatgtccactcttatcgaagctgtgcttctgaataagcatcagtccttttgtggggaaaccatgaaacacaaaatcaatccgcatgtagcctatttccaaggttcagtaaggcacagtagtagagttgtggactttgtgggttgcataactccgtccactacggttcaaatcctagagcctaaatttatgcatgtgaggtgtgcttcaaatagcaaattttcataggaattctgtgatgtacatggaattttcctagcatccttccgtcgaaggttttcaaggaattctcatgtatatttgcatcctccatctatagtaaaaagaaataaaatccatattctagttgcctgtctaatttcgtttgaaaaaggttaaaggcttacagttagcacagagcttttaacccaaaaacgaactaagatgctcgcatatatatacctgaaatcatcatcattttttgtggtaaaagcacctgaatcgtcaccaagcttgtgataggatgatgagtcgaacgtgattgatcgttccttcacaaaaaacacaaacatacatatcactatatcagttataagtatttacagtccgctgagaagagatgccatgccacgcagatggcgaaatccccactcaaacagtaacaatgatcgaggcgctcacctgaaaccgcgcacagatcgcgaaggctagggcgagggcgagttggggatcagcttgatgtgtggcgcggtcgtcgatcaacttggcgagggcgaacacggcgagggaatcggcagcggaggcggtcgagagctggcggcgagggcgtgctagggctccgtcgtcggggttgccgtcgctcggaggttgcggggaatacatagcttccgcctcagcgcgcaaggaacggcgaacggcgggcggcgggcggcgcgaggaggcgtccggcggcggcggaaggcgagccgatcgaagcgagcaacggcgaggggtttaggagctgagggacgatgcgtcgccgtcggatgttctgattgtgtttaaattacggatgtgtagctttaggattcggacagtaagtaccaaaggaaattgggtctttttaacgacaaaattctagatgatcgtggattatgctttccttcttgataataactttatgcaacttcatgacgccaaacgcgttgctacagaaaattgtactatgaatctatattggttaagcttcttgatgacatgccctcaggcacgagcgtatttaaacgatgttaatgagttgtagttatgcgcttgtttggtttagagctaattttgtcatttaccttatcaatattttggtaaatacccaaaccttggaaaattttgccgctactaaggtactactatcaatttgtaactgtgtgatcaaaattagcttccatctaaacaagcactatatattagctccaatgggaagtatcgagccctaacagttgggtgctaatagttttcctccagttttctaaatagggcaataacactataatcctcttcaatagctttcacttgtgcgcttggaatagttggatcatatgacaaaactgaactaatacgagtatagaagttaaaaaaggctcaagtttttatttgactactttctaaagacgaggatgaaaataatcgtttcttagtttaatatgaaaaatagggcataggaagatctgactctatgggagcccaaaaaagaagttaatttagattatctaggatattgtaatcaacatagcaaaatagttttatagttgtcgatatttcagtcaggagagccttccacgtttgatttctcatgcaaaaggcataaagctggatgcatggtgtcgttccttagcaaaactgcttcgcgctataatgcactgccgtctatacatatacagcaggatgtcacaccaacaaaaactacaaaactgaagggtacacatgatcataatcatgtccatcttttgagttttgatgttgatgaacattttattacttcctaactcagttgcacagtccagcctagccaatcttctgcctggcccatctgcaggcttgtcaatgaagtatatagctgctgagacacgacaccaactcctttgttgccagcatattcgaccctgcaacgaaaaatccattgcatagtatgatggaacttggaagaacaaactttctctgacttcggaaattttaccaagacaagtccatcttagtaggagatccaacaaaaaaggttagccacgacttactagccactagtgaataatatacacctttcaattgtttttatatggctttagtggttcctttattcaagcaacatggggtgaagaattggctaggtttcggcccattaggtagttcatatggcttaattggtgatttatttgaggaacaatacataatacgggtgtaaggaaaggaaacaatttaaattttgacttttgactacacatacagcaaacggctgaaatttcaaggaagcaatgttctaaaagtcagcactgggtgccacctaggagcctggtagccgccacaattaggaattagatggtgtattagactgttgaatttcttggatggtgttctgttgctattttagtgttatattgtctaattttcatgtaatatgcttgctaatttcttgaaacaatgcaaggaaggataagagtatcaccttttcccttgataggtaatactacccacaggagacactacgacagcagttcctgtgcagaaaacctcatcagcttcaagcagctcgtctactgacacaagtcgctcctcgaccttcaagaaacaaaaaaacattaatagaagatttcccaaaaaattgagaatagatgtaacaattttcagtaacagattgagaacagtgttttgctgcttctaattggatcgacatcgctaggaaaaataggttctatcttcttcaatgtagccgtagctcatatgaacctaaccatgaatataacccttggtagattgaaatatagataacccattgttaatattcacagcgaacaagaaggatgatatggacaaatagaaacatggacttggatacctagcaaatacacaaggatcaatgttgaatacctaatgctgttgtcaaagatatcaaatcacaggctactaatttgagctacactgaaagtaaaacatcttgcttgttagttcatgggattgatgattaatttacctggaaacccttgctcagagcaacatcaatgatacttttccttgtgatgcctggcaatattgttccttttactgctggagttgaaatgacattgccctggtgcaaaagccaagaaaaataataagggtgtgtttagatggggaactaaacgggccctaaatagatctcaagtcaaaagcagcatgtataagatattccttcaatttgttgactatccttatgcaaaaataagcaataaatgttttgtctgcaatggaaatacaaagtccaccataaactaaaacaaatacaacaatagtttgccattcaggatacgacacagacaacctggctgaacctaataggtgtagaacaaccaattgttagtacgatattatcctatagaatagtcatggcactgtattgctagcgaaccaatacctatgaccatgtgttgtagatatgcctgtggttttcatttaggtaacaattcatagaggtttatgcatggtagaaggtactccctccgttccaaaatataacaacttttagccttcaggatttgtcccaaaatataacaacttatctaccaacattctcttcccaaccaatcacaaccctccaccattcacttttcccacctacctccactactcatccaatcacaaccctccaccactcgctttacctactttcttaataaccgtgtccaaccctaaaacttcttatattctgggacggagggagtagcagttttgagtttgtatgttatgaaattagatcccttgacacattatctccatcatttatagaagtacactaacccacagggtatgcatttacttatggatgttgctagcaactaacacataaaacacatctatattttttgggtactaccatgctatctgttacagattttcaaaagttttgagccagaagcctgttcaatctaagagtatcaaatatctacttcaaagagcgtatgactcatttcatttatttgaaacctctttaatctatatagacataaggacatacatctatcagtaaagaaaacaaagctgatcgttaatacttaatagagtaggttacaaatcttagcatcggttaatttactgtggtagctttcagaactaaaaaggctaatattaactggacctacaggagaaagtgttcgaatcaaactaacaggtattattgacagcataaacacaccttgacaacaaaaatattacatgaagaaacttcttcaagatactttttgtgaacagcatccaagtagagaacatcagaatagcccttttcttttgcaatcttttgtgccatcaagacctatgcaaagacagtatataaattaaagccagtgaaaataataacagaattcaacatagaagatagcagaaaataataatgataagatagcagggagatataagtcgtcatacaaaatagcatttcatttgaagtatatctgatggttcaattatttttcatttcacagcttcataatggcctgtatgttcttaagagaattgcactgacaactctcctttcaaccacatgttcacatcaatagaatgactgttccgtagtttaatatttgcagatctgaactaaaaacattacatcaaaaacatcagaaagagaaatatcaggtagcgaagttgcagaaatagccatgacaataacttccgcatcaaagctgtaagtaatgggtttcaaacttgactgtagaattaccgaggcataatttcctatggtcttcacacttccagttccaccaggggttgcacgatgaaacttatcttcaactatcaaatttattggagctaaaccttcctgaagatatgagtgaataaattaaattaaaaaaaatccatgatacatgagctgtttagaaattctacattcaaccatcagttatcaacaaccaacaaaagtggaaaaaaaatcataaattcataagtcaagttgctgcgaaatatatattcagaaacacggtgtcaagtagaacgcagattataacagtatctaccatagcttttttttttatttatggcaacaacgctgcggctaaaagagggagcagaattaaagaaaaaaacacaaaccttaaagtagttccccacaggggagacaaatataatgaacgtatactcaggagcaggtgcaagaccaagaacagcaccactacccataagtagcggtctaatatataaagaacctttaccggtaggaggcacctggaattaaaaattatttaacaaatgattaaatcaagagtatgaacagcggcctagcccactatgaaatgatttactttttacagtaaacccacccatctcttgtttgctaaaacagtctgctttactgcatccacaaactgctcaacactaggcgcaggcatgcacattctttctgcacctgttctcattctcagtgcattttcctccgggcgaaataataagatagagtcactgttgttctatatgcttttagaccttcaaacaatccctgtaaataattataatcttttaggacgaaaagtatttaaaaaggctcaattttccttatcttcagttaccacaatgtactcaggatatatgaagcaaggagatctacctccaatacaaacctatccgtaattaaggactccagaagatgggttcagcgctataggtccaaatggaatcatttcaccctcagaaaaattcccgtcctgtccgcattttgtgatatacatgtagtcggtctgcacgattccaaaaccaaggttctcccaatcaaaatcagctacctcagatgccttcctgaaaatatgcaagagttgccatcagaattattcctgaaatgaccaacacatcgtcacaatttgacaggcaggtcccctgcctggagggatacagttcaacgaatcatcagcttatggtaagaatcacacacgtgtagtcacttgctagagaagcctcgcatcttctcacgcctcgagcctttagtggaatcgacgacatcgaataaagtcgattctgaatctgcagcagcgagaaaacaccagtatcaaatacagtattttaataaaaaacgaacataaaaaaaaacagcatggacttcatcaatttaatctccacaagcacttcacaaatcccacctacaacaacatataatccaaatcctaaatctccagttcgaccgtacacgccaatctagccaccatgatccacgaaatctacagcacaaacgcatccaggagaccgtgcaaaccaaataccggcctagtcgcgcgcgtacctgaatagagggcggcgacggcggcggtgagaggggcaaccggctacgccgggcgccggcgagcagggtggccgcgaggagcgcgccacgcgttgctgcaccgtactccatttgctgctctctcgtgagctcccccgctctctcgccggggtatagggtttctgcggctactgcggcggcggcggcgcgggagaggcagcggagacggagacgacgatgatggccaaatcggacgggaatggcacgggggccaaatggggaagcggctttactcacagaaccttctagccattgtagccgatgtgagaccgactggtggggcccatgctgtgtgggccccacttggcagtggctgggctcgggatcccgcgggtgtgcacgggggtgtctggaattctggatgaggagcgcccggtaatcgagcaaccaaaatatagttttttatccacatggttttctggcaggtggggcccgcgcaccttcacactcaatggtgttcgtggctgccgccgtgcggtactgcggtgggtattgaaaagggcaaaaaaaaaagtggtggctcgaagaataggccgacttggctttggctagctctctttcgccacgtcggaaggcaattttattttgttttttcttggtaggatttctttctctttttttaaaggtttactcctctattacaaaatatagatatttttagcataatagtttattccaaaatagaactatttttccgtttgcttctcttatcaaccaatcacaaccattttcgatttaattatcatattcgcttcatcttcacaattaatcataacttttctctaatcatttctatcaactttcttaatacttgtatccattttagaaatggcaacaatttatgacagatgtggtagtggttctgctcttattgacctgttacctcactctcaacatcgttatatattcaattttagcggcataactgttaaagtcacataaaaaatatatatatatatatatatatataagaacataatatgatacgaaagacaatcagacaaatattataatttgatagtaaaaaataatgcattgggggtgttcaatctttgctaccagctgcaattgccaccgtgagttaatactgaataccctcattgcatgactactaatgttgtggttgtcctcctttgtctaatgtgtgatatcgatctatgtgcaagttgacacaaacatcacaatgtgtaatgctctatcaaccaaacaggtataagagaagcgtatgctaattaccggaagaatacttgctttgtctgtagacataagttgaagtattgtggagcacgattgcttaaattctaaaacattcaaccgcagaaaaatgacattgctagcttgcaacatatgtttttttccacagcagctttggattgatttattttcagctagggtgcccattcagctatttgatgctctctttttcgcgaacgcgtaaaaaaattgtatgtcaatatattagaagaagcatagatttttaaaatacacgacacaaacggccgaaggacattgtcagggaacaggagaaaaacggattttcttgggttttcttgccacatgctctatcaacatatgttcttttgcacagcagtgtttggattgaattgtttttagctattggattaaattgttttcagctatttgatgctctccttttcacgaaagaaaaaaggattatacgtcaatatattagaagaagcagagtttttttttaaaaatacacgacgcaacggtcgaatgccattgtcagggggaacaggagaaaaaaaaaggcttttctccaggggcatcgcgcaaaagaacaaatttgatgctctcctactctatcacaatataaggcaatcttcttgccttctttttatttattttttcaaactcacataatcatgtctcttctggtatccgatagagatctctctctagtccaagtcaagtgttgtccttttattttttttttaaatcattgtcctttaaaattttagctacttattaatcagcatgcacagacctagatcagtcccggctccctggtattggatccgaccgatcgagtgatgtgctctcatccatccatagccatattatccctgcaattgtttattttcattgccaaatgaaccttaagtgataaaacttttttttgtttgtgtcaatcgcattgtttattggttaattctctgaaagtgataaaagggcattttatttgtgtaacctaatgaaatactagtttttgacatgcatattgtgtttctcgtgactgcaagaatatgaacatgtcactagtttaaggtgtgtttgaaagatagagaataaaaaagaataaaaggatatgcaaaacaaggtgtgtcattagcgtatgattaatcgagtattaatcattttaaacctaaaaatatattaattttatttttaaaataacttttctataattatttaaaaaacgcacacaccgcttagtagtttagaaagcgtgcgcacgataaaggaggatatttttttccgaatatgcttgaaacaaccaaggattgttgacatgtgtcgacgggtgatacccgtagaccggatataaagggtattggggtacgttggtacaaggatctacgtagtacgacatcgaacaatcaaaagacaagaattatactggttcaggccccttggtaggtaatagccataatccagttgatatgtgattatatggtggaaaacacaggttacaaagggaacgatggaacttgttggattcggcgagatcatagtcgagtggattcgactagctctcgatgacttggctcctcgcagacttcggctttgtaggctgtgtgggttgtgttggctctgagattcgatgatctatgccctccctaggggggtcccttttatatcatagatctggaggtctccaagtaggactcggagatatcagacccaatacgatacgtcgacgacccagttctgtccgagaaggactcttcccatctgtagatttcgtgaaaggtttccttaggatatgtagaaaacatccgcgtgtgtgtgggtatgccatgtcgatatgtaacgtatattgaagggtagagggtatgcctgacccgtaaccctgacagtagcccccgacttctgcttaaaatgaactcgtgcaaccatttatgacttcgggtgtcgagaacgttgtcattcttggcgcgaggaccgcggagatagaacgtagtcgagcatgccgtttgaagcccaacggtcacgagtgaattttgaactgaagtccagaaaactaccgcgcgtaacgggcccagagatttccggcggggatctctctccgttccttggaattcgcaccgttggtagtgtgcttatttaaaggaattttgggagctcattttgaagtctgccaaccttgttgaacacacaccacctgccagcgctccttgccttctccgccgccgcaagaaaccctagttcgccaactcaggcttgttttccggcgatcttggaacaacaatggatctcggtaagtcgtcttccaccagcgcgacgttgaagaacctttaggaggacggcgcccttcccggccgtggagacatggagagagaagtaggaggtactgatcctcagcccctcttaggtcgcatggttgtgatcgaagattacgttctctgcggttttcttcctccaccttccgagtttcttctcctggtgttgaatttctatggtctttctcttctccatttgaatcctaattccatcgcctttcttagtatctttgttcatctctgtgaggcctacattggggtagagccttttctcgatctcttccgtttctactatgaactgcgttggatggaatccaatagggtgtctggttgcgtcgggttccgacttcgtgatggcatgaagtcgcgttatatccccttccagtgtccttcttcccgcagtaagtggcggaacaggtggttctatcttgagatcaaggactcgaaccctgtcttcgttgttcccgaggatcaaccggacaagattccggcctggaccgccaagccccctttgagcccctctcttcagtcgtttatcgacatcatcgatgatctccgagaacagggcttgtcgggatatgaagtcgctgcagacttcgtcggtaggcggatccagccgctccaggctcgggcccatccagcctataactatttcgggtcggatgacgcgacccgggtttctcctcggggtatctttctcgtattcatcttggcgtgcttgtagtcgcgttcctcttgacttatcaaaagttggtttccgtttaacaggtctaagcagcgaagctatggagcggcgcgtcggtcaagtgatgatcagcggtccgaccacggctagcgacatccccgtgcccctttgtgaaaagggggcggcggaacgcgatgaagccatcaacgtaagtgtatttgataagcatctcgtattctcctttcgaaatcaccttatgacctgattaagcgtaggcccttcctttgactgacatcatcgggccgctcgcggaccatcaggtggcgacatctctaaaggagaaggttgtcaaggaggcatctgatgcggccaccactagcggtggcaaagtcccgaccaaggcgaggaaattctcgtctgtactcggacattgccgcaaggcagcgacccccctcgggattaaattggcgtcagaacgggcagaaaggagggtatcctcttactctggattgaaaggctgtaaagggttcagacgcgtcccctccacctccaagacgacagggcattgaaacgaacggcgagaaggaagttaaaagaaccttggattctcgtgcttttcgttcaaatggtgtttgattcgtggttgtccgtagggaggcgcgggcgaaggctttcttttcttttccgggggagcttctagcgcatgacctgccacggcctcgacagatgtcgtgcccatgaccgggagccgggaggcgaccctagtggccccatcaacaatcccgctgcgggtcgtggtctgccagcggccgttctcacctgggaggagctccaagtcgagatggggcgtcttctcgaagctggtgctcgcggcatcggcagcgagatctcggaggcgaggtcggaagcggcgacggcgaatgcgcgtgctgagagattggtgcgcgagctagctgaagcccgtgaggacctcacgaagatgagggagttggtggccggcaacgagcatcaacggaaggggctcgaggactgaatgtcggaactcgggaacaatctctccgagatccatggctcgttgcgggtcacctacactggcctccatcagctcgccgaggagtgcggcgtcaagtccacgatcccggcgaatcccgacgagtttttgctgacttcctctcttgcggaactggcgacggcgatggggaaaatcccctccaagcatgcggccaggatcgcggaggagacgtcgaacggcatctacaccggagcgtgtcacgtcctcgcgtgtgtaagattgtcgcgtcctgaactcgatctgcgcgagatcttggatcagggggcggcaagcgacacgcgtaaggaggtgatggaagaagtcagtgatctgggggagtctgttctgcccctttttgaagagtaggacttcttgtatttgttatatattgtgtaaatcttgaactctggccgccttcgttcgtgcgattaccacccttgtccaattttgtatgttgatctcgggagtttttgtccattatagagatgttgatgatgaggatgtccagcagcgcgggcagcctgagtcactggcgatgattccggtactcgattttgaaccacatgtttcgtctgacaatgtggatcaaactcttgatgcgaaggccgggatggcaacggccacctcaagtgagtagccttttcacctcttagtgacctcttgattaggttatttatgttgtaaaggaggtatccaacttgtcttagtggtcatcacatttagcagatctcgagggtgcccttgcaaatcaagatcgtcgtatccaatactggaagacgaaatttgaagtggcggaacttgagagaaccatgctggccgtgaagaaagagcaggttgtggagacgctccgaggtcgcgaggtgtggttcaactcttacttgaggagttgctgtgcctccatggccagagtatgcagggaacttcgagtagtccgcgatgatcccgaggagtcggcggctgggtacatctcttggctaaacggggcctgtgcccaacttgatggcatcggcaagcatatcgacgaggccttgaagcaagagtgtcgtcgagtgagccgatacgccggagtgcacatgctggcttgcctacgagatcaccgcccgcgcttggacctcgagtttctccgccatggttttgctcgttctcggagaactccggcggagatagaccatctggcgaggtcgatgtcgccgctggccgagaagatcttccagtctatggactagcgttggccttcttggtagtactcatgccctgtcacagatatcttagggaaagatgtaatgtagtggaaaatttatgtaaaaactgtaagaattattttgtgaataaagaaatattccttaaacaaatgtatcttactctagatgtcgtgtgtaagagtgtgttctcagttaatgactttggtcagccgtttgagtcgtacactctccctagcccccagccttgtcgtcggaggaattttctcggaggataaggctcttggaccattgacctgccttggttgaataagctctgatcctagcccccagccgtgagtttggaaaattgatttccgatttcacggcttggttaatacgcacggtgagaactcttacacgaccagatcttacatggtcttttgtctctacaggatctgacaaggccttatcggctctgggcatccccagccgaagatcccttaggttcctcggaggccttgtcgagacggcgtaaagggacataaggacaggtttcaacgctaggtgtcatcagagtaagggatcatcgggtgaaaacactttgattgtgatatgggacctagaaataggctttattgatactataagggtacttacaggtacagtggtattgactcatacatagaatttacgtagttggtcaatgttccaagaatttgctaattcgcgaccatcaccgtctgcgattttgaatgcgcctggccgcaagacttgtgtgattgtgtaaggtccttcccattttggtgagagtttgttttgccctgcttgggtttgaactcgtcggaggacatagtcgccgatcgaaagtatgcgtgctcggatgcgcttctcgtgataacggcggagggactgttgatagctggctgctcggacggcaactcgctcatgatgctcctcgagaagatttacatcgatgtctcactgttcctcctggttctcgttggaatacttctgtactcgtgtactctgatgtcgtagctcgccggggagcatggcctcggagccgtacacgaggaagaagggtgtttccttattggacgttgtcggtgtggtgcgtacggcccatagtactgatgggagttcttcaacccactttttgtcttgtgacatgagcctgtcgtagacgcgggttttcatcccttgtagtactatgtcgtttgccctttcgacttattcgttgctttgagggtgagagaccgaggcgaaacatattttgactcccaacccgatgcagtaatcttggaagtcggtgctgatgaattgggagccgttgtcggttatgatgcggtgcagtagtccgtatctgcagaatatccctctgatgaatttgatggcgttgtcggccttgatttcccccgtgggcactgcttctatccatttggtgaatttgtcgatcgccacgaataggaatctgtagccgccctgtcctcgtgggaatggcccaagtatatctagcccccagcacgagaacggccaagtcagagggatagtctggagcgcttgcgcgggtagctttgtgtgtttactgtggaattgacaggcttcacatcgctggaccatgtcgaatgcatctttaagggcggttggccagaaaaagacttgtcgaaaagctttgccgaccaatgtccgaccggcggcgtgtgacccacatatgccttcatgtatgtcgaggaggaggtgtctgtcgtcgtcagtagagacgcatttgagaagtaccccgtttagcgcttttttgtataaatcgttaccgaccatacagtagatctttgctttacgggttattttctcggcctctgtatcgtcctcgggcaactcctcgctgctgatgaatttgattaatgggatgcgccagtcgtctgtggtttcgatgtcagcaacggcgcgttctgcctcggtgacctccgagctgatgtcgggggtgttcgggctaacttcgccgctaacttctttcaccgatggcttcgtcaggatatcgagaaaggtgccgggttcgagtggttctcgtctggctcgacgttgtccttgcgatagacgtgtcggacctcgatcccatcgaacctcttctctagcttcctgacttctacgagatacttggataactcggggttagagcatttatagtctttgtgcacctggttcgcgactagctcggagtcccctttgacgattagtcgcttggcgccaagtgcggctgcagctcgtatcctggcgagtagtccttcgtattctgcagtgttattggtcgccctgaagttgaggtggattgcgtgcttgaattgatctccggaaggagacgtcaagataaatcctgcccctgctccttggctgttgagtgcgccatcgaacgccattgtccatgtttcgttgtcgccttggttgtctgatttgttgtccggcatagtccaatcggcaacgaagtcggcgagtacctgggatttgatggctattcgcggcagaaagtggacatcaaattggcttagctcgactacccatttcgcaatgcggccgacaacgtctttgtttctcacaacttctccaagggggaaggaggatacaactgtgactctgtgagcttgaaagtagtggcgcagcttccttgatgtcatgatgactgcgtaaagcattttttggatatgtgggtatcttgtctttgcgtcatggagagcttcgctgatgtaataaactggtcgctgtactttctctctctcgacaacaatgacagtgctaacggaatatggcgtggcggcaatatagaggaataattcttcattaggttggggagcaacaagtacaggggggtttgataggtagcgcttgagtgcaataaatgcctctttggctttctgtgtccatataaatttgtcttgtttcttcaatagagcgaaggttgtgctcgttctcccatcctagcgacgaatctgcttagtgcttccatgcatccagttagcttttgtacctccttgagtctcgtgggcgacttcatgttctcgattgctttgatcttctcgggatttgcctctattcctctgccagagacaaggaatccgagtagcttgcccgacggtactccgaacgtgcacttctcaggattgagcatgaggcgatatcgtcggaggttgtcgaacatttcccgcagatcgtcaatcaatgagtcgcttgtcttggttttgacaacgatgttgtcaacgtaagcctcaacattgttgccaagctggttgctaagtgcgccctggaccgtgcgctggaaagtattcccgacggttatcagtccgaacggcatcttaacatagcaaaataccccgaacggcatgatgaatgctgtcttctcttcgtcctctattgccatgctgatttggtggtagccaaagtaagcgtcgaggaagctcaatagcttgcaaccggctgttgaatccaccaattgatctattcgagggagaggaaagtgatccttgggacacgccttgttgaggtcggtgaagtcgacacacattctccattttccattggccttccgcaccatgactggattggctagccactctggatgaagtacttctctgatgaagccagctttgagaagtttgtcgagctcttctcgtatggcttgtttccggtctggtgcaaatctccgcagtctttgctttactgacttggcatcgggtcgcaccattagtttgtgctcaatcacctccctagggacccccggcatgtcggacggttgccaaacgaacatgcaggcattatcgcggaggaaggtgatgagcgcgagttcctatttctcgtttagtgtcgccccgatcttgacagtcttgtcgggattggcactggagagtggaacgatcttgatggcgccgtccggcttcggcgtcttatttgtcttgctcactttcttgggtggctcagttgtggcgggtgggctgggcgtttgctcgactatgtcgaggctccgcttgtcgcactgcactgccagctttgtgttcccctgaatagtgattgttcccttcggtcccggcatcttgagcacttgatacgcgtagtgagatatggccatgaacttcgcaagtgcagttctcccgatgatggcgttgtaagctgtatcaaattcaacgacatcgaaggtgatctgctctgttcggaagttgttggcttggccgaaagtcacaggcaacgtaatcttgccaaaaggtctggatgatgattggggagtaattccatggaagggttgatcagttggtgtcaactcactttgcggaattcccattgcgtctagagtactagcgaaaagaagattgatcgagctgccaccgtcgatgagaactcgcgctactttgatgttccgaataatgggttcgaccacgatcggatatcgtcctgggataacggcggtcttggggtggtcttctttcgagaactctattttctgcttagaccacttcatcttgggtgcagccccccgccatgtcgaacagacttcacgttccactttcttgtattctcacttggaggagtacgttgtggagccgccgaaaatgtgtgagatgtggaggtcggagtctggatacgcataatccgattcgtgaggagccgtctcttcgttcttctcgacaatgcgtactcgcttgcctttttcaaacgccatgtgcttctcgagcgactttttgaaaacaaggcaatcttccagagaatgtctgtccgtcttgtgtatggggcaccaagatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctgatttcttctctcccccggtcttcggcttgtcgttcttgcgtcttagcgcatcgtccacatgggcacatcgctcaacgatctcgaataacctccgagtggttgtgatgcgtcttgtcgccaattcctgggtagtgtagcgatctctgacaccggatttgaaggcgcggattacagaagcgtcggtgatttcaggaattgtgtttctgcattcgttgaagcgtcgaacatattccctcaatgattcacctgagttctgtgtcaacgcgtgtaggttgtcttcgatcgcgtggcgcttgtacgttccttggaaattggcaacgaattgttgccacaggtctgcccacgaagagattgagtagggaggaagatgcatcagccatgaacgtgcagaacccttcaacgcggttgataaatagttcgctagcgcgttgtcgtctgctccggcagcatagagtactgtggagtagacttgaaggaattcttctgggttggtgctcccatcatacttttcaattgctccgggtcggaatctctcaggccatcggacatcacgtagggaacgaccgaaagccctgcacccagcgttgggggcggtgggttgtcagcggtcgtgtgtccttcgtggatgtctgtctgacgatgaggaggacgcagatgatgatgatgacgatgggtcacttggttccggcgtacgattacgagtatgacggcctggatctcgggaatcctatcgttgtctctcgctgttgtctcggcgccgatctccattattgtcgtcgttacggcggcggccatgaccagtattgtctggcccccgtcattcgcgatcgttgcgattgcggtggttgtcgtgatcccggtcctcgtttgagcggtctcctcgatttccgttatcatggcgccgtgaagagacatgacgccgagagcgatttacattgtctcgtgtgcgtcgtgcttctcggcggccgttgatttgatctcggagatcgccagcgccgcgaggtggaggagtggctcgttgaggtgattccctccgttccggatcttcaccattggcgtcgctagttggcggctgatcttggtgcgctgcggtagcgacttcttcaaacgcgttgctaaggttggtcaccgattcccgtagtcgttctgtcaacgctcgaggtcatcattcagaacgggatcgtaaggagtttcccttagtaaggcttgaacggccctgatgtgttgggctggagtagtcgattgattcgccgcttctgcgttggcttgcgttgacgtgccaacgtcatcgatagccaatacctcctgcggcacgctcattgtcgatgacccatagtcttcgagaagatgtaagaccggtggttcatgaggatcgatatcgattacctcaacgaatcgatctgaggctggagtcgctccttgttccttgccgttatccctgacggggacgtatgactcaggagacggagctttcatggcgccgaggaagactttgtagctcgagaggttgtgattctttgtcttgtgaataggacaatagacatcccgagttggagaagtacgctgaattccacgttctttgcatgcgcgaatttcagcatggacgttgaggaaaacccagcaatcttgcagggtgtgtttcttggttttgtggataggacaccaagaccttgtggcttcggaagtcatctttgccggctcgtggttcatgtcagaagggcaaggtttggccgtatcagaatccttcccgagcttggatgtcgtcgatgatccgttctccgtttcgacaggtggatttttcgacatgaagtcgccttggtttgtagccactgcgttctcgtttccggtcattggaggaccggttgagatcagcgtcgtggtgtaaaacgggaagacgatttcgccgacttgagtccataccagcattgttgaagcagggagcgcttggctgaggctggtgttgacgttgttgtcgacgaagctggatgacatagtagtagaaccttgagtaccaaatccccctacctggcgcgccactgtcgacgggtgatacccgtagaccggatataaagggtattggggtacgttggtacaaggatctacgtagtacgacatcgaacaatcaaaatacaagaattatactggttcaggccccttggtaggtaatagccctaatccagttgatatgggattatatggtggaaaacacaggttacaaagggaacgatggaacttgtcggatccggcgagatcgtagtcgagtggattcgactagctctcgatgacttggctcctcgcagacttcggctttgtaggctgtgtgcgttgtgttggctctgagattcgatgatctatgccctccccgggggggtcccttttatatcacagatctggaggtctccaagtaggactcggagatatcagacccaatacgatacgtcgacgacctagttctgtccgagaaggactcttcccatcagtagatttcgtgaaaggtttccttaggatatgtagaaaacatccgcgtgcgcgtgggtatgccatgtcgatatgtaacgtatatcgaagggtagagggtatgcctgacccataaccctgacaacatgtcctttgttttagactagggcagtgttttgccacttaggacaagtgactttgagtcctagttaattagtgtctactaggtgtcattgtcaatctgtgtttgcacaacttctgctaaatatgttggtttttatgatgtgtagaacttgagatatcttatatcttgttgtatgcattgcatgtcactagttaaactcagttttaccaagaagaagcttcattctctagtgcatattgctggcttgatttagttgtgtcgacgttgttcaggtggtctcaactctcaacctttttcttggtttatgctttccatgccctgaacagtaagtagtaacataaatcatcagccaccaattaactgaaaaaagctttgttgttcactcgaaaaaaatatggcaaaaagggatcagccacgtgcccaggaagtgagtgttgccccgtcattgtcgccagaaagcgaagaaaagcaaagcaaatctaatcgtttctcttcactccaaaaatagcaaagcaaacacatccgtctctctctctctctctctctcccctactactatctcctcctgcccttccaatttatgttacaaacaaatcgttggttcctcttttttcttcagtttgtttcagtgcaactcagttcttggaaagaaaggttggatttttactctgaacaaagcgaaaggtaaaaccatctcttttgtaatgcagcaatttatgtatattttggcgtcctttcagttattttgtttgatcaggtgtggcaatgggcggcagcggaacgctgatctccatttaccctgaggatctcactttcctatgtaagttcagaggacttcttgagattatctaatgttgttaacatttacggatggttagccttaacccacttgtgtgggttcttcactccattaaattctcgtgtgtagttgagctggataagcggtgctattgcaatctcaaggtggtgaacaacagcgagcatcatgctgcattcaaggtccatggccttccatttcatgaccaatattttctaaaacttggcgagaaggcttgatgaaagtttgtttcatgtcaagacgacattaccgaggaagtattttgtccggccgaacacgagcattgtccagccatgggattcttgcacaataacaagtaaatagtaccttcgccgcataataagttaatctaatacgagatgtgacatatcccagtacttgtccaaattcatagtactagtatatatcacatcttgtattagattaatttattctgggacggagggaatacatgttcctaatttggccattttatggtatgccaagccatggctctcttcaggctccttgtttggtcttgatatttggatatctgcattgttcttgggtgatgtagttacgctccaggcacataaatagtgcccaccaaatatgcaatgcaaggataaattcttgatccagagcaccaagctagtagctaccagtactgacatggatgagattccccccaatactgtgagcataaaatgcaaatagatgatttgcaagctttattagtgatgcattattgttacaatgacatgactactgacccaccaactatatgccatttttgtatcggtccagttcaacaaggaagtcgataaggtgattgaggaaatgaagcttaaggttgtttatacagttcccagtggaagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaattctaagattacccaccaaaaattataaaaattatggtaatgaataagtctaatagcctaggctatgactatttaccataatgagaacaggcatataacataccaaagaaacgactatggtaaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaaatactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccgccgcctcaatccctcacctctccctagccatccctcgaatcaaatcagcgcattcgggtaaaatcgatggcggaagagaaagaaagctttgaaggccaatgggcgccatccgacgtgacggaggagaacctgaaggagatggtggcgcacggcgttcttcctgccaaggagatcatcgggtggcggccagcgtgcggtgaggcttttccgtcccccgatacacacgaggttgtggtcttctctcatttcttctatggcggcttcgctcttccgacctcgaaatttttccgcgggatattaagcttctatggaatcagcttgcatcacctaaacccgaattccatagtccacatcgccaatttcgtccatgtttgtgaagccttcttgggaattaaaccccacttcgctctgtttcgccgaatcttctttctcaaaccccaaccgaacaagagtaagccatgtgtagtcggaggggccggatttcagctgagaggaactctgagccagaagtacttctcaatgcccatcaagacttcaaacaaagggtggcatgcgaactggttttatattcagaatcctgagcccgctcttcctgagtactcttgtcttcctccggtgtaccaagatacctggaactctcttcctattggggatgaagcagcccaagccttggaattgatggatcgcatgctaaaactcaaagaacaaggcttacaaggagagcagattactcggcacttcatcaaatgccgattggcaccaattaaagaaagatcccgtacggcattcgagtttgacggcaagcatgatcctaatcgtgaagaaccagactctctggattttaaaatcatgaaggagagaatgtataaaatcttctcaaatgctattgtcgtcagctactcacatcagctgccagttgtgccatataatgcattcaattcgcctccgcaggtatgtatctgaaaccttcaacccatgaccaaaacataatcttgtcttcatgttgagttaactaaccatggaggcatctcattcaggaatatgtattgatgaaatctgaccccccaattactcagcgccggtctcctcgccagcacaccgttaagggaggtggagggccgacaatcagatcggactcgcaacctcaaacctccaatccgactgggcaaacaggttctcgcaagagaaagctgatgcttaacgatgacgaaggcgacgacggcaacaaatctgggaacaaaagcctacccaataaactcccaaagcataccactcccaggaaaaaactggctggccgtccaacgccaaagatcagaacatcttccaggcataaacctcttggtaccatttcgctccggtatgcttctctcatgaaaataatactgaatattgaaaggacactttgcaggaaaccatccgacatagatccaactggaaaagatcctgatccggttgtgacagagccaagttcatccaaggattctgagccgactgccgagaaccagccgactggcgctcatacttcaggtgatacagccgatccgagtgaccagcctccgactggagaccagtcggcagcaactgaaactacaacaacccaagagcccccgactggaaaccagtcggacgtaggtccagaccaagaaattcccgaagttgaagcgcagacgacgacttctcaaggaccagaggctggtaacgacgctatgattgggtcttcaaataaagaacaagaatcgcctcacgctcagctaggaacatcctcgggtaactcatcttctcaagtgatgccgatttgaataactccagcttattcgtctaatatcttggaaatacatcaggaccaccaggcgatgacgaagaagaaatccctcgcataaaggcggctgacgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcctctgggtgactgcctttgatgactttgttttctctttagcagaactaaaccatgaaccatcatgcagagaatccatcttcgcaatgaggccaagacagcaactttagaaaagctggttcctcatttgggaactcttgaagcagtcagggaccagctacacgaggccaaggagcttgccaaaaagacagagaaggaattaagggaccgaattgcccagctccaggattcaaacttcgagctgagtggttcatcaaaaggtaatcttctagatctgtcccattaatttatgttgtcataactgtatcctcaaacatttggatttcaaacagcgcaagccaccaggatggctcagatggagaaacaaattgaagtcttgaaaagagacaaagtagaattggctgcgcaaagggactcggccttgaaggaggttgaaggtaccgccagctgacaatctgaacttctctctttttaaggcagtagattttgatcataaacgtgttttgtagaccgcaaaatcaaatctcaagctcaatttgacgtcctggttggtaagatcaaaaagcttgaaggagcaagagatgaagtcgctaatgtcgctacaccacttgtccaagctatgttcctcaataacagtggtccgagtgcactcgacgcaaccgaaatcttcgacaagctgagagttgctccagatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaagtgacgttgtagagcaattccgcaataccgaccttcagccgagtagtaataactctgatgatgaaaaaactgattctgactgagtatgaatgtaacaaatggaggttcaacttgtacaatactggtgtatttatgctgtgtttgataattctagccaagtctttgatttcttaaaagcttttatcaagctttgttgagcctagaacccaaagaagctattaaaaactttcagtcctcgcagacgaagtagaaaaaccaaacaaggcaatgatagaccaagtaagcaaattaaattgataaaaaatcacactccattattatgatgatagcccccgactgacaacgtcaagaagaaaacttgatgttgacagtcaagatagggaagtacaatgataagtttaagcgtagaaacgacgaagatgttcaatgttccaagagttgtcaacgagtgtaccgtcttcgcgcttgagtcgataggaacctggtcgggtgacgtcagagatgataaatggcccttcccatagaggagataacttgtgccgatctcgtgtagtttgaattttcctcaaaaccaggtcgccgactagaaaggcacgggatcgaacattgcgattatgataacgtcgcagcccttgtaagtatcgagccgactgaatcaaagctgcttcgcggacttcttctaatcggtgcaagtcatccactcggtcctcttcgtagcgttcttcacggtaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgaagtatcatgccattggctcgctccacctgtccattgctcatgggatgtgccactgaggcatagcaaatcttgattccaaagtcttcacaaaagtctttaaaaactccgccggtgaattgtctgccattgtcagtgatgatccgattgggcactccaaatctatgcacaatgttgatgaagaagtctcgagcgttatctgctgtgattgtgacaaccggtttagcttcaatccacttggagaatttgtcaatggccacaaaaaggtgcgtgtaaccgccgactgcctttttaaacgggccaaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcggtgggccagaaaaaaccctgccggtaagctttgccgacaatggtgcgtgcggcagcatggtttccgcatatcccagaatgtatgtctttcagcaattgcctcccttcctctaaagatacgcagcgttgcagaatccctgaagggcttttcttgtacaactcagcttcatgcataacgtaaagtttgctccgccttgaaatccgctcggcttcatctttgtcttgtgggagttcttgagaagtcaaaaatcgtatgaggggctctcgccaatcggcttcaaccagagctacgtcatgagtgcccgcaatttgagtagtatccttgtgaggtacggtcggcgtataaaggtgttcgacgaaaacatcagagggcgccacctcgcgcttggatccaaagttggcaagtctgtcggcggcttcattgttgtgtcgaagaacgtgactaagctcgagtccatcgaacttgtcttccaatttgcgtacctcttgtcgatatgccatcatattgtcgtcaaggcaggaccactctttcataacctggttgacaaccagctgtgaatcgcctcgaactattagacgctttattcctagggaaattgcaatccgcagtccatgaaggagcgcctcatactcggcgacgttgtgggatgccgaaaaatgtatccaaagcacatagcttaatctttctccagttggggaaatcaagaccactcctgctccagtgcccgaaagtcgttttgatccgtcaaaatgcatggtccagtgctccatcttctccgcgggggtatcctcctggcactcggtccattcggcgacaaaatcagctaacgcttgggacttaattgaaattcggggcttgaatgatatgtccaaagacatcaactccaaagcccacttagcaatccgcccgtttgcttcgcggttatgcagtatatcaccgagtgaaaatgatgtgaccaccgttaccgagtgactttgaaagtagtgagatagcttcctggtagtaattagaataccatataacagcttctgaacctgagggtacctcgttttggagtcggctaggacttcgctgacaaagtaaatcggtcgttggactttctggacatggccttcttcctcgcgctcaacgaccaagactgtgctcacaacctgggaggcggctgctatatacaacaacaacggctcctgcgggtgtggtgaggctaagaccggtggctcggtgaggagtttcttgaaatcttcgaaggccttctgtgcatcgggtccccactggaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaattttctccgggttggcttggatgcccctatgagacaccataaaaccaagcagcttccctgacggtactccgaaggtgcacttttcagggtttaatttcatcctgaaagcgcggatgctcgcgaaggtttcttctagatccgagatcaaatcatccttttgcttggtcttgacaactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccaagtagcagtccaaaaaactgagaagctcacagccggcggtcgagtcgactacctggtcaatgcgaggcaacccaaaaggatctttagggcaagatatgttgaggtcagtataatcaacacacatgcgccattgccccgttttcttccgaactagaaccgggtttgccagccagtcgggatgaaggacttctttaatgaagcctgctgctaacagcttggttaattcctccttgatcgcgtcttttctgtcttgtgcgaatcggcggagtcgttgtttgataggcttggcatcttctttgacatataaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaagggaatctttttagtcttggcttcgctttctccactttttgaaatcttggtagcgggcacttctccttcgctcgccgtggctgcagccagtcggatatcctctcgggctgacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcgtcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccgccgtcgatgagggttctgcgaagcttgacattacggaccactgggtctagtaccagggggtaccgccccgggtggaccactcggtcaggatgatccgagcggtcaaacttgattgcaatttctgaccatcgaagatactggggcgtgtcgggctgaacagcattgatctcccgttcagtcaacttttgcttccttttagactcataagccagggggccgccgaagatatggttgagctccttgcggtggtcttgaaatcctgccggggtgtcgccgtcgtccttcttcctcgacgtactttgttcttcgtcggagttcttccgtgtagtcttggtgtattgctccgcaaactgcctgtagacgaaacaatctttggccacgtggttggagttaggatggtgcgggcattgggagttcatgatcttgtcgaacgtgttgacgcgcgaatgctgtcgagaagagtgagtggcggttgcaacaagttcctcaggcttacgcttgcggtccttatgattgttacttccacctcctcccttagccggcgtacccttgtttggcttccaactgggacctgactgctttgatgcggtgacggcgtcttcggccttggcgtactcgttggctttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34923 - DNA, 498 bp, Oryza sativa
acgtcatgtgctgaggtgcagcagcgctgttcttggagctgctggagccgacggagtacctgctgtgctcctggatggtccctgaggcgaggtgaccgacgagatagcggacggcgttgttctgcgcaaagagctcctggcacgtagcgctccggtcagcgagagtaccaatggcatcggcaacggcagcctgcacgcgcatgggtggatccttgagcgccgcggcgaagacggagcacaccccggcctggacgagcttatcgatgctctcgtcgtcgcagccgagcaagccgagcgcgcgggcggcggcctcctggccgtcgtcggtgccttccttgagcagcctaagcagcggcggcacgccgtcctcctcgatgatgagcttggcgaagtgctggctgtcgcgggcgagggaggcgaggttgacggcggagtcggcgcgcgcggcgagcccgccggtgtggaggcgcgcgacgtggtcccagatgaggaacagta

SEQ ID NO: 34924 - DNA, 6308 bp, Oryza sativa
ccgcgctgcgctgctgctccccccttccctgaagacgacggtgaggtacccctctcgagctccgtgtcaacggcggtgggcgacgagtcctcctcggaaagggcacggcgggtgtcgtgcgcggcatgtcgtgctcgtcccccataaccaaaggcggctgtcgtgctcgtccctcatctccgcctcatgcttctgcggaggctcgccggcgcaccgacgtcgccgagcggcgggagcctcatgctccgtgcatcgatccgcctccgccaccggccaccatctcctccttctccagccgtagacgcaaagcaagagagagagaagggaagcagggggaatgggattggggagggattggtgtgaggaaagagatgacatgtgggactagatttttttaatgttttattttgctgaccagatgccacgttggcggccacatatgctgattccagttaaaaccgtccaaaacagtgctcggggggttatttgtccggttttagtagttgagggtgtaaaatgtatggttttcgagttcaggggggtaattcggacgaccgtgatagttcggggggggggggttaattcgtactttttcctttactagaaaaaatgcccgtgcgttgctacgggtaaaaactttttttatcctatacattatactccctttgttttggaccggatgcttctttgtttttggaccggacgttcattccttccttcttttcagctctagtcctagagcagtccgctacctctatctgctcggcctatctctcttcgcctcagcccacaagtggagctgtaggcctagctcgaacaatctcgtgcccgtaccatgacggagccaaacctcccatcaaatccggtaatctggtcgagctcgcatagtaccgtgtccgtatgatggcggagttgatcctctctgtcaaatgcggtcgaatctttctcgatctccaaaattattagagattttgatccacttgatcccctttttcgtttttttaccaaaatcgaagcaatccacaaaacttggggaaaaaaataatgaactgaaagggaaattcaaggggaaaatgacgagagtagtggagaatcgatttttgcaatcaattggatgaggaaacacataaagatgcaaatcgacatggcggcggcgctagggtttggcccgacgaaaaaaccgcaaaaaaaaaatagcgaaacatagttttcctttttacaatcgttttttgccgcactttttttttccgcctttttagtaggaataggaatcggtcagctttttttttttgccgcatttttttgccctgggattttttaattacaatcggacttttttatcatttttttattaacggacgaaggaaacatcttaaactctatatatatatatatatatatatatatatatatatatataaaagtagtagtagatccgtggtaactctattttgttctctagataaccaagacaaaatttgatttttgtctggatttacaaacttgaataggacttatatttctgaaaatcgtatgattgcttgtgattcaaatactccaagccattgtgatgataatctccatgtaaaaggggaaacatatgtatcttcagagagatcagtaaaaatatggcttcaacttgcatgcacgctacaaccggccagcggcaattaaccacaccggacacgatgtcagcatgcacgtcaagtatacagaacaaatgaccgttgaaccatgtgctgctagtttcacccactcaatcaaggagcactgttgcaaaagataccatgtggcatccatcccaaggtgcaaaaacttcaaaaatctagaaaaccgatatggtagctagggaagttattaattacattctccgtttcatattataagttattttgtttttttcttctagtcaaacttttttggtttgatcaaatttatagaaaagtataatattttaaacacaaaacaaacgtattatcaaaatatatttaatgttacatttatagtaaaactaattcgatattgtagatgttgctaatttttttctataaacttagtcaaacataaaaaaatgattagaaaaaagttaaaatgacttatagtatgaaatggagggatcagtataaattagtattcttgagcagaaggttggtcaaaaatagatgttggagagtatcttcaaaattcatccttcctaacatattcctatttttcaatctatctttcatgaataaccagaaaaatactttgtgtttttttaacatatgaataaaatgttgctactaattcactaccttccctgcacgctgcctcccatcattccttgctagcatggctcgttccccgtgttagagtataagtgaattactaccatctttctttgcaattgccccttcttaattagtttaagctcttattttgaattagttgttaatacttatatttaactccatatgttatcggagtgaagtcccaaaatcacaaagaccaaaaccattcgcttttgagtaaattttagaaagagtaaattgctcccacggtacaacaacttggcatgtggatgcgatataatgcaagaacttgaaaattgaacgtccaagtgcaacaacttgacaagtgggtgcgttctagtataagaacttaacaatttagtatttttgtacatcaacttggctaagcatatacaaggtgagtttttttcacgatgtcaatatgccattacatagtaatcatatggatattgccttataagcacatagtagtacaatttacatccaattacctttaagattttttttgttttcttcatcttatcaaatatcaaccgaaatataataatttctacatatagtttaattggctttcagttattagttattatgataaaaatataaatacacttatcaaatctgtgaaatatgcgctagtatattgtcaaaattagtacttaaaaattgaatttataaaaaaaatgctccaaataatcaagttgtagcataactttttaatttactgtatcaaaatcgtacctaccttgcaagttgttgcatttatacgatcacttataaagttcttatactaaattgcacctacctaccaaattattgcactagaacgttcatttctcaactcaagttattgcactaaattgcacccacctgccaagttgatgcaccatggatgcaatttactcttttagaaaacttcgtgttgtatggtcaaagttgtagaaaccatatgtattatgacacgcggcatctaacctcaagtattgttgttttcaaagtttcacaaaactccacccttatgcattttgagcatgaatttacttaaaattaaaaaacgtagagtgcaaatgaaaatttaattattaagttattgactagattgatagaagctttactgtactttcaaaattttatttagatatgctgaaatttattaagatttaaataaagatggggttttatgaaacatggagaccataaatcttgtggtgtgccacacatcataattaatacatatggtttccacaactttaatcatacaatatggagttttctgaaatttactctttagttttggacaagggaataaattaaacggtttcaaaagttgaggagtctgtaatacccgatattaaagttaaggggtatattttagactaatacaatcttggcggggttaaatggacttaaacctttttaatgtactctatgcattttaatcctttttgttgttttatcattttaggtttgttcaaagtctatgtaacttaaaatggaatggagggagtaatagttttatagatatatactactcagtactcgtaaaggaagtcgttttggacagcgatacggtctccaaaacataactttaactttttatttttataaaatatttattgaaaagtgatatatgtatacttttatgaaagtatttttcaagataaatctattcatataatttttacatcttcaaactcaacaacttaagggttattcatgatttatattcctaatgtttgacttaaatattgtccaaaacgacttcctttacgagtacggagggagtatatctcgttccaattccgtattataaacgattgatcacacgtggaatatatacccaaagataaaaaaagccagtagtaagttattttaagtttttatttgcaataggctaatatatgtagacaagtgcatatccaattatccatgcatatatatcagcgtatgcacgtacagtggatttgggttcaggttgatgtgatggattgcaagcatgcatgcgtgtagcgcacaagatgctggtgcatcttgcccacaggcccaggagacctacatgcatggcccatccatgtttcagcacgcgggcaggacaagacgtagcagtagcacttatagttggccgaaaggcccggggtccaatggctcggcccatagtatggggttttggcccagcctaaacatggcacggtccgactggcagtgtcgggcccttgcgtgggcctcttcctcggcacgatgggccagtttggcatggtccggtccaacaatcaaggagttaaatagatgagcgagccaaaataaacttattccggctatataaggtatatatggcacaaatagctgcggcgcaaaatagacttaatctagccaatggcccaaatagatgaggaacgcaaaatataatttttttccaaggttgagcacggtgggccttcatgcattcaggctggtccggcacagcacgagtcatattggatcgtgcctaggccgatggtacagcaagtgggaggggtacgacgtggcctgacgcacttctctactattataaaaattgaagatgtttttgccggtactttgatacgtcattcgtgttttagtcggtttttaagtttattcgcttttgagaatacaaaaggagttgtataagaaatctctttaaaaaaacttgcatgaaacttgagaaaatcagactcctaactgcgggtcatgattttataaaaaagaaaatcgagcaaaatcgcacaatgaattttaccttagttaaacctataacaataataagattaacataacttcacccattgcaacacacgggtatttttttatagtagataaaagaagctattttccctttcgtaaaatacttaaattatattatgtttaataatgttgcacagtgaaggaggaatagcttatatgcatacaatgcataatctaccctataattcaccaactcactcttacacctacattactcattcatcaaatccaatggctcatattcatctaactgtgatcgaacgtgccagatgagaccccctcccctccgcgctcctcccccacgcggtcacgcccacgcgcggacgcgccttctctctctctcgctaactcctgttctcacgcgcccccttctctctcgcgcaccgctattctcgcccgttcccctcacccatcgccgccgcgattcttgcccctcgccaatcgccgccgtacccaatcaccaaacactaccccaccgccggcatgcccctgcccctcgcctatcgccgccgcgccgccgctccaaatccccaaaccctaccccgcccccagcactacgggttacggatgccaccgcacctcctccattgagacgagccaccatggaggccaccgtctttgctccccaccaggtcgccatcctggcactgccagcggtggaggcggaggcggccggcgccgctgcaccgggaggatggctatgaatggcatgagatcgatatccaaggtcggggctgtaatgaggaggtacacccatggaccctgccggaccggtgtgtgcggtggatgcgggcaaggagggaatcgcgcagctggtcaaggaaagatcccatctctctctgttaatcccgatctcctcatgagattgctcttgaggagagggagtacgtccctgaacttgattccttgcatcagttcatcccttctgttgaggctttgagtggctggggcttttgatgctatgtgctcttggtttgactcgatttttgctttgttttggtgcatgcagcaagatcatagagttgagcaggaatggaccagaagctatggctcgctaactggcatattgaacaggtaaattcccatatgctagcagtaagttttcccctaaattatatcccggaaacttcaatgtttagttgccaactgaaatctgtgtaatgagttattattcgtttcacgcattttgttggtgaaacttgcttattgcctcttttttgttctgcaggagcacaaccttaggagggatagagtcag

SEQ ID NO: 34925 - DNA, 15836 bp, Oryza sativa
caaaatatcagaattggaggtttggagatgctcctatagtggctggaaattcatctggtcacggctggtaagttgaattattttctattgtgatttgccatctccagattaccctgctccttgcaataaatcaatctcccatggtattagatttttttctactcttccatcaataaaaatgatggcacatgattgctggagctgtataggtgaacgtcggcacacatgttcatacttcataccggcacaggggacattgcagaaaaaaaaagagaagtagatttcaggttcgatcgccactgcaccccagggtctcacgcatcgatctgcacgcttatttgtagtcaaactaatgcagctccaaagttttgatttgatttgctagatttagaaatagcttaacaaattgttctgttcaggtgtctcagcttctgcctttgtttcaaatgtgtttagctgttaaggaaaataggttaggcttcacttccgagattatgcactagtttagaaattttttacgatatgatagtcccagtttctgcctttgttacaaattggctgcccttccatatgaaggaatcacaaagtcaaaacactgttagattgaatggaaaaatcatttaatttttcgaaattcttctatttgttattacatggccttaattctagcagctaaaatcaagatcatcttgcttatcttatttgtcttttcatttctaacaaagctaatctcaaccaaatactccttttttggtaggacagatcgtctttctcgtgcccaaatgccgtcctcggtcttgctacgcagcccctccaaccgtgcaagtttggatcctctcgatggcggaggacgtcaggcggtgggagatggatctgctccccccgccgagtgcgtaggtccggtcctttccattattttccctgctctctttcttgatccaatttgtggagaatttgttgcgtgctcgacattattacatgcaacctgttctgtatatctggaattcttaggtgctgtttgttcctttcgtgtgtgattatgcgttggattgtcttctacaaccgcaggagaagctaggctgagaatcgctggtgagtggcagggaagaggaacgtttaattgcttagagtttcttggatgggagattctagagagatcgcagcaggtttataaaatgctatgatctagatgaataggtttcctgactattgttgttcatttaaaattgaaccaaatatgctgaaactattcactgaaaaaaggtcaaacagaagaattctactgtcacactgcactttcaaaagtgtttgttgatactggattttattctctttatgttccttcagtattttttcttatatatcagaattaaatagtttacaagaatatgagtgagaattattctccttctccttctcctgaaccacatcatatcattcttaattttcctgaaatgttgcatgcatcctatggtttttttggactgctttccgtggtgcctagctcttggtgctgtgcaatattgatgatttatgcgtcctgtgtattcgcagggtataatgaaatttgatctgaacatatgaaatttgacaaatgcatttccatgatccgaaaagtttatctgcagatttaacatagtattcatgtccattttacctttttcaactcatttacacgaacaaaattgcagccatgtaaaagcctagcgctttcagttaaaataaataatttattatcatttgctattaaatgcttaatgcctatatatttgctttgctacatatttttgccttagtagaaaccgggatgtttttccaaatattttgggagttaaattactaatgctaagtgatgaatatatctttataagcgtgtgcctcgtggtaggcgaatacactgtcttcaatatggtgcttctcctgatatgcgttcgatagagaagtttatgtggcttcttgaggtgctctataaggaggaaggtgaccagtgaggagcagaagttgctgaatgtttccaggcgatgcatgttttgaaaaaatagcacctgtagaacgtgcaggtaatatttgtatatgtggtatagaaagttagataccatgagctattgtttgtgttttgaaaagtttcactcacagtgatgaaaatattgcagaactctattcatggccaattttgggaagttattaacagtgtaataacattcatgagaacaatacaaatctctctatcgttattttattcgtgaatcttaaatattaccttttgccttttacattatcaattatcaccgttgcgtttcaatcaaaattatcaccgttgcgttagcacggacatattattactagtgtattagatatgccaataaatggaggtactacacaagcacttctgcacgaacttaattttattctcacacacatcgatcgatcgatctcacacagtcacactctcctctcacatctcacaacttttattattctgcaccaacaagctgacctggaaattaatcatgcaagaaccaaaaggattaaccaagccatgaaatcaaacaaaaaagcaagtgtggatattgatggaatggatgaattaaaaattcagctgtgatatgccggccggagggctgggagccggcgccgcagctccgccaccgtttgccgcgccaccaccgttcgccggcgtcggcttggggccttggggtctgttgtagaaatagtcgaagaaggggcacaggaacgccgaggtgcactccgccgacgacgagtagtgcatcctcttgccggcgacggcgacgaaggtgttagccttattgccgccgttgtccgtcgttgatggcagcggcacgatcttggacggctcctgcccggggcacggcgcgctgctcgccgcgctgtgcagctgcgcgaagcagccggcggcgccgtggaggtcgtcggcggcgaggggcacgctgaaggcgccgtcgccgtcgaggtcgccgacggccttgctctcgtactcgccgtcgctgttcttgcacttgatcgccacctggagacctgaacatcaccaaacaattaatcaacgacggtgatatatcgatcgcaattaattatcgatgaacatattatcatcatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgcagacgatggcggcgaagagtagtgctcgtgctacagctgccattgctgaatcaatcctagaaaactctattgctctttggactatgtggcaagaggctagagctgtgtgtgtcgatgagtgaagaaaaatcaggcatatgcatgtggtttatatagatcgataaaggctactagttgggagtgatctgaggtcagctaattatattacagtacaacatgattagcaatttgcgccgattttgcaggtttaaaatcattcacgccgtgcattttatttgatttgatcagacaccgatcgattaagagtagcagctagcagttcatggaggcactgtgaacattcacactgcatgcagtggtgactgttgatgctcttgccgccgattggtggtgtttaacaagcaaagttaagctttaatcgactggtactcctagagcgcacagtactactagcctgttttatgaaaagggagaatagttctgtagtataggacagttccaaccaaattgcatgattgatactatttgtaagtaaatgagtaaatttcacaaaaaactacaaatactttgatcaaactattgcaaaactattgatttaaggtattatatcataaaactaagtacatatagtgttaagtttatcacaaaactaaagatttgaaatatatggtcacaaagctatagattaagtaacaaaattattacaaaactacatgtttatagtgccaatttaatcacttcctcctgattgatattcgatgtgacttgtggctatggcttatgattcgatgctcttctctcctaggggctatatatttatatggacaatcaattttttgttaagtagaatttgaggagttcatatgggatatgaacaagtaagagtcttgtcagatcctgtagtcaatggcacatgagcataacccaagagtcttagcgatgagattgccgaagctttcaaaaatgctttcggcatagatactagggttaaaaggcgtatatatcaaaaactctatactggccactacgataatgttcaatatcctcaagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaacactttctgataaggtcttggtagatttggcttattctggtttacttgaatatttaaaagaaaagctagatggtcatactttcttagatgtaagccaattacttcaaaaggctttaactcaagagagccgagttaaagaggccaaaatctcgcaaaaagttaagtctgattgtgcccatgttaatatagttgatcaacaagaatctttgaacaaagagacagttgatgtatacatacacaaatgggttttgaactccaactctaaaccatccgtttgctccgctcttaagctggttagtcgtaagaatcagcaagaggaaataaagttcacgtttgatgtggccaaatgcaataggatttttgaataattactagtaaaagaagaaaattaaattgtcacatggccacgccataccttcacttgaagaatagagcggcgagcatattataagtgtcacaactccaattctcatgccacaaatgattgcaatgtattccatagacaagttcaatcggcaattgacgaatgacgattgacttttacaaagatgcaggtggatgagctaccttttcctatacagaccgttgaattgcaagagaaggagattcccgatggcaaggagaagaccacattgaagacttcaatactgtcggtgaaatgggcccgggggtacgcacagtagagggaagtatccttcccatctagtcgcgtggctacgtgggctcgccttcccccggccctcgggtagcgctgaggtggccagagggacctcggggtgccacgtcgcactcctcgggctttcggggcgtgctaccccgaggccctcgcctgaccacctcgtggcggggagagcgggcggggcgaaagacactgctccgcgccttcaatgcgcggtgcaccaaccgccccaagcagcatttaatgcggcgtggagggatgtgcggcgccgctcgattgacccatgtgttggtatttcttacgtccacagataaatccgcaagcgcacggaatactgttgtagcacttcaccttcgggtgaccccaaaaagatatcgaactcagggaacgtgtgtaatttacctaaggctaagacgatccaatgacaacaactatagataggctaggcaagctagagaggactttctatgtgttttaattatctaagctaagttgaaggtaatttcctatttgttgcttcgggcaccgacccctgctggtctgccagcgtggttccggctatagctctatgatgtatccgaacgtggagaattattaggacgggattcagggctgttaccacttgtcgcctacctctgacaaatccgtgggatacacaacaaacaaaggtaatctctaacctagacaccacgtctaagttattaattactactctaatacttgtacatgaacttccttctttatccagagtcctagtactagagcacttagtatgaatactagataaagaacccgcaaagatgaaaatctatcttacttagacaaagtaattaaataatataagaaaggaacacgaatgcttactttatagaagaggttctccgaacccagagcagagtgtaccgacagctccggtactccccccgaattcctcctaggaagctacactcgtcgagatagaagtcggatgagcgccaaacttccgggcactcctccagagcttcccctcactctctaccttattataatgtacaaaagatacaatagagcctcttataattcagctcaaaattgtgtgtcttggaaatgagaatgtgacctccttatataggctccaaatgacggttaggggtatgggaaatgaccaaaacaccctgcaactgccttaggggagaaatccgagccgtccaggtgaaagcagatgatgggaagcgccaggattggtttgtccgaactggtgggttcggccaaacccaaaaactctcctcccggcctctccttcagccgggaggttgcttattgggcccccaacaacctgggctatgttttggcccaattctaaatggtttttattgacttattgggcctctaatccgtgtaaacgcgtcctgaatgcgcggaggtgcattttgtcacatgacggatgtgttttctcctcaaattacttgcatacacatatttcaccaatactagtggaaatgattagtaataatacctaccactaagttggataccatgttttatttcattatatgcaggtattgacggtccgatattatgatttaaggaccgtcaacaccatatcaatcgagcttgaccggcctgtgaccggtcacaggcgacgggacgggggcagtgcccccacgttccgccctgtgtcaggcggagtgggggcaggtatgccctgtcccatcggcacgcttccaggggcgccccacgcgcgtggtgagccgccgaagtcttcatacaataatagggaatgacagggatgtcccccgtgtcaggcgggggcggcgctgggccccacctggagccaggcgaccatgttgcttccagttgaagcaaaggatagcggtatgattagggccatgtgccccccctccgatggaggggtaggtgcaaacagtgcatgtggtatccccttggactataaaaggaggacctcgcccaccgagaaaggggacgactctcagagaacttgagctcggaggaagaacagctaggtttcccttagagctcaaaacctcatgtaaaaattcaccataatcccatacacaagagtagggtattacactcaataacggcccgaacctgtataatccttgatctcccacacagccacgagagcgatctagcgattagaccgcaagcggaagtaggcccttgatcatcgtgccatttcccccggccgaactcacaaaggggggggtctcacgaccacctgctagagaggatcattcctcgacaaatacttaggaggcaagacgacaatctggagatatcaaaatatggcaagcgaccaaggagatcaagttcatctaccaagcgagtatgcaccaccggcaacttacttctccttttccatggtattacgcttggtataaatgtattatagatttttaatggtatgtggatgatgcctttttatataccatattattatccattatgggcattgccagtttccacattgacccattttaaataatcaaccacactcatctcatagccggttgagagaaaagaatcagtcacaaaagaatccacacaagaaagtggtgaggcaagagtggaggccaaagaaaaacaaaatacaatctgaacaagagaggcctctcgtagctttcttacatcaccattaaacatttaagccttagaggaattcatggtcggtattggtggatatcgcccttagatgatctcatgcatagtatttttttggctcataagtttgccaaaaagacagggggggcatgtgttgataatcaaatttggtagtagggtcgagttatagcaagtttgagccaaatttaaaaaatgccagagctttcccgcgaaggctggtctaaccgtcattatgtggccggtcaaagcagacaatgcactgagattagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgtaattggaaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgttgttggtgcactttgtaaacatagagagaattaataaagtcgtcattcactttaagagttcttcgatttgtgtttcaccgggtttcggcggtctaaccgacaactcaccggtggtcagaccagcggcattgcggcggtcagaccggcgggagcacggcggtcagaccgacggcggcgacagtaggcggcaggcgatcacggcggttagaccggtagatcaacaccggtcagaccgggggctacgcttcggtcagaccggctaatctacttcggtcagaccgatctccatcgatttcgagggtaacttttatttccgctaaaagttttcggtttttgggtataccaaccattcaccccctctggttggcttagttcttgtgattcgatcctacacgatcgatcgatctcacacagtcacactcctctcacatctcacaacttatatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgccggcgatgtggaggagtgcatcctcttgccagcgacgacgacgaaggtgttagccttgtcgccgccgttgtccgttgttgacgacagcggtacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggccttgctctcgtactcgccatcgctgttcttgcacttgatcgccacctggagacctgaacatcaccaaacaattaatcaaggacggtgatatatcgatcgcaattaatcaatgatgaacatatcatcatcatcatcatcatcatgatatatatatacccttgaaagcatcctgcgccatcatgttcttcctggtgcactcgccgcacttggcctgaccgacgacgaccgccgccacctcgccgtccgcagcagcggcaactgccatcacggcggcgcagacgacggcggcgaagagtagtagtgttcgtgctacatgttgaaattgtatcttcagctgtggccccatcgtgatccattttgcagttgcaacggtgtggagaataagtcgccagcaggttgttagcaggcgcgggtgatgcggcgatctgggagttgaagaccgtgtcgtgtgcgtgagtttagcgcaggggagtgtgtgtgtagcgagtcagagaattgcggatcgtgggatggcacgatttttgcctcggattcgttctgttatgtatggagtataaatagtttatttagctcagttttacagttgtaagtttattattcagttgaatgaaaaacaaccagaaaattccccaaagattgtgcgatctagttcagagttctgaaacttctctgttcttcactctgctctgaatttctcctctcagttccttgtcactgttgctgtgttgtgccgtgccggacgcgtgcagtctgcgcgcaaggtgttcgatcagggaaatcttcgccaacactactgatgccattgcttgatcaatcctagcaattagcaaactctattgcccctcctccttactatgtgtggatgagtgaagaagaagcagaggccatgcatggtttatataggcgccagcatgcatagcatcatgtagatcgataaaggctacctgggagtgagctgagatcagctaattatattacatcatgattagaaatttgcgccgaatttgcaggttcaaaattaatgccgtaagtttgattttatcaggcagtaccgatcgattaagagtagtgcactgtgaacgtgcacactgcatgcagtgttcacccttgatgctcttgcttccaattggtggtgttaaacaagcaaaagttatgctttaatcgagtagtactcctacagtacacagtgctactagtccgttttattaaaaaggaggatagttctatactataggacagcttcaaccaaattgcattattgatactattgtgctttcttattactgtcttggttaatttggctcttggataattacctgtttaaatttatcagcatatactgcctactagtatttgcagaaatcgaagccagcataagtttaagtaaaatgttattgtgtcttcgtctattttaataacgtagtgtacgtgagtatatgagtgtggtgtcaccgactacacgtgcatcttgtctatgtaatggaaaaagaaaatctctttgctttcttaggctgaatccaccatggcagtccagcgcatattctagatgccaacctgtatgcatgacccgacatgagcatatgtcaactaggcctttttctttacctcttcacccaccttgcgtctctgcaacacacaacgccacgggctgagataaagacgagaatgctccagccagacgctagatctagcccaaaaaatgggtagcccatgtccaagccaccccatgaactcctccatgaactcttttgtacacaatgctatctttttatctgaattttaggtagtttcaaattgtatttctatatggactatttcttgtagttttaatttttattccgacttttagattgaattatatttatacatataattttatttcaatatttattttaaatttttaatccgaatttcatatttttcagcctaaaaggtatttctacgttgactcttgtcttaatttaatttttaaatacgaatttaagttttcttttcaaaattgcatttctacatgtacttcttttatccttttattattattccgaattacagatatttttaatctatacacttggactctatttttttcttttttattaatatgggaaattctaggtcatgagagtgaatatggtggcttttatattgttttattgagttaataatagatcgacagttacaggtgttcctttttctgttacttcatgaatatttcaataactagatgaaactctgcgcattactgcggaaatttagtatgataacaataaaaaaaataacgtgtaagataactagataacatcagattaagtaaattaatgtggtttacgataatttaaatttaaatagtatgtagaatggtgattcaaacgtaaaaagtaaggtggtatgactttatggaagaagaaaagtagggagatagtttgtaccgtagattaatcatctaaaggctaaaaacaattgatgtgatatgacttaattagaggaaaaaaagagaaagataatttgaaccatagattaatcatttaagcactaactaagtgaggatgaactatataagtatataggatatcataaaacataataaagatatacattgaaacatgatgtgaattcacataattatgttagattataatttaacatgtttgtatttgaaaagctcttaaattataaaaactataaagatatagcatgtttgcatgatgtttaaatgtgatgattgttagtgaatgatgatgtggtatcttgttaattagtggatgatgatgtggcatcttgttagtggatgatgatgtggcatctttgcatgttaagcttaagaagttagtgggggataactttatagtaagataggatatatttgacatttacagctagctctttttttcttttacttaatttaattttttttatagtaagataggatatatttgacatttacagctagctctttttttcttttacttaatttaatttaatctaataatatatttacatgttacagctaactggacaaaaaaaataagggctaaaaaggaatcgaagtctggacctatagagtgtcctcgctagtggaaaccactgcactagaacagcatattgttatttttagtgcaggatgctaaacaaatatttgggtgttagcgtaaacctcatcagcacaaaatcatttatttgtccccaaaacaactcacctaaaagaaatacttagcttcttcatagcacagcaatattttgtatatagtacaaacaactgaacaaataagtccatttgaacacacgacgaaaaaattcattgagaaaatagttagagaaatatatcaaggcagataacaaaattagtgataaaaaatacttcaaaagtgtatgaacatatcacacgatcgaaataacagacaaatcccattaaataatgaagtctatcacaacaaaactagcttgttgggtcatcctcatcactatctgatggttctgtacccatatcatatagatccctcggcctatatggttgtgcaacatgccatccttgtgcttttggttcctgcacatagaacacctgtgatacttgtgatgagaacacaaaaggatcatgctccatcttctctcccttatcttcctctgtcacctccttatcacaacaacaactcaagcccgctggtcaccgcgaacttgttctccttcgagcccgatgtaagtacttttttttttaactaacgtattagtattttttaactaacatatcatattcaatggataaagcactgtcgctatttagaggctcctactgtgtatatattaaatatatataattaaaaaagaaactgtatagatctcaatgcatgctgtctagccattctataatcggaaaaagtacgaattaccccttccccgaactatcgcgatcgtccgaattatccccttgaactcgaaaaccagacattttacaccctcaactactaaaaccgaacaaataacccccctactcaatctctggagtggttttgatcctacgtggcatacacgtgtcagccaagtcagcaatcctttaaaaaaattcggtggggcccacctgtcaatctctctcctgtattgctcaccttctctctcctcctggattcatcccctcccctcgctaaagcacgcatcggcggggcgagcggtggcggcgggcgcggctgagcgagcggaggtggctgcgggcgcggctgggtgagcggcgccggctgctgcgggcacaattgggcgagcgtcggcggcgacgacggcggctgcggatgctagcctcgccggcgagctccgccacgggcccccaccctggcaccaccgcccaccgtgtccacctccactatgccgacgtccacgtccgtcttggtccgcctcggtgcgtgggcgagcgcctcgtcgccgtcgccttcgtgcaccaccgggagcaacagcacggtcgtcgcctccgccaccacgggcacggcggggcgcgagacggcggcggaggcgctgtcagtgtcgtcgtcgtccatctcctccccggcgaccttcctccctgcacggtcgatctccagctccacacgcgccctcgcggactccgtctcgaccacctccaacgcgcgctccagctccgccacgtagttgttaacagtgaaatttggtaagcccggagtagtcatcggcgtagagtcagcatcggcttcgaagtcttgagattagccgatgagagttgtcaagtcgtcagttgtcggattcttgctatattcggttaaggaaattgatctactaaaggaagcttatccagaagagaccgagtttaaagagaatacggcatggtaagttatctattaattaggaatagtttgttagtttccttttatctttaggaaagtgtgtttagtgtcctataaggactttatcttttccttttatctttaggaaaggttctttcttgtccgacaaggacttatatccacccatggatataaatatgtacacttggggtctatgtaatctgtcctcacgatcaatacaatgccgcgcatcggcaccttttttacttcaacttttgttttacgttccggcggaacttggcacccgacgcggggctgcatcgtcttcgatctccg

SEQ ID NO: 34926 - DNA, 1670 bp, Oryza sativa
  unsure (1)..(1670): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcgctcatactttctgtgttccacaactctgtgtttggtttgcttgtgtgctgatcagtagaatcgacaggtttctcaacaattttaaccattctgtggtcacaactgaaagattatcagcagatatacatttgctattctgacgccccatatatatataatcaaggaacacatgcgtaaaaagaaaatccaattttattgcaggctaaatgttcaattcagccacaacatgcacatgcagagggacagccagtagttgcacttgagcattagataacaaaggagtccagttacattcctccaaatgcaattgaaataagttcactttgggtccctgcctagtccgattttcatcccctcgtcacaaaaccggatacgatgggtcccccaacttacgaaaccgtttaaatgaggtccctcggcggtatttagtccagttttagctgaggtggtacctacgtggcttcttttgactaggtctttatccaaagtgtcgttgatggggtgtttatgtggcaattagattcgaaaaaataataaaacacgtgggacccacatgtcagtttcacacacaaataacaaaaaaaattgtgggcccatgtggatccacacgtcatgctcactacctcttctctctatcccctctctctctatcctctctctctccctcttttctctctccagccggcgaagcagggagggcggctcttgccgacaccgaagtccctgatgagcaggatcttgaagctgcacccgtcctcaccaccgccgctgctccccgcccccggtggcgcggcccacaacgccggccgttggtcgaaaattccccattccaaaatcccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgtagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttccgtaattttgtttgtagatttgaagagctatttcaccaggtagtccagtagttgccgagcagtatgctttcattccacagcgcggcggggggagaagtcgcacgacctcgacggcaccgtcgtcggcgggcccaacggcaacaacgtgttcaccgaccaccggggcgcgtacctacagacggaggcctgcacgtacaacac

SEQ ID NO: 34927 - DNA, 10766 bp, Oryza sativa
  unsure (1)..(10766): unsure at all n locations
cccacgtgttttattattttttcatctaattgccacataagcgccacgtcaacgacacgttggacgaaaacctggtcaaaaggagccacgtaggcaccacctcagccaaaaccgaagacagtaccgccgaaggaccttatttaaacggttttgttaagttgggggacccatcgtacccggttttgcgaccggggacgaaaatcggactaggtgataaatagagggacccaaagtgaacttataccaatgcaatttcatatcaaacagtcacggatgggctttaggaaagcagaactgggcccggcccagtagatcacatagcccaacaagatctaaaccgcatgctctcgtttcaacaaattatcacaccgattgcatttgcatctgctgcacaggctaaatcaaacacgtagccatgaaccattcacctcacaagtcacaagcattgcatttctatggttaccagtgcaggacgaaatgctcaactagcccaagcaagaatggagcatgacaacctcaggcaccaaaagctctataaatatttgcattgcacaaatcaaaagtttccaagttttaatcagagaagttcaagatatcagaaagaacaacacataccaggatgtctcagctcaagtcttctagcctggctgcactgctgatcttcctcctggcagtgttcaccactgcagcagcagcggcaggtacagaatgccagaacgatgtcgaggtgctgaagacaacctgctacaagttcgttgagaaggacgggccgaagctgcagccatcacctgactgctgcacctccatgaagggcgtcaacgtgccctgcgtctgcacctacctgggcagcccaggcgtcagggacaacatcaacatggataaggtgttctatgtcaccaagcagtgtggcatcgccatccccgggaactgcggaggtgagcaggcttcacttgattggccacactgatcacctgggtaagaactgacaataacacgccggctcctctggattgcgacttccagtggggcccaggtgtcggtgtcagctgggtaagttggtgtcatctggtatgggaaactttgatgttttgtacatgtggtggtgctcttgtcaacattatatagataaggagagaataggacaaacatgacgcttgaatagcagaagagaagttctatccagcaatatcaaaagtacagctgtcattttcaaaaaatgtaaaacaaaaataaaacgaaaaacccactatactagtgccaataaaagaagaaacaaaagagaactacattattgtcaatgccatttgttgatgttattattacttttgtttataagaataacaattgtacttataaggcctacgatttattacaggatccaaggtctaaaacaagaactgattgacttggtgaagttggctgacaaaagcaaggcacctagcagttgcacggctgatataggtaaataatgttggtcaacttttagagtacacggattgtacgtcaaccttcagcatgttgtgataacaaaatatgtatcaatgatggttgtctatatacactgaaaatgcaagagtatttttaaatcacatgttgtattgagtattgacccagctatcaactgtttgttgatgtgccctgttccttagtctgataaatgctaatatagcacattgctaaaagcataaataaatatctagacatattggacagggtgaacgatgaagaaatgtccaaactccaaatatgagtaggataagtttgaaaaataacaaagtagcaatatataaaaacaatctagggatgctctgcaacattaaaatcaatcacatattcagcaatctgcatctgccaatacaaaacaatcaaaattaattttcatacgcaatatgtagggcaccatgatatgcaagatccttcttaaaacaattttcttggagttcccatgcttctaaaaattgtagatgagcagttgacttatatgctagtgttttgattttgagtaaatttcccagaactacaggtattttgaccaaactatcgcgaaactatagatttaaggtgttctgtcacaaaactacatatttagcacaaaatttatcacaaaactacagatttaaggttaacatcacaaaactgaatatttaatattgaagttatcacaaaactacagcttttagagtttaaatccctagaaccgttgttatgttggagctatacacattattattttgttcctaaattggttctaagcctatagttttatgataatttagttactaaacatgtagttttgtgacacttcattttaaatgtgtagttttgtgataaatttggtattaaatgtgtagttttcttttgtttttgaagctgaataatgtgaaattgcttaaaagttataaatagcctggtcaggaaccaaagcttcagaatcccactcttgcaatccaactagacagaagtaacaagaaaaacaatcagctaaatttttggccaactttacaggtacacatataatctgtttaaaatgcctcttgaattacaattcaataatcccaaccaattttactgacagattgattgctagagatttgtacaacctacggagaacaaaactccgatagaacaatcatgaacaacagaaaaaaaaaatctactctaattacacattgcagcaaagaaattactaacccatgtctgctggtcttgctgccaaaatcacctggaggctctggactggaagagttccagccttcccttggcatctggaagtagtgcatcgacacgcatgtcctgtatcatgtgagcctgttttgatgcccagagaagcacagcaagcacaccagcttgagccagctcctcactttctggcacgtgcaatgcaatgaaacagagcagtatcagtgcctctatctgcacctcatcaccgagatacaccagctggacaaggtggcgagcaccaccgctgtccacgatggccttgcagtggtttacatgcaggtggttttcattgcatgcgaacttggtgagcgcaagcacggcctccttaatgactggtggctcacgctcatcgagcagctccacaaggggagcgatgacgcggttctcactcgctgtgaaagtgcgtgcaaggcagccaagagcagtaatgcaagggagcaagagatcatcgtagtctcccttgctgacaatgtgaagcagctggtcgacgacagccttggctgctggagagctaggcttgaaagccgactgtcgcagggcaaggctgtgctcagcgacacgggaaatttccatgattgccattgctgagaagtactgtacgctagtacccatgccaccatcacccttctcaagaagcaccgcgaagcagagcagtgcacgcgaatcagtaatgctcttgcagacacctagatgaccgcgggcaagcttccacagagctctcgctgccatggcctttagccgtgccttggtctccggatcctccacctcccggacagcaccacggccactagaaccactcgtgcccagctgtggcctgaagggtggaaccaacgacccattcgtcttagtcttagcagccatcgcggattgcacgaccgactgcatctgattccttttcgtgtcttgctcattggacacccttgggggctcatcggtggaggaggaggtgccacggtcaccaccgtggcgcatgctgagcgtcttggcaagcacgacagagtgcagcgacgtcatgtgctgaggtgcagcagcgctgttcttggagctgctggagccgacggagtacctgctgtgctcctggatggtccctgaggcgaggtgaccgacgagatagcggacggcgttgttctgcgcaaagagctcctggcacgtagcgctccggtcagcgagagtaccaatggcatcggcaacggcagcctgcacgcgcatgggtggatccttgagcgccgcggcgaagacggagcacaccccggcctggacgagcttatcgatgctctcgtcgtcgcagccgagcaagccgagcgcgcgggcggcggcctcctggccgtcgtcggtgccttccttgagcagcctaagcagcggcggcacgccgtcctcctcgatgatgagcttggcgaagtgctggctgtcgcgggcgagggaggcgaagtttgcngcngagtcngcgcgcgccgcgagccccgccgtgtggaggcgcgcgacgtggtcccagatgaggaacagtatgggctcgttctgcgcgatgttggggagccccctcaggtcgccgtcgaagacgttcccgttgtggtcgccggcggcaccaggaccaccaccaccaccaccggagcgaggcgaggagatgcgcagcagccacgcgacgtcctcgagcgcggtgtcgaggagggcgacggtgcgggggaaccccgcggcggggctgagcgtgaagagccgcctgaggcgcgggtggccgctggcgcaacgcgcggcgagggaggaggccttgaggagcgcctgctgcgccccggccatgatgcgcgcggcggggcggtcgtacaggtcggcgcgcgccgcctgtcggagcaacgccgcgagcttgtgcgcccgcgccttgagctcgccgcacttcgcgcggaagcaccgcgccgcgccgcactgcttggcgacctcgtcggccagctggatcggccgcgccagcatcgccttcaccccctcccccatcccaaaagaaaaaccaaacgattctccgcctgctccgcctccgggaaccagaattccttcgagaatcgcgtctccgcggggctgaatcggcgggcggcgagggatttgggggggaattccgaattcggggtgggggatttggggtttttggtttgcttggtggagttgcgagttggtggaaaggtgggtcgtcgagtcgagtcgagtgaagaaaaaagagggaagagggaaggtggggcccacggccggtgaccgtgtcgtcggccgcgtgtgtttgctgttcttgttttcgccgtggtttctctggagattcccggaagatagggtgggcgttatcctgcccgtccgattcgggccggttgcaaagtaccccttctttggagtatgatccttctttttttttatttctttattattatattgttttcttcggcgagggggattacgaccgttgactcgttgaccatgaatatgagctagtacttttttatttttttaatatttctggtgacagttgtttgttttttttttctttttgggtttggattgtagttatccagggggaatgtacaactgtatttggtcctgttctggaaactgataaattctagtaacaaggaataactggggtgtggccaatgagattttggaaattatgggtttccatggttatggctttttagtgtgatacaaccatatattctcataatttgagtaaaaatcttaaacatcgtttaaggagctaaagattttgaaaaaaaacagtagatagtaaaaactccttccaaacatagcctttatagtacgatatgtatcaaatatagcggtcttaaaacgagttacaccacgagataactaaaaggggacacatttatccatgctaaggaatttcatggctttggagaaaaaaattatcggttgcaagagccaggggctttctgttttggcaaaaattttctttcgcggttttggattgatgcataatatatagagcctatagttcctcatggtggggagcacaaagttgtcccctagtaggagcataagagcatcaaccggatatctccctaaaaatggccaaacatgcatgtcactatattacatttgactagctctatatggtcttatggcacaaggaatatgcccattatttttaccttattctgaataggagatgattctttttttaccatatatttgatcaatatatattataggtcccgtttgagatggatgatggttatgatgaagtaagtgcacacgaaaaaaattagcttatgattaattaagttttaattagtataaacttgaaaaatggatttacttgtcgaagtaatttttctatataggaagtttagttgtttagcaccatttagctgttttaaaaacgtgctaacgaaaattgatgtagaatctgaatctcataataaatgaacggagcctcagaattgatagaatcaacaaaatgaactggccaaatctatattttttaaatgtgaccaattcttaatagtctgatctagtttgatccgatttgtcagctgccatgtcctgttctcatctactactactgatgttatcatctcaactaaagaggagttgaacaaacaaatttttagttctgaaaagaaactattttcgatgcatcattaagcttggagaaaccactaatccaattaattaacttgcacgtttcttatatgtcaataaataacaccccgcatgcatttgatcttccatccaagatcgagaggctcacgtacacaatctgacagaggccatatcgcaatcatttataactaatgattccctagtctttatcaatgtatagttatgtcagaagagagacgtgagtcacacaaacacgccaatccaaccatgctgcatgcataccaggtgctgaactctacgcttctcacgttttaacgcgggaattactaattcttaatatattttcttaacatattaataaatatattaaatattataaaaataatatattgatttgttaaaatattgtgcaaatggtgtgaggggtgatgatgggatatgcttgcatgttgatttgtagaattaaataaattgtagataatgttgtatgcttgcatgaggttaactatgtaactattaccagctagtagttgatgatgtgataagattgtatgtcgagttttaggcttagtagattataactttatataaagtatagattatttttctgttattttcagggcaatcgatcatatcataccttggaaattaataccatcaatatatacttactgttatcataataaattatcataataaatgattaaattgccgttgcaacgcatagagtttcactcagtatatagtactagtacattgcacgtggtgactaaaaaaagaatctgccagtaccaatttgccaacacacaaagtagaagtgaagcctagcattaagccaataacaaattggttaaacacagcaaaaaatccgctttactttggagagccagctggaaaaagtgataataatctccgagggccagctggtgtggaaaaaaaggagggaaaaattcccaggccaccaattcttgtcctcagctttttgtgcatcgcacttgcaggaataatagaatttaataccacaggaataatggactagtggtcacctgagcgttaatatcgtcattctgtcactgtaattgtgttaccatggagtcgtagtaaatacatcataatgactataaatgtgtttcatagcactaacattatgtatatattcactttacacatttgtgcatttttattctaatatttgaaaaaaactaaaaataaaattatgaaattgaaagtaccttttgagacatctacacatgatattcaagcagccaaaccaagtatttaaaaatacattttgtgttcaaagtttccttaaaaaaatatacgaagtatatcccaaaatgtgttttgcaatccgatagagtagtttttggttaagcagtgtattttacctcgatttagttagtatcaaataataatatgcgcaatatttcatatcaatattccatgaattgaatatgatgtttttcttagaaggcgttattaatctcaaaaacgcatattgcttttcaaggtagtactccctccgtaatttaattcatgacgccgttgactttttaatcaacgtttgaccattcgttttattcaaattttttatgcaaatataaaaatacttatgtcatcttgatgataaatcaagtgacaataaaataaataataattatataatttttttaataagacgaaaggtcaaacgtttgtcaaaaagtcaacagcgtcatacattaaaatacggagggagtataaaataggacgtgactacacagcaagtggtagctggtttgtctaaaccagctaccactcaatctataagaggcactatccacctatacttcaaatacaattttctcttaaactacttatccgatctacgatccgattacaccgttgtattcataacaattaaatctttataacaagatctcacatgattatattttgatgaaaaataataatttacttttataatatatctaaattacttttagattttactaaattacttcttagacatataaaagtaattcaataaagcctaaaagtaatttacatatattatagaagtaacttataacaaaaagaaagtaactctaattaatacatttttttcattggacgtgactacacagctagtggtagctagtttgtactctatctagcatctcctttcaacttgaaccatgcaaaagttacttccaattaacattgaagttacttttaaaaattgttaaacttacgtgtgttgatctgtgctgattaaatttaatttctagataaagtatatttttatccctacaacgaatttacttctaatgtcgtgacaaagttacttacgttttgttttaagttacttttataatatatgtaaattacttgcagactttattgaatttacttttatatgtctaagaagtaatttagtgaaatctataagtaacttatatatatgataaaagtaacttacgtatataataaaagtaatttacaaatataaatattttttcatcgtaatataatcatgtaagatcttgttgtgaagatttaattataacaaacacaatggtgtaatcaaattgtagatcggataaataatttgagagaaaactttgtttgaagagaaaaatgacatgggagagaaaactgtagcctttctctctgtgactctctttgaagcaggaattgcgtgtgcgtgtggttggagatcggacggctctgccagcatcgcgcaatagcgctaaaacgagaggggctctcgaattagattttacgtataaaatagtggcgagaggagtcgttttcgcacagacatgcaacttaaagaagtcgctcgcgcatgagcccacaagcataggctggtttctcacgtggcccgctaggcttttgtgaggctaaaagtgtaccaaacgaagatgtggagtcttgatttttaatctctaaatacttttaactaaaaaattaaaattttctgttcaacttttcaaacttccaactcaaatcctaaacttttaactttacatataaaactctcaacacgagaatgatgaaattacctggaagttcacgagtcatggagaatactcggcatccttagcctacaaggtgcagttcttggggtcgctaaaaacaaactttgacaccttaatttggaaagcttgggcccacgcaagtataaaaccttcgcatggctaataatctaaaattgggtctggacctcggaccggctggcgatcaggggctggcaaaacaacggcgtttgtcccctttgccggtgcacagatgagacatccctacatctgctggcggattgcagatatacaaggaaaatctgggatgccattgctacttgggttgcctgtgaacccatcatgctgataaactgagcgcaattgaccacaacacatcactggtgggaatcacttgaaacacgtcaagaagcacccaagcatgggactcgattcttaatcctcataatctcttgggaagtttggaaggagcgaaaccaacgaattttccaaaacaaggagctaaccacggtggccctaatcgcgaagataaaggaagaggcgaaatcttgggctatggctggagccaaacacctagcagagattcccgaccgtgatgctgtaaatatttttttccttacctgtaaaaagaaaatttcgaacgaaaggcaaagcttgcctattctttttaaatatactatatccgattttgaaaactttcagcttaaacttgaaaactttcaaattacgacattttcaactcgaatatgaaaatattcaagtcaaatttgaaaactttcaactcaaattacaaaaattttcaactgatatttaaattttaactttcaattcatgatttaaaattttcaactcaaatatttttaattattaaaaatatgtctatcgctaattgccattagcattaagcatgctgggaggcgattaacgttacacgcgtcggagatgccgcgttggcggtgcacaccatcgatcctctcttggcgcaggtgcgcgcgcttcgaaagtgccagcgatgtacaaacccaatgggctcagtgctcaacgagaggcattttagactgggctatagcccatcgaatgaagctagccaaatcctggcccggtaatgcccggcccaacaatccgaaatatccagtgaaaggcaggcacctgctcgccggccgtttgcttaagagtgaaaattaagtctgaacatttctctttaagtgccaagagagccattcaagatcattttgtcatatattatttttttgattcgatttgctctccaattttctactctgttcggaccattccagcaaaagtgtgtcattctggtccaagatagctatggaccattttagcttgctacgtggcgttgatgtgacatgccatacaaatgcgagattttggactatttgccactctattgaatggcacattctcaaatgctat

SEQ ID NO: 34928 - DNA, 18199 bp, Oryza sativa
  unsure (1)..(18199): unsure at all n locations
aatttgattgtttgtcatcgtgattcaccaaattgtttctattttatcacttttgacggccaacatactaaaagaaacagaaaatgacctcactgcccctctcatatcttctcttcttcctctccggcgtgggaatcccaagtacagttgcagttggatggatgacacaagcctccggtatttttgacggtgaggtcgttgatgagcgaggatatgtcgaggccaccttgaccacaagcgagatactcgtgctggtgagagagcatacaacttgacagcttgacccacgctggctcctgccctcctgtcgacgtttgatgtcgcgattccggtattcgcatggtatggggatcattggtactaggatatacacgagactgaggtaaaagagatggagatagggatttttatacaggttcgggcccctgaattgtcaggtaataaccctacatcctgttggctgatgccggtcattgctcttattcatcataatcacactagtacaatatttggggtagtctatctaactgttgtcgatatggcggtctgaaggtctgactcgtagttgacaacagggtagccttcctcctcgagttcgtgcccggcgagatcaaagatagcgctttcgtctctcctgacagtatctggagacaccgtaggggactagccgtgcttatccctgaaatcgatatccggcatcttgtcttggcgtatgttggcttgtatgttgatcttgtgtcttgatatattgttttgtgtcttctatggtgggtgtgtgttgatcgtctgtatcccctctccttttagggggccttgtatttatacccataggtgtccccttgtccaagtagaactagggaaaccaatatggatacaatccgagtagtccttatcgtttccatgtagaactctggttgtcttttcttatccggaactcctcctatatccgcaggttgtttccgtataggacatggtaagtggtgggtcatgccgagatttagtcaactactattaggtatgtggtatccataaccctgacacctcccccccgggtgccccacctccatttgcgttgcttctctcaagttcacaagatttatgcgaggtagagggcctgcaaccgagatgtattgccttcgccccgacgacccaacggcgaaccatcaagcatcgtcacatccattgctcgtcctgctgccccagctcattcatggcaatagttgtccctactgcttggcttgtcccatgttggagactggttcatgccatgtcggagaggaagatggtagaaggaagatgaatgagaggggcaatgtggtcattttctcatcgttttgctgagttgttagttaaaaaatggtaaaatagaaacaacttggtaggtcacaatggcaaataatcaaagttaatgggaatgatggcatttgagaatgcaccatcgaagagagtgataaataatccaaaatccccacaaatgctgacgtggcaccagcaatatctctatattgactgacaactggggcccacttggaaaagttttctttccttttctcctttttcttttttccattttcctctcttctttccctttcttctctctctttttttccctcttctttagttggacaagcagaagtggcatgccacatcagcatccgtgtggtatgccacaccagtgtcacatagcatgctataatggtccgtagccatcttggaccagaatgacacactttagcaagttatgggacctgaattagcatttttagagttcggggatctagatgacacagtgacacaagttctagatgacacgtgatacaagctaagtgaccggtcgtacactttacttaaaaataaagaaaatcaaagcgtcttataatatgaaacgaggaagtaaatatttgtatggaaaaaatgcaagattttagtatgcatccaataaaattaattaagctagctaagctagtagctaggtatccattcaatccggcaaacatgtaatcacatcatagagaacagaagcttttatttatatctgaatagttaagctagcaggcaggcaacagaccaagcttcaacaacgctagaagggcagtaattaactagctcgagtagccggtgtgaaaaacacacaaagaaacgaagcaattaaaccagctagtactcatgtttcctcgcttcgatcgatcgatcatggcgccgcggcgaagccggcgaccatctatggctttgcctccacctccacaggcgggagcttggggaacttgaggaatggattcttcttgatcaatggcagcagcttcttgaacagctcggggtcagcctccgcgtcgtcctgcatcgccaccttcttctcctccgccggcgggtggtagatcggcggcgacggcgtcggcagcggctgcttgtacaccggcgtcgggtgagagtacgccggcgtcgggtaggagtacaccggcggcgccgggtgcgtgtacgacggcggcggcttgtggtacgccgccggcgctggcggcgacgggttcttgtagtggaagaagaagtccttcttgtggaacgggtcgcagaggaacgccgacgcgcactccgacgacgggaagtgggtgtcgccggcgacggcgacgaaggtcttcttcttgtcggcggcggcgttgacgatccacgacggctcctgcccggggcatggctggttcgacgccgcgctgtgcagctgcgcgaagcattgctgcctcagctcgccgtcgtcgccgaggaggtccgccgcgaggggcacggcgaacgcgccagacttgccgacctcgccggtggccttcgtctcgtactcgccgttgctgttcttgcacttgatcgccacgcgaacacctgaacaaaatcaagaataaaaatgcagcagcattttcaacacaaaatatatacccaatataaaagaatatattcaatgatagatttaatgaaattaatttggtgtcataaatattgcgatatatatttttaatataaatttggtttaatttaaaaaaaattgacttaggacaaccaaaaacgtcttgcatttatgagaacttagaacaagcatttttcaggtagtagtttaaataaatgacaatgattaattggaccatattgcgtgattatttatgatatcaacatacccttgaaaacggcctcagctttcatgttcttcctggtgcagtcggcgcacttggccaatccgacgaccatggacgccgccgccgcggcgtcgccgtcggcggcaacggcgagcacgttcaccagcaagacggcggcgcaaacgccgaggactagagcccttggcagagcccccattgctgaagctcacaagagatatatgatgatcagcaagaagtagtggattgggagatgagcaagaagagaggcagtgatgggtttatatagtgatcaagaagagcatatgcatgcaaagctacatgcaatattatgttcatatccatgcaagtgcaacagaagcatttggcatatgcaggagagagtaaattaaattgcaactaggtagatggtgtgttaaattaaactgcgactagctaggtagtagatagtagtgatcagctgagctaccagttcaatcaggcaccggctttgcagattgttagtaaatgtgccgttaaaagttgatgattgttctctctgttttctcagatctgcaattcttgccattgtgcatctggcactgggcaacttaattattttcctttagggcaatgcatgcagagatgcatgaacaattaactgcaagtttgcaacaacaattggctgcattgaaagaacagttattgttgagattgtgttggaagtacaaggggtgtatttgcagcatggccggagattttaatttggtcccaggtttaacttgaattgttcaagttgaataactgttacatctgtggcactgctacatctgtgccacattctgtaggtcaccatagagaaagaaaggtattcatgtcttcagttcagcagtatatgtaggtactattaaagagatgtggtggattctgggtattcatgtatatattgttttttaacctcaaatttgactgctagatccaacagtttataatgaaaatttaaccaaaatgttatcaattgatcctgcttggttttgggccctctgtcctgttgccctgttggtcctcttgctgttaatattttaaaactaacctttatttattgtgtcgctgtcaaaaagagggttattgtaacatttcagtttaattcaattatattaattcagatattccaaatgaacttctcagtggtttactgaatttctggaaagtgttttcctactttaacaatctgctatatatgttgaaggaacaactatactgttgactttaatggaatctcattgcagtttagatgtgtttaatggcaaactttaaaagttttcgatattaatgtccttttaaatatttagaatgaattaaaaaaaatactgttagtataattttatcagcatttttaaataccttgcaatagaaattgacggtgaaacttttatcttgaagaccatatatactaatatatatccaaatcaacagtttcttttcccaaggagtttagatggtaacgtgtaacaaaatttgaaacagctaaaatcttttttcaaaattttatcatgctggtatttattgggttttcttttcctgttcctgttgtgccattgccaaaatagtttaaaaaggaattaaagtcaaatataaaatttcaaataacatttcataaagaaaatgatctgcaataagaagttaatttacaagtcttttgcagcaatagtctacccaccagttgagctggccgatggaactgcctgtccatttgttgggttattttacctagatttttttctaccatggctcgtttaacggtccatcctctagaaccgaacccagcctagcccatctgacagtgtgttcagggcagggttggaaatttcggaccgaaatttcggtcacttccgatacgatattattttggctgaaattttttattttttaaatttttttcataaatttaggtaatatttgtttaaattcaactaaattttactcaaaatttcggaaattttagaccgaaatttttaaaatttccgaaatttcggaatttcggtgacccccgatataaacggctcaaccgatagagtgaaccctgttcaggggatggtgggcttgcggctcgtgtgacgccgcttggacaatgcaccgtacgtgctccgtgcggaggaggacgtacggcggccccgccgacccggttgatgatatcccacggcagttgcgttggtcatcgccggcaaagtcgccggccagggcccatcgcaaccgcaccgtaccttgtaattttattgtccgcaccgcactggacgtgtgtaactgtgcgtgtacacatggtactcctaattattttactcatgtgatgtgattcaatgaaacaatatataattatatatagtattccctccgttttaaaatagttgacaccattgactttttagcacatatttgaccgttcatcttattcaaaaatatttgtgaaatatgtaaaactatatgtgtatatgaaagtatatttaacaatgaatcaaatgatataaaaaaaataaataattacttaaattttttaaataagacgaatggtcaagcacgttataaaaagtcaatggtgtcaaatattttgaaacggagggagtactaagtaaacaatatactcctactatcattttgcccctgcaaaagagaaagcatatgctcgatcttttgtgattcaattaaaccgtacgtgagtaaaaataccagagtcctacgaggacttgagtacaacattactagtggatcatattgtaattgtagtgcatataatggaagtaatctttttatcgaccagatctcgtagtaatttagttactaacttatcaaatgagattggcaagaataatggatagtaatatttttatgaagtactaacactactacgtacaaatcaggtttttgctagcgtccaaatcaggtttttgctggttttcattggccttgccgaccgccagcaaaaattgactttcgcaggtggccaagctaagaaggccgctagcgaaaaaaactagtttcactgtacaataggtaaagagacccgccaacgaaaatattcttataggaggaaaaaaattaaaatggaaaaaaaattaaaatcaggatccacaattaatgtcccaaatccttatcccaaattcacatgcatcaacacaagcttcccaaatttgttattgccgagcagtaggaagcaggaacccaagctgaagttgtcgtcgtcgccaccatcaccgagctggccgcaaccctagccaccgagggtaaccattgccgaactacgcgtggagccatcgccaccgagggccaccgtcaccgagcttacacgtggagccgtcgtcgccgagggcagccatctccttggactaccaccgccaccagatatagctagacatctggcggtcccaagcaccgccaccgctagatctggtggtccggtctcgattaccgttgtcttcgttgtccaagatgcacatgcatgatgttgatggagctcttgaggttctgcgtggcagagtaggcagagaagacgaaccatcgccgtggtagccattgtcgtcccggccttgccaactcgagccgtcatggtcatcagggccatcctcaacctgaagcagtcgtgtcccctacgctttgccaccgcctctccccttcaccgagtagccatcgcccccaccctttgctgcaaaccggccgccaccccttccccgccacttattcttcgcgaggtgtgcaccgtaggacggcgaggagttcgcgcagtcctgggcctcctagccaccccttccccgtgctgcaacaaacatcaagagagagaagggagaggagaggataatacgatgcaactgttggttcagtagtaggttttgcaggtggtgttcattactccgccattaaaaaatcaattcttaatggcagggtgttaagagcaccactcacaaagatagaggtatttttacaagcggtgctcttattaaaatcccacctgcaaaaattatttttactggcagggctaggtttttagaccactcttccattttcaggggcaaagctttttagatccaccactggaaataaaactcaattgtcataaaaatcgctttttggtagtgtcactgctacaaaactcctcataggtatcaactcataggtaccgccatcctctcctctctctcgcaaccgctcctccccgtctgtagtcgcacatcccctcctccttgtcatctctctctctctctctctctcgcacaaccctacccctcccccttcgtccctcgctccctccctcttcttcccccacctggccgggaggctgccaacggaggagaaataggtcaaaggaggtacctctgcacccaacgctagggcgaggccgcgtcagagatgagttgcccatcggtggagtgaggaggaggggagaaggtgcctagggtgaatggtggtggtgtttatggtagggtgagggcgtgttgagcggtcgggcggagcatgccactggtgagaagtcggaggtggcgtcgatcacgaccacgaccacggggcccgaggggaagacggtcaagaagtgtgccaacgtgtccggcgagctcaggcatgccaagcgggacaagtgtgagaaggcggggcacgatggtaggtgtgacgtacagtagcgggggcggagcatagcggtcagcggcgccgcatgttctcccgatttgtgtgtaaggcatcccaaatttctcccgatcttgattggttcatgtttttgggatatattggttggtgtttctagggatggattagttgattattggttaaaatttctcgccgatatatgtctattattggttgattggttgttgttggatgcaaagatgctgctctttttatagggatggattggttaacagatccacccgcgaaatatatttttgcatgtgggtcttttaaggagccgtacgaaaaaaatgcatgccgggttttgcaggcacaactagttacgatgatccgcctgcaacctacggggggctcttgtccagaaaaatcatttttttagtagtgtgcataatatgagatgttagacctatgacagtttgaagtcactttacagctcaaagaaggatctaaacgtttctaaaaaaaggaagcatctaaacagaatattggacgataaagacgcatttgccaactttactcatatattctgttgttttaagcatatatgctgatacgcgactggttcccttccactctacctatatgccatacgtttttctcctttgtacaaatcttcagttcacaattgcttttcatacctagatttcaaataatttaagtgaaacatataaaactttttaactcctcaaactttcaactgagatcacaaacattataccaaaatctaaaacatctttatattcaaaatctttaacttcttccaattgaatctctgagtttttgctcaaatcttgaactttcaaccggttgcagagctcatcaccggagaagatataaagtaagggggtgcagagaaagaaggcaatggtcgtctcgctaggaaaaggaccccaagattgctactagcacaacttggggaagaaagaagggcctcgcacttgccgcaactacaacaaaagttttatataaagacacttttgtagaggcattttgcaaattgcctcttagatcgggagttttatagtgtagagacattttatagaggcactttaaaaatttcctagaaaacttttactctatgaacactttagaaatattttcagcacattttattagattttatcttgtagaggcattctttcggtactttaaactgtgcctgatatataaagacattttcttgagacattttaaactctgtaaagacacttcttacaataaaaatatatactaaatgactaaatataagtaactcaaggcaacaacatataagtaatgacttggggttgagttggttagtaccttgaagataagaatgatttgtgcaattgatcataagtttcgaggattggcaaaaacaagggaaaatattttattgtttttttcattggtttcatatgattgtggtacaatctaatgtctctagaaaatatctctaccatcttatagacattttgtaaaatgtctcttcgtttatagagataattcaccataagacacttattagacatttttttgaatgcctatgtaaaggtattttttgaaaagtgtctctatagtattagaaaaatgtctctacaaaatatttttcttgtaatacgccgtgtcactagggaggaggaggaagggtagctatggtgtcttgctatggtgaggaacaggaacatgtgacgtgatggcttgtgtaaaggcacgaggtggtgtcaagccatgcgaagcaagtaaggaagtgatgaactaatgtacttgacagatagagagaaaataaggtgtttgctatttctgtttgcacatggatgttcatcaaataggggctctttggcatatgggccaataagtactttctagatataagttctcaatcagctttctttatgacagatggcaattacagtttagaagatgacaaatacacaatatcagttgtagtacatgaacaatgattaaaatgattcatgattatgattgtagatattgtttcggctaatagtactttatctgttgtctgatttttgtatgtcaccgaggtgagcggcgcaccgagcggcccatgcacgcatgcactcgctcagtcactcttagatgctgccggccgtgctatgcgtacgcgatcctcacttggttgttagagtttgtatcgaatatatatacgtagtcggttacagtttaagacttagagttgtattaggtgtatgactagagtatgagtcggactctatcctaggatctctcatgaatagaggggcgtgcctgttgtaaccgcatggcgacatagcatagcgagagggagcggctgccgcgacgaccggtcgtgagtcgttgtaactatgatacgctgtaatatgctggatcggggaggagcgtccgtaatcagtgccctagagatgtaggcctcggctgaactccgttatcaaatatcgtgccttggtgtcgtcatcgtgtttagatctcctacggtgttttctttcgcgtttagctaccgatgtcgatttcggggctggttttataacaagtggtatcagagcctacgggagatccatggtagaggtacgagggaggtgctccacgccgcgacgactacacagggtgtccagggacggacatggatgcaaggtggagcacggcggcgatcaacggaatttgatcggtggaatcggacacttcaggcggcggtttgaaccgtttgatggctgcaatcaacaaggagatgaccagacgtggtgctcgggttgatggcggcggaagcgattggcaatccaatcggtgggtcggacacttcaagcgggtggctcgaactttccggtgagctactctcaacagggagacgtgtggccacacgctcggggttgattgaaactggaggcgatcggcgttctcggtcggtggaatcgaacactcttggtggggtggccggggcctttcgatgagttgcgttcgacagggagatggctagacatagcactcgggttgttcggcgactgggaagacggcatgtgatttgtcggcttcggctcgcgactggattgaggggtggtcaattggaagtcggagcagatggatccttggtgctgatgtggaggtgttgataacgaggcagtgcgtgatggattgctacagtgacgacgtacgcacgacaagcattgcattgtggcaggcactggttattgatcggcggcattcgctgtcaatggaattgacccgaagtgtttggtggcggtgtaggaagtcgtggaggcgtacatgaagcttggagatggtcagggccgcggcggtgtgagcgatcctcgcgttgtggtcaagccggcggcgtagaccaaagcggcgtcattggtagcaggctcggtttgagcggtgattacgcggtatcttttctgatggggttcgcggcgcagtagcggatgcggactcggagtccggtcacagcgcgtgcggcacaattgtagaagacgaagccaagtcgaacacgagaagaggcggcgatgcggactctgatttgaagaaatcggatgcaattggcctcatgaagtcagcaaaggagttccatgggattgctttgcaatcgaacaaatcaccaaggcaaaaggagatcggattgggacctcttggcggcggtgatttgggacgacgagcgtcgagtggtaggagcacggcttggtgtagtcgtcgtgcaggtgccggcgaagttcgtcgggccagctccggtcggaggaggcggcagcggcacgcgcaggaacatcacacaatatagaacgagcagaagttgtctggaactcgtgcaatgagtcatagccagtcatgtacaggagcaaatccaaagtgcattggttaaattaattgcatgtatatgcaaggtatcaattatgatgcaggagcttgttggcttggtaatcttacggtggctatgatgggaaggatgcatgagacgtacagataaaagaagtttttgcatggtgtgcagggctacggactaatctacaggcgacagagcggcactagtgcattagcactcggattagtgcatgtcgcgggcgtggtgggcagacgtggtggtgcaaggtgctaagatcaggagtgggccaagagaagaggctgatggtgcggatagatgttggagcgagatgaacacggagactggtaggagggactccgaacccgagtccatgatttttgccagccgagtcagtgtctgtgatggatgccgaggccgtggaaaagcaacaacacctagacattagcacttcggggagcccttcgatcaattgtggccaagctatcagtgcaaaaggtgcagctcgggtgtaggtgtgtgacaacaagcgtgcgtgaagaacgtcccgggcaacagcgggtgaaaatcgtttggcagtacagaatatatccataatctgcagggtttgcatgatggggatatatagaatctgcgtcactgaaggagaagagcaagcgctatggtggtaatttcttcgaatgattcaaagcaacggtgattttctcaaattatcaggaattcagtctacggatgcgaaaaagtgtggatgttggatttattagctcggttcataagatgataaggaagaaagggttttctccatgtctggtgagtttgatttatctatttggttatgacatcggttatctagccatggattatatcaagtcatacttaagacggtagatagaggtgaacatggtcttcgagaagtctatgatgtgacagctaggaagaattcaattcgcttggcaagatgactgtggtgatatgagagaaggtggagcattgttgcgggtggagtcagaaggaagaaattacagggatactggagtatcttgttacgatgagcctggtggaggcttgtcagggcggctcggtgtgagcggcgaaaaaggatcaactcaagtcctggtacactgaaattcgagcaagtaacgaatttggattggcgtggcatattcgccaaggtggagtttgttagagtttgtgtcgaatatgtgtacgtagtcggttagagtttaggacttggagttgtattaggtgtaggactagagtatgagtcggactctattctaggatctctcataaatagaagggcgtgcctgttgtaaccgcatggcgacatagcatagcgagagggagcggctgccggcggtgaccggtcgtgagtcgttgtcactctgatacgttgtaatatgctggatcggggaggagcgcccgtaatcagtgcttcggagatgtaagcctcggctgaactccgttatcaaatatagtgccttggtgtcgtcatcgtgtttggatctactacggtgttttcttccacatttagctaccgatgtcgatttcggtgctggttttataacattggttgcctctatacatcggatatgtatatagaggagtaacaatccttgctgtacctgcattaatagagcggcacagttctattacccgcaacacatgcagcatcgtcgtatgcatcaggaatatatagcttgttcacgcctgcaggatgggctttttatgctttagcaacatggatttctcacgcggaggcgccacaatagcttctcctgactactgagtgggtactgcgacaagtaggcgagatagatgcacgtacagaggtgacgagtcacccgaccaactgcaagcaccacatgcacaaatttagtctgaaaggaggaagtagagtcttcacaaagcaatgtcgttactctgctaaaacctggtagatttgattaattttatcaacccatgcatttttcatgcgatgtttgtattgtgcatttttttcactaaagcattttcaatgaattttttcactgattcacccaaaatagattttattataagtgataggaataatacatatataacttagatatccatggatattttttttgaaatattttcatgttatatctagatgacatagtataatgaatgttatttttatataggcatattataggatatatataagctatcaagatatcttttagaattgcaaaatctaaatcgtgcgtgctctcgtttcgtcttatagcgcgacgcgtctaccagccatccatccgtgcgagtcaacaagtaatgtgcacactattttgtctttatccagcgacggatgcatttaaggttgacattaagtactgtcacggcgtgcgccctttcacctgctacgtattgaggccaccaccaaccaacaagattagttatactagtctatctttcttatagaacttttgatgatttatatcttttaaaccacacattacttttaaaattcgtttgaaccatcctactacactcaaaatatcgaatatattcaaatatttaaaagtaatttacttaaattttagaagtaacttagttattcaatagaaataactctccatagtaatagaactaattacgtagcaggtcagttgtaataactatgtgaagtaaattcacaagtaaaatgtacgaagatttttaagtaaatacaaatattttctttatttgaagtaaccactatatttttttttcaaaaaatgtaattttgcaacatatggaaggtaactcttcaaggtattagaagtaatacattgttagagggaagaaattatgaaaaacagaagtaactcttcatgatactagaagcaactagactgctagagagaaataactcaaaaaatagaagtaacttttcatggtattagaagtaacttaagtaccacttgatgctagagggaagtaactaaaaaatagaagtaactcttcacattattagaagtagctatactactagagaaaggtaactcttcgcagtattagaagtaactatgttcttagaggagttaaaaataatgataaaatttatgtcgatttgacagttttatggtacagtttgttttgtttatatgtcttttgcattatttggcacatgtttaaaggatgtgggataattttgcatgattctaaatataactacttataattacttttagatttgaataaattacttcttagatatttatgaaagtaaattcaataaagcctgaaaataattcacacaaattataaaagtaacttaacacaaaataaaagtaagttatcatggtattaaaatttaaagtaaatcagttgtggtggtaaaaacatgtgtctatctagaaattaaattgaatcaacataaattatagaactaactaaaaacaacaataaaagtaacatattcacaatattatgagaatgtctaagaagtaatctaatccaatctaaaagtaatttatagatacacaaaagtaatttactacacatattcttcttccattaaaatataattatgtgagatcttgttataaaaattaagttgcaatgaacataatgatacaatctgattgtatatcagattagtaatttaagagaaaattttatttgaagtttaggtgttaggaagtaggtgggctctttggccaaggcaacacatgaaattggtaggttggaaaacttcaaaagcatgatctgttcatgagcggtattatttttagagagtgaaaggtgcagtggtactattttttagggccgtctctagaaatttggggccctagggtgaaatgcaaatgccctataatttaaaaagttatgtctaatataaataaaacatattttcgctcaattatatagatgtaatatgtgttgtaatgtacaatacaagtaattttattcaaacattgtaatttgatttaatggatcattcaaattataaactacaatcatgaactcatggtaatttgatgcatattatgaatttacaatctatcatatatgtactcaatcactgtctaatcttaccggtccgaggtcaagctgtcaagagtcgagtcgaggatgatgagcggacgaggagggggaaggcaggagccgaggcgaggcagctgttttgccgtcaccgttgccgctcggagcctcggaatcacaagcagcaagttgtgtcgccgcctcgccagtcactgtgcatggaattgggatggacgtctcagcagttgtcacggcgcggaatcagaatcgcagagcagccagctagcagcagggccaagttaggccatcgcacagtccaatagtgccccacccctggcaatctagcatgaccttgctgatcgatctgcctaattgggctattggcagttgcaagctatagctgggcaattggaagtgggcctcatgtttatatgggaaaaaaattggaggccctatgcaatcgcttatttggcacgtacccatcgacatgcctgctatttttagtaacaaggtcgctgattaggacaattcagcgcacaccatttgatatagtctcctcctattagaatgtatgctaataaacagaaggcatcattaactcttctctctctctctcttatctacactagaaaaaatatccgtgcgttgcaacggaaaggttattttaatcatattattattttttagataagttaatcatcttattattatacggtttagttaaggtgaaatttactatgggaattcacttggatttgtttcttttacaaaattatgagctgtaattagaagtttgattatctcaagtaattatcatgtatgtttttttaaagagatttcttatacgactctttttgtattttcaaaagcgaacgaacttaaaaaaacgactcaaacacagatctgtatttccaaaagcgagtgatttaaaaaccgactcaaacacgaatgacgtaccaaaacaccggcaaaaatatctttaatttttgtaaaagtaaagtgcatatgtggtccttaaactcgtaaggttgtgtcatctaggtctccaaagtctcaaaatacagattcaggtcccagaacttgtcaaagtgtatcatttaggtcccaaatcgatatagcccctttaggatcctacgcggcgctgatgtgtcacaccacatgaacgtgacgtgtcattttctcttttttcttcttcttttctttttctttttctttttcctttttgttttcttgtcattcttcggtttttctttcctttcttatgctccggtcgcagagaaaggagaagaaagaaaaaaaaaggagaagaaaaatagaagaacagaagaaaaaggaaaaaggaaaatttttaaatgggttccgtttgtcacgttatgtccgtgtggcatgccacatcagcgccatgtagaaaggggctgtggtgaattgggacttatatgacacactatgacaagttctagaatttggatatacattttaagagtttaaggatctagatgacacaccattattagtttaaggactacctgtgcactttactctttttataatagtagggatatacaattaaaagaatatgtttgatattttttctaaatgataacgtcacgccattgttcatatctaaaataagaagatacaaaatcagaaaagaatacgatcgatcatggcttggatttgttcttgtagtcgtatcgctgcgcaaggtagacgaacacggccacctccagagcggcgagcgcggcgagcaaccagtagaagtagtccaggtgcgcgcggttgaggtcgtcggcgaaccagctctctccgccgccgctcctcgccgccgtcgcccagtcgatcgccgccacgagcgcgccgctggcgtagcttccgacgcccatcacgccctgggacacggcgagccccacgctgtggagctcgccggccacctggtcgtagaagaactccttcagcccgatcacggcgagcacctccgcgacgccgatcagcacgtgctgcggcaccagccaccacacccccatcggcaccgtcgcgcccggccggttgaccaggccggcgtcgcgggccacgcggagccgcctcgcctcgacgagcgccgccacggccatggcgaggcagcccgtcgccatgccggcgccgatgcgctggagcattgtgatgccgccgccgccgccggtgaggcgcctcgcgagcggcaccaccatgcggtcgtacaccggcagcaccgcgatgtaggtgaagctgacgaggcactgcagccccgccgacggcaagacgaggccgccgccgccgccgctgccgacgcgccgatccattgtgctgctctgcttggtgaacagggtggacacctgcgagacgacgacggcgaacactatgctgctcagccagatcggaagaagcttcacaaggaagaattctctgccggcatcgncatggtcatgcaccaccaccaccacctactgttgtggttctagaagctgttcggcggcatcctttcggtttcgggagaagaagaagaagaacctcgccgttcacgcacgacgcgccgtggtggcgccgtcgatggcaggacgctctgcgctgcggtacgtcctcgtgccgagcaagaagacggcgatgtagagcaccatggttgccc

SEQ ID NO: 34929 - DNA, 5079 bp, Oryza sativa
gacgccgtgagcatccccaagctgagcaggtagagcgcgctgccgacgatgacggcgcggtaccggccgaggccggaggagtcgccggcgagaccgccgccgagcgtgagcaccagcaccgtcccgccccaggcgttcgccgcggtggccaccgccgccgtggacatggccatcgggccggtgaggtacagcatcaggttgccttgcacgccgaagaacccaatccgctccaagaacccgacgactgcgccatggccatgcatgcacacgtcagcaacaaattaagcctggctgagagagatgatgtcatcactaaagcctgagaagccgccacttaccgacgaggaagaaggcggcgcgccaaccgccgcggcgggcgtcgccgtcgtcggggtcggcggcggcggcgcatggctcgggacgacgtgcaaggaagccgccggactccatggctaatggcgcaacgtgcagctgtgtcaagattatattttatcgtgctagctgtgcactgtgcagcatgggctagtacatttcaaggccagaatatcagtattaggcctggttaacaaaaaaaacattacatccaatctttagatatatacatgaagcattaaatatagataaaaacaaaatctaattaattaattgtacagtttgcatgaaaattgcgagacaaatcttttgagcataattagtccatgattagctataagtgctgcactaaattaggcttaacagattcgtctcgcggttttcagacgagttatgaaattattttttttcattcgtgtattaccttctgacattcggtcaaacgtccgatgtgacactcaaatattttcttttcgcgaactaggccttagcaatgcttctttttccttttttccttttacaatatgtctagatcagaataccaatgatgcctagagccgagtgaataagacataaagaaatagttaatatatgtcactgtatttagctatcagtactgacaagtactaccaccacctaatatctggagtggctgtctttgtactgaaattagttgggcccgccaccaagggtctactccttccgtctcaaaatataagaagttttggttaaatggagtacattttactactataaatctggactgtctgtagggatggcaacggggcagggcggggccgggttgggctggaacggccccgctcccgacccccgacttcaccccctgcccccgcccccggtcccgactggagatgcggggctaaatctagccccgtccccgacccctccgtggccccgcaccctgactggggcccgcattgaataaaatctccatcccatcagcataagaaatacaagacagctatcaattcggcaagaacaaaaatggtacaaaattcacacaccatcaaaaatagcataattgtacataattgactctccgaacggtggccgcgcctgtgcgccgtgcggctcgccggccgccgtgcctgtcccctcgcggctcgccggccacagcgcttcccctcgcggctcgccgaccacagcgcctgtgcgttgcgccgaccgccgcgcggctcgtcggccaccgtgccctgcgcaccgcccgtgcgacgtgcgtcgtcggcactcggtagaccggagggagagcgggagagggtaaccggagaggggagaggaggggaggaaagaggaggggagctggggatgggagagcccgagagggcgaccgccgtgccctggcgacctgcattgtgaagcgccgccgccgtcgcctatgtgtgagacgggaggggagatggggttgggagagactagaggagagctagggttttgtttatatatgtcactattttgttgtattgggttctattgggccttttatgcgctacattttaagagtttaatatacatcccccggggccctgcgggtgaaatgtctctcccgtcccctccccgcccaaatacagggcccggccccaactccccgcaggggacccggccccgcgggggaaattgccatccctaactgtcttactgtctagatacataggactaggatctggacggaccgagtatttgataaggcttcaacttctaaatttttcttcaggatttatgtctagagtgaagttgtggagcataaactcagctccagctctctagttcattttctagagtactccagcctatttcactccctttttgacggagctgaaaccgtttggctgtgcttcattggagctgagaccgtaccctcactttattaaactaggaaatgaattttaaactcccaatgggatattgttaaatattttttttaaatgttagcaggatagacaaatatttgatatattatttcacaaacatacaagttaaatttgacttctacatattacattaaataaataacacattaaagtatagcttagtcaaatttgtcttacagttaaatttaaatttacatatcggtagtgatttatcagatattaatttaaattgttttattattatttggatgatatataaacaatgaatgatgtggtctgaaaagtttagaatcatcccgtataattgacacgtgactgacatatcccatctgttttctgatcatttcatttactgttcactgttcaataattataaccaaaccaaaccgaccatgaatagttgcatagatatagtttaaatcaaaaactcaaccaaaggaccgtaaaaactcacaccatctctccacaaggcaaatttaaaaagttgtgctcccggtgacacgatcgagagggtggtgagcagcggacgatcgattacttctctttcacgtaccagatacttcctccgttttaccatctaaattattcttatattttccatatttatattgatgttaatgaatctagacatccgtatatctgtatagattcattaacatcaatataaatgtcagaaatgctagaataacttacattataaaacggaggaagtaacatgaaaaaaaattctcacaatttattaaatataactggtaaagattgttctataataaacacgctcaatgatttgagatgagctcttcgacctgtatcacaagagatcacgaccagaataagggtgtgtttgaaaaggaggggatcgagaagattggaaagatacgtaaaacgaggtgagccttagcacataattaattaagtattagctattttaaacttcaaaaatggattaatatgattttttaaagcaactttcctacataaattttttgaaaaaaacataccgtttagtagtttaagaagcgtgcacgtgaaaaacgaaacaatctttctctctttctcctgcgctcgaatgcagcctaagagtagtaacacgtggtttcgggaatacatatactattatatcacatcactgctcactctctgtcattactgcttgatgttagaggatacgaacccgcacaaaagatacggggacacgacgaactcaaacctgacatatcctattaataattaattatgaattaatatcgcctgagggcaactcattacccactcgacaaaatcgaaaagcacaaaacgaactgtgaactaatttattaggtaagggctagaccaattatgcaagtcatatcaattccaaccaccgatcgacatgcaacacatcaaaaaataataaaccagtttatatatatatatatatatatacggctctaatgctactaattgccttgactaattaagcacctcacaaaaaaataataataaacagatgcggcttctttgctataatttccgcactaacgatctttgctaatcatacatatttttaaaatatgggtgatatgatcttaaattgtttagttaattacaaatagaataacaacggaaacaaaaaaaatcacatgttgttgccttaagtttatgggtccatggaattttttatttttatacatatatacgaggtttgtatgtatacttaccgagttttttttaacaacgtagtcactcacagcacacgcacactcacccctatgaacgcacgcacgtaaaccctacccctatgagcatctttgaatactgggccggcaaatccttaagattgacgaagttaccaagttaccacaggcgcctcgctgtcgacggataaatcctagaaaattcgctctgtacacatacatataaatcttttttacatttaaagtgtatacatacttatataaagtttatacatatgcaaagatttttataagtgtatatacaaagtttatattgtatattaatgtaaagttcaaatcaccctctacattatgcagtagtacaatttaccctttcgtagcccagtcgtcttcatcggcgtcgtcgcactctagctatgctagtacgtagtaggagcggatctacagttaaagggctctagctatgctagtacgtagtaggggtggatctacagtaaaaagaccggtgttaagtaataccgatgactttatgttagagttcgcagctcggcccaccaaccgtggaccacccagatcacattgggcttgctccaccccagattcaaccggagccacaattttaggtcctggacctacacaacccaacagactagtctcttgggtgaggattgctcccaccttttaagtcatactccccatcatcaattaccgatcactggtggagaaaccatctttggtcggtcggccgaaatccacaatagtctcggttccactaaaaaccggttcaaaagatgatctttagtcccggttcaaaaggttagagctactttttgatctttagtcccggttggtaacatcaaccgggactaaagattatttttagtcccggtttaaaagacggcaggtggtgtcagacccctctttatctttagtcacggttggtgacaccaaccgggaggtgtgtgtaaataaaataacttattaataaaataagataaaatacaataacttatgaaacaaaattagttatttaaaataacttatttaaattaaataagttattaacttattttacaccaacctaacaccaatcgacatgcaccgtgcgagatcgagaggaccaaggcgcacgggaggatcag

SEQ ID NO: 34930 - DNA, 9154 bp, Oryza sativa
  unsure (1)..(9154): unsure at all n locations
atttggggtttgatttaggtatatgcatgacactcgatttggggatttgttgtttgatctgggtatatacatcccacttgggagaaaataaaaagaaaatagaccaaccgggactgcccctatcctctctttagtcccggttggtagcattaaccgggactaaagatccctctctttatatcgatctttactcctggttatttcacccgggactaaagatagcgatctttagtcccggattcgtagtcccagttttccaccagtggatgtgggactaaacccaacacttttggtaaaacctatagtgaaactctttatccatatgttataacattatgatctaagcataattagcatattaagacatcgatagatatgttatatgacaccaacgaatcgattttctggatccgccactggcacgtagcattgcaacgagctttaccaatgaagaagaagaagatttatgatgatgactagcatgcatgcaagtagttgatttaattagctgctatgtccgtcttgtgcttttttcttcacgacgactgtctctgtccgaatccgtctcgtgcatgctccccgtgtgattgaggcatgcgacgccggagacgccatcgtggccagccgtcgcctggggattacctccttgtcggctatatatcgcgtagtcaccgctgcctcgtcttcccatcctgggttcctgtactggcagctgtggcttgcaaattactccctctgttctaaatattttacaccgttgattttttaacacatagtggatcgttcatcttattcaaaaacttttgtgaaatatgtaaaactatatgtatccatataagtatatttaacaatgaatcaaatgataggaaaagaattaataattacttaaattttttttaataagatgaatggttaaacatatttaaaaaagtcaatggcatcgaatatttagaaacggaggaagtaacggtcagatatctagcctcctctgtcccggcatagagagaggtggcagctacctcgccgccgcaacgggagcactgccttcgttattgctgaagccttggtgaggtggaatcgtcctgctcctctagcttctactcccgcccgcactcgcggccccaattatcgtccgttgaggctgaggataaacacgcatcactgacaattgggcctcaccgattttttatttgtatttactgactagattgcaacttgtacacgtaggtcgaaaaccactctcgaatgagttaggagataattcgtttagagttaagagttcagggtgtgaaatattggtattttaattagtttagggggtaaatcgtacgacataagtttagagaggcaacttgaactttcaccttctttatataatatatgtataaattttatatatacacatctacgtatagggcagaaagatgaccgtgcactcgcttgtggtgccacgcaagggagggggacgataggtgggtcccaacatgtgagtgaggcttgatcgggtttgaagggtagtatcgtactttcataactgtttcactcttaaatttattcggatataataaaataatattacgggtgtctagtaaataattactacttttttgcagtgccctagcacagaaacgtgttcttgcggtgtcccctagatagttacattttttttatatcatgtagcaaattttgcacatattagtttgagctattgacttagaagaaagatttattggttgaaatcgatggttagatttgtttcgtcaaaattcatagtagttttttctagtttattagagggactctcgcccagcatgaccctgtcgacccgtgatccagatcaatacacaggacattatacaacaagagatatttgccagtaattagacttgcatacttgaatgttaattattatcacgtactgcattgttaaaatcaacatcaattcagcgcatgcaaagcacattcccaaatgccgtaaacacgcaagaagccatgaacacgcacgcgtggctttgcatccattaatttctccgataaatgaaatgcacgccagtagttgcgagatacagtagctacatcatcaacttatttggtggaaatggagatcgagcagtgaactcgatcgatcgatcagtggctccccgggggacggtagatcggagtcggcgatggcgtgccgtacgccggcgagacagggggccagaaaggcgacggcgatccgtatcccggcgccgtgggaggtgggcatgccgtcgccggcgttccgtattccggcgtggatggtgggcactccggcgccggcgttccgtatgccggcgtggaaggaggatattccggcgccggctggccgcattccggtgccggcgtgggaggaggagggcactccggcgctggctggccgtaacccgggtcggcaggggggcattccggcgccggctggccgtatcccggcggcgtgctgggaggggagcatgagcatcccggcgccggcgtgccgtacaccggcgagggaggcggctggtactccggcatgggcttcctgtggaacatgcgatggcgcctgtggcaggggaagcagatggccaccgacgagcactccggcgaggacgacgtcgacgacgggaggtgcgtcttgccggcgacggcgacgaaggtgcccgtctcgccctccgacgacagcggctcgatcttggatggctcctggccggggcacggcgcgtcggtcgccgcgctgtgcagctgcgcgacgcagtcggcgccgcggaggtcggcggcgagcggcacggcgaacgcgcccgcgccgtcgagctcgccgacggccttgctctcgtactcctcgctgctgccgttcttgcacttgatcgccaccttaagtcctgtcaacaaaatgaacaaaaataaacacaacatttttgtgcatttaatagttgctttgattggtgatcatgcaaatgcacagttagatgacacagtttcttttaatcaaagcgaatcggttacagtgactgatccaagaattttcttgagcctaggtaaagcataatcctatggcctgctagtaagtttttggcccaagcaatatcatctgtgataacaggcccacacatgtcaataggtgtctgttacaacatctgtcgttatggtagaggatgtgcgcacttttagatctaaacataacaatgtttatataatcgactcgatggttattttgtacccaaatatcgcgtatattctacttttaatttatgagaggtgtcaattgtaatctttgtcaaataccactgtcccatcatcaagagtgtactccgtatatactccctccgtttcgaaatgtttgacgccgttgactttttatcacatgtttgactattcgtcttattcaaaaaattaagtaattattaattcttttcctatcatttgattctcatataattttacatatctcacaaaagtttttgaataagacgaacggttaaacatgtgctaaaaagtcaacggtgtacatgtgctaaaaagtcaacggtgtcaaacatttcgaaacggagcgagtagttgcttgcattcgtacttacccttgaaagcggtctcggcgtccatgttcttcctgccgcagccggcgcacttggccgcgccgacgacgaccgacgccgtcgccgtcgtctcaccggcggccgccgccgccatcagtatcatcagcgccgcgccatggaggagcagccagcttgctcccatggcgaagctacagttgtgtgtggctctcaatagtagttgcactgtttgcaggtgaagagcaagggcgtccaatgaactgcttatataggcgatcattgcatatataattgcattactggatgttaataattcagcactgattatttattttatctatttatttacagctcgatcgatatgatgatccatggagttaagatgtgccacgaaaagagttaatgtcaaacgtacgtatagcgtaggagtgctacagtaagctacattttgtttagttaatttaccagcgaattaaatctcactggcagtgatgaaatggtagatagtatagagtatagagtataaatatacgtatgcatactagtagtatgtactttggctatgtataattaaatgccggctcaattcaatatgttgtcgccgttgtcatgatctcttatatcgtgagctacgcttctatgtaataagtagaactctagttctagtttgtgttcatctcagtttcgggggaaaatccagcagtacccactatacatataaaaatctcatcgggagaaattcaaattgttaaaaaatatttcccgaaattgaagcagttcaaaagagctttaatagttccaagaaattttagttgtcactacattgttgattataagctgtaacggtttaccaacaaacaaaaataatttataaataaaacttatatatatatatatatatatatatatatatagatatacattcttagctgtttaaatacaaatgttgtaaaataaactaccgttaacccaaaaatctgtcccaaaattaaattttgaagtttaaattttggtttataagctaaaggatgaacaataggagtgcttatttttttttccttggaccagaaaaatctcaagagggcccgagatagcaagatcctgcagagaatcttgcatgaccacacataggagagtagaggatgtagttatgttggatgcatgatcgaagcacatgcaacgatgatcgacgacgtcgtggggttgactgtcatcttcaatatgttcatgtgtgtgcattcaaccaagttggtgtaaatgtacgcattgtacagtcttgatctccaataatacagatctacggctgtgtttagttcagcgcaaagtttggattttgattgaaattagagatgatgtgactgaaaagttatgtgtgtatgacaggttgatgtgatggaaaaggactgaagtttggatccaaactttagatctaaacacagcctacatttatttaaacccttctaatccataattccctttaagcttcaggtccagaagtacatgttcccaaagggaaaaagattgaatttaagtacgaccgatacctataagattgaattgaagtactatgcctatattaataactattcctagtaggtaaaacgtactagccttaattaattagacaatgtcgtctcaaatgaaaccacagttcaaattaaagaatgaccaatcttcatacagtgataataatcaaggctcaaagccaactcaacctttagaaaagaaaactccttttttgcaatttaaagaacttccaaataaacttttgtgaggcaaggaagtttatattaagaatcatatcaaaatgtttcctttgattattgctagatcataaagtttaggaaatcacaacattagtatgtcccgaccttgcacattccataaagcgtcccaacaacaaaaaaaaccccaccaattcaaccatcatccagcaaatcattgtttaaaaacattctggaattttaaatgtatgtaaactacaacgagcaaagagtttccttaaaacattccaacaataaaaacccaccagttcaaccatcatccaggaaatcattgtttaaaatattctcacattttaaatgtatgtaagctcaaacgagcaaaggatttccttcacagctatgcccggaagacatcaatttcacgtcttaataataagaaataaggatgggatcattgatcatcctgcacttccctgtggcctcctcttgcaccttacacttctcaacaatgatcctctgcaatctggagctgcctccagctagggctggcacgcctgctggagttacctgagagcagcggaacaccccacacgcctccagctgcaagcatcctcttgcaatatcttctaagccaacgtcgctaatcgcatcacagcgaagcatcatgagatgtttcaattttcggaatccttcaccaacctttgctagtgtggtgtcaccaattttctgaagaacagtgcaggaccatgaggggaaaaatcaatgctttaattgctatgcatgaaggtaggaaaacaaacatgacgaattctataaacaatttctgaaattaactaagactagaggtcattttagaacaagaaaatcaatatcttctatcttatgatgttgagagagagaggggagaccttggtatcacttatattcagatggactagatcatggcactctcttataatggtagtaagcccataatcagtaatttgattgcacccacatatatctaacctctcaaggaaacgacattgatcaaccgtagcaagcccggtatcatttaacctgtaaatgaaagccaaatgttagcagatctttgtcataatagatagaacaaaagtttttatactcaacaaaaaaaatgtttagaacagaatgatgtcagaatgctttgaagaaaatgttataaaatggaaaaattaatgacatgcaactcaactgtatacctttcactttgaactcaggaagtcaatttaacttttgattggaactatcatctaagaaaggctaacgaattaaagttatctttgattagaacatgtaaaaaagtgaatcatggattcaagtacttacctcccaagaccatggagggtcaactctctaagttctttacaattctcacctacagatagtaatgcttcatccccgatctgcagagtaaaacttcaacttaatatatacaagcaaagttacaatgaaataaaataaaaacattttctcattccgtattccggtttgggagcagccgagcagcaaactctggtgtcggcttgccacatgttggtcttgggataaacattagcctaattggcaaatatgaaagacaactgtaacctggcaaatgccagagttgacaaagcaggagaacattaccacatcgaatgagggagaagggatgtggttaagactcaggaaaagattctactcagagtcatgtgctaaatcctcatcaacaaagccgttatgagaccatgatgactcagcattccttcatcgctctttggatctctcccttcaacaggaggggggctcaggaaatacttgtgcttgtggacagaaaagttgctacttgctacaaactgccagggaatgtggagtcggcatgtgacagttttgcctcgccaaagggattctttgattcatcagcaaggatgacaaaaatcctcgtccatgagatcggtggcatagtctatgacatcaagggccctacccagcaatgacttttgatggtggctccatggacacaatggcagggtcatccccacgacaatggcagggtctattctcacaacagatggtgccaacaatccaatactgagaaattcaaaatttcaaataaagggagactgacttcagttactcccttggaaatgttgagactacaatgaaactttgttacaggaaatttatgtaaaaaaaaggacttcaggatcctccccttggaggtgtttatggcttccatatgtatagcctctaaagggacaaataggcacctttcatcaacatgcatcttttgttcaatgggcatgtctcttgagattgaacccgtattccacatgtactgtattattattttgtataataataacaacaaaaataaggatttttattcttattatatacttcctccgatccaaaatgtagctacctagtatagaatgggacattacctagtactatgaatctggacaggctctccagattcatagtactagataatgtcccatcctgtactaggtagctatattttgggacggaggaagtattgattaacaatgtaaattataatactgggacaagtcgttgatgatcactattcagataaatatagtgatcgtacaaaagctgtgatatgcagaatcactatgtgaagacacaaggtgctctgcaagatcaccctaagacaaactatcatagtgatctgtatgacttagtgataacgtatcatcattcgtatgatcaaaacaagtgactggagaaagcatgcattattcctcgctagccatgcccatttccctatactggtacaaatccatcaccttgaagtgattggagacaaagtcttgaacatcgcaccaaaagaaaaggaaaattgggcggggagatggaagtaaaattttggtggtattaaaatgtaccacaaacttttagtgttataaatctgaaggtaaattttgatggtatagatcatttttttcttaaatgtaaaatcaatcttcataaatgtagattaatacaaactagaaatgtacctgaggacaagagatgatagaaagctctctcaagttcttgcagccttgagctatgtgagatatggcctcatcgcttattttacaacaagttggcaaacagacagacttgagaaggaagcaacatcgaccaaatccgagaaatgcattattgtcaatccacaaactgtttagagtgagccctaggngaattctgcgtttaacatgtccanacacaanagaaaaaaaatcaacagtttattgtgaagtctagctttgcagtaggacaaaggcaaaagtaattgcttagagtagtagcatgtatcgcccaaaacctatataatttagaatgacaaaagcagctgagaaccaagttcttcaaaatttgcccataagaaaataacagaggcatagtattatgatattataaattactaatatattcaaaaagagtgaaggctctagtttagagaatacgtgtcatgtgcatgctatgggaattaggcctgatgtgctaatctcgtcacaccaaaccaggtaaaaaaaaatcgtttttagactactccgttgctatctaagttaaacaaggtaaaattacactacttcataaaattgtttttactaaaaaactgtctgttccttaaccacgagactaataagtttaggtttcgacagcacttcaatcattataccagtatattgcacacactgacatttgttagacatgttgataatttgggaaagagtgaatttcacaaaaccacacaccttttgacacttggcacttaactacatatattttgatattgaagtctcacaaaactatactattaacaaatgggcctacctgtgagatgacatggatgtttatctatacata

SEQ ID NO: 34931 - DNA, 8039 bp, Oryza sativa
ccattttgagcaaacatttgatatgcaacttagattacagctgttgtacaaacatcaaaataacaagtggattgaataggaaatgttgaaactttcaggcttattaattatttgttaccgcatattagcacaccttcagttttcctaatctccaatttaatttatcacaaaacaacgtgcatattttgtcaaaaggaatacatttagtccaaacctcaacggactagcaaataataaaagaaatcctgtttatatatgtataaattgaaaagtacaaggtaggaagtatgttaacaaaaacaaactttgtaccatgtcaaaataaaaattgcgcgagttgcaatatgttaagtaatcaagaagaaacatacatgcatcgctgtccaatatgctccaatgcagcactttccataatatggcacatgttaatttccatgtgttgtagcattttacagttctgggaaacacgttcaatacttctatctgtgaatttgaccgacgatttgataattagacttttcagctgcttgcatccatttgctatggaaaaaaggctcctgcagtagcaaatgattagcagttgaataaagccctaggacatcgctccaaagataaggggcattactgaaaagaacaacagaagtcaaagaatggtcaatgcttgcaataagagaaaaagggaactgaagtgaaaataagtagccatatattcctagaaaatatactacaacaaggtaagaagtgcaagcagtaggcaactagtcattgataaatatttcacatgtataactttcatcatttacagatcagtagatgccaaccattcaaatttgctataaggttttaaacctcagtaaccagtactccttgtttgattaccttgtagcaaagcatacttgaatcaggcttgtacttagccttataagcagtataattacattttgggtttctatattggcaaatctaaaatttggtttatggttttttgatatttcatagagaattacagttgaaaaacataataattttaagcaactatttcacaatttgcttaacctttaagaaatagtatctaaatctagagaaacttgtcacaaataaaaggaacacgcatataaggaaataaacacaacttagaaagaaacaaattattctagtcccgtctatggttcttcccaactaacattgcactgtggcgggattaacggtgtcaagtaacacagtactactacagcacagtcatgcattagaagatgcatacataaaatgtcttgaccaatatatccactttgaatggaccgtttcaggagattactcttaatatgctgatttttagagagaactaacttgcaaatatacataccaattaaaaaatttaacaacatattgtgtgccatgttcatgtaggtataaatcttaaagtaagtggacatgagaaaactatagaaaagaaacttcgcatatagcagatttcttgatgttttgatggggattgcttgactttccatatataggaaaggataaactataaatgatacagtagttcaccaaagtagttgttgttctaacggtgtcttacaagtaagacccatgtgctgatagtttgttcagcacaattataggagtaattccactatttcacaatatatgtttttttctcgaaaacgcaagagaattgagtttcatttcattaaggggaagaaaataaaagaaaaatacaaagtagaagagaccaatgccctcctaccgcaaaaaacacacccacaccccggtcaaccccggctatctagctgcctaggtttgccgaaccactaaaaaacttttggcggggcagatgctcccactagacaccaaagattaccctcattccctaccacctgcaagactgtcgcaggtggaaaaattttcaatagctacatcttgatctcctcaatggagaaataccttcttaagcaatgcacaaatattgtaggtggcttctacctgcaagattaccctcattccctaccacctgccttccaccgtccttaatcaaagtttttgaaagttaggtggccgtattatgaatttattagggagcagccatggtttcttactctcttaccaactttttcttagattttgtgcttctagctggcttgtgcgaactgtgggcattacaaatattttgaaacagaaggaacaattggattggtacttatactagtaaccacctttatgctggttggacattgaaagtgttccaaaaactctccaaaaaagtggatattggagcatttgctgaacacatgtacgcccgcaaaattatggggacaaatgctgtcaaaccaggaaaagttacttatgaagtttactctttttttttgtcataaataatatccacgatgatcatgaaaatttgaaaccaaacagggcaaatatgccccacaagtgatttttcccatattttcagtatattattcacaacccaactacaataatatatacaattactcctaaaagtgagaaatctacaggtgcattattgaacttctttttttacaaaaaagaagtgcatatttctctgaaagtttgggaaggtcctaaaaaaaggcataaattgcaccctcaatttatcaatttcatatttacgctgatttcatttttatgtaaaacatttattgatgttaaccttgtaccattatcttggcctaagaattctaatcgcacaaaaaattaactttcctgtagtctgctttaaatatcctatggtgccaaagttctcaaggtgcagtacttagagaaaacataattctttatttactacttaacatgcaaacttatactcaggtggttcactactgaaattaagaaaagagcatgtgttcaaatcaatataaaaaaattataaaacaattgttaacaaatggttcagcatttctactcttcaattctataagcatcacaatgcagtatcagtataagctatatcaaatttctaagagaaatgagacaccgatacttccatccctgtaaaaatgcaacagtagatttaataattggacctattacctgtctgagcacttattaaggttgtcaagtgacaaattttctaaagcagagcaagatgaaccaatagcttctaaagcttcatcgccgacaccaagccataccatctttaaggatttcaaatattggcatccttttgcaacagagatcattcctttgttttcattaacatgcttggactccacggataggacttccaagttatggcagtaggtaccaattgcatacagggatctgtatgttatgcaaccattgcagaaagaaatatcaagagagaccaatgatttactacgtatctttacaaattcaaccagtccttcgtccgtcaactcttgaacaccacacagctttaattcactaagattgcatccctctgccagagtaatcaacccatggttttgaacatagccaccctgtaagaaatgttgtcaataaaaaatgaaactcaggggaatacaacactaaatatcagcatgaaatgaaacctcaatgcgaagtttacaacgtgaactgctgacttggacaatgataaacctcaaaaaggagaccattaccacaacggaactcactattgctacaatatgatcctcaagtttcattcgacaaaatagttaaaataaaagaggcatctatgatcaccattcaccataaggaagcattaacttcttcatagttccaaagatttgcccgcattggaaatgaaagcagatcatgctacgtgtgaaacaatattgaatgcacgaaagaaaacagaacaagtacaactaacaagaaattaccgaaagcgctaacgattgcagattccggcaacgatttgcaattcccaccagccccttttcagaaatgtgcaaaaaccagtttagagtcagcttttcaagccctttgcaaccctcaatgagatgaagtagcccagcatcagtaaatgaggttgggttgacaccatcactgccattttctttttgcgtatcttcgcttagtgtggaacactgcatatgttgctcatctaacttggggttttcgttatcccaaccctgtgcctgtgacaaaaatagtgcattagtgacttgcaaaattgatagacaaaccacatcaagaaaatagtttccagagatctaaattatatgcagctctggcaaaatgctaatttctcagggagaccaagaaaacaaaatcttaaccacggatttagttgttgaaccaataaaacatcggatcattcattcaattccacaggggaacacaagagatgcgagaatttcgcgcgattcccgaactgcagccagagaaggactcaccctgctccgctccgcggcggcggcggaggcgccggcggcaatgtagaggccgtggtcgaggaagacatcggcgaggcccgggaaccggtcggcgacgcagcggacgacggcgtcgccgtcgggcccgtcgacggggaccctggcggcgcggcgggacgcgcgctcgacgccgcgccagcggcggcacacgagcgcgcagctgtcaaggtcggccttgccccccgcggcggcgacgcggcggaacacctccgcgagcaggtcgtccgggagggcggcgttgacgaggccggaagcggaggccatcgcccgaggcggcggcggcggctatcaccggaggtagggttccatggaatccctaagattggaatgaaatggaattgaagcggaaggaagaggggggttttagagcccaagcctttgcaactgccgttacaactttgggttaattagacacatgccattacctaatttgaggtttagaaaaatatcattactatttgacaaattgtaaagatgccattacaaatcccacgatactggaaacatgccacgttctacgcctgatccgcgattgtactcgtttttatgcgtaccgtatttacgtatggaccataatgcccttgtgtatgagtatgtagggaccgagtggaatcagtttgaccaagtgcattcacagtgaaccgtaaacctaacactaggcttctccggcggcggcgggatttggaggcggcgtcggcggcgtcagcgatggcatcgggctttggcggcagtgtcggcggcagcggcgggctttggcggcaatggcggggagaggcagcccgattcgttcgacgggctcgagcggttgtagctttcagcgcacacgggccgcagcgtcgtcggcaccatggttgagatgtgcttgcggcaaagccgctgcagtgaacaaatccaacacctcgaggaatctagggcggcggtggattcagtgtgggaaagaggtaaaccccattgtttttcattttcttttgttgaaattcctttcttttttgtttcgttttcttgattgatgccattgatttgagatgtgttgtgcagccaaagtgttgctcgttgtgaatatgggaggatctgttgaacgaatatgtggaggaaatggttgcttattcccatgctggtgaggacgatggtcaaagagacatgttgcgacagcttgcagaagagcataaggaagagaggtcgaggatgcagggtttggttgaggcaaaccataggcagatgcaatccatatatcagcagctgaatgattctaagaaaaagtgtgagcagctaaagaagatgttgaaagaagagaagtgtagtcgtagtagacaactttatgtgatgttgttcttgttggccataattatgtatttctatgtatgttctgtaaattttgtggccatatttggtacaagtaggtaaatcagtgccattttgtgtaatgttaatcactgtctataaattatgtggattcaatttctgagtaatgacataggtgtgttaattatatggatttaatttcccactctgggtgctctgttaaggataagtctggcagctcaaggtacaagctgatattgtgtgtttgcagcaagagctaactgctgactcctgcactaaaactatgctaatatatgttcacttggtgtaaaaaaaaaaggaaggtataggacattgaaatatcttttggtgtgaagtatataaagaactgaaagttctgtgtttttatttcctctttgaaaagactgcccatcattgagacaaatgaaaaagaagtacaggaaaatgagttcacaggaaatttgtgcattcagatggtattagttgagatgatcagcaacaaatatttcacatggtataagttgagatgatcagcaacaaatatttcacatggcatgtgttcaaatgatcagcaatatttcacaatatggactgcatgttcacaggtttggactaatttcagcatactgcatgttcacatgttgcacacagtgcatatcacagtgccaggcaacataggcctcaaaatacaggttcaagacagtggcaggtaacatgaaggcctcacaatacaatatagagtgcatatcactacagcaagtcaggaaggcctcaaaatacaatatatagtgcatatcacagtggcatgttagcaaggcctcaaaacacacaaacttcaggattgtaaatattgtgacaggcttctaacaactttagctgggccttctgaggcagctcgagcatccttcttcttctggggtgtcttctttttcttgggcgtcttctttttcttgggtgtcttcttcttcttagcaggccttgatgaactttcatcttgagttttcttcctgcaaacagtgatatggatatgttagttagcaaatgcaacatatgtaaaagaattcaaaataaatagtcaaccatgcagcatattacctcttcttggggaaagcagtaggcacttcatcagtgtcttctggtgcttcagcctctttgcaagtcttggcaaagtgcccaaaaccatggcatctcttgcatcgcacccttcttgcccctggttcaagtgcacccctgatcctagtgactctaggcctccctgcacccctcttgagtctaggtggacagactttgaagcctaaattcaccacaggccattgtgatttgtctggcatagttggcactctccctgcataagctgctctgaacatgccaacagaaaagtactctaaaacaaatctttaatctcaactcctctgttggaacatatccatgccaaggcatgattgcaaggttttcctgaaacctgcctctttctgcatgaacatgtttggttgatcaaatgcacagtgtgccttctggtattgttgtcactctcaaccaatgtgatctcagccatgtcatcatcactcctagcaacctttacaactttcaggttggttgttgctgcattgagctgtttaatcacactgggcaggattccatcagtcaacttctcaccaacttgtctcctcaaatacatcttctccatgaataactctctaggagaatcaactagctcatggagatgtagacccttcagagatttaatctgattattgaaactttcagatgcattgttggtcaagtaatcacacttgcaagtttccttgaaaccagacctataccatatccttgaatgatgtttgtctaggtaatcaatggcttcaggaaataaattataaatctgctgcatatgatctctaaaaccatcctctgtgaagcatcttgcagcaggatacaagtgcagtgtgaaaataggacccctaaacttcttcataaaattaccataaaggtgtctcatgcactccctatgttcagctttctcaaatacagcacctacagctttctctagccctttgcatgcatctgttgatatgactaacccttcaggagcacctatagctccatgcaactgtttcataaaccacaaccagttgtcatctgtctctgagtcaaaaattgcaaatgcaacataaaacaaccaattgtgtccatcaacagatgtggctgaggctagctgaccagtgtatttaccagttagtctagttgaatctacacctatatatggcctacaaccattaacaaatccatctacacatgctttgaaagcaataaacatccttttgaaacacatat

SEQ ID NO: 34932 - DNA, 10802 bp, Oryza sativa
ctgtaggtggaatggtgtgaataggttgaatataaattccctcatcatcaacacccacatacttctccatgtcaaacacattaggcaatgtttcatccgcttcttgagttgcaggttcacctgaaactgccactttagatgcagatgctccctgccctgtctgagtaagtcgaagaacacacaatggcattgatgttggctccatgttattagcactagcatcgcagagtacactctcaacaactaagaccattaattcagcatgcatttctgacttggtacatttcaaacatgtcaaccagttgagattcatggacaattctaacgtcctcattactgcccttgtcaaaaaccacactgttgcagtctgctgctcaccccatctaacctctgagcttaagcttagcatcaacaaatccaaagagaagctaccatactcaacatcccatttcagcacacaacccttagtatacctccgtctaccatccgaatctatggtggtaaaaccatgaacctttaactctatcgagaacaatagtgtactgacattggaatgaaatcaagtcaaccacacatggaatgcacagaaaaaaaacctacacattcagctcacggcacatcgaatcgaaggaatcgactaccttaccttgatttgggctccatcccttgcagtacgtttccaacccctccatggaaagaaagagtcgtcgccgctgacgccgtaaacgccgtcgccgccggcggcgaatacgccgccgctgccgacgtagacgccgtcgccaccgccgtcgaagacgccaccgcagccgtcgtagcccgcgccgtcgtcaccaccgtccgccgcgtaaacgttgtcgtcggcgcgggccgcgtagatgacgttgccgccgtcgtcgctgctcctgctaggggtaggtctaagagaacgagaaaggggataaaatgtgtgctgctcctgctaacccgactccagtcagtatagccggtcaaacgggggcattttggtcattaagaacaaattttagtcacacgtggtcaacaatcgcggatcaggcgtagaacgtggcatgtttccagtatcgtgcgatttgtaatggcatctttacaatttgtcaaatagtaatggcatttttccaaaccttcaaattagtaatggcatgtgtctaattaaccctacaacttttggggattttggactatttgccatcctcttgagtggcatattcttcccaaataactttaatggtttgccatccagatccactgatttgtttttatgttaccacttttcaccatcaacttagcaaattgagtagaaaataaccttattgtccctcccatctctcattttccttcttccttcttgctctcaggcatcaatgatgtggcagagtagtcttgcgcgtcttctacggtggtggcattgctcattctgctgctcccctacaagaggctcaacagcacacacattacacaatttgagcctgacgccacacgccttgtggcgatgatcactctcgccggtggagtggcaccagcgcgcatggacagacagccagagaaaattttgaaacacagcggccattttttgctgaccggatgctcatccccgtccaccacaagtcgagccaaagaagcagagccgactatgaagcgacttgacaagctagatggttggtggtgcattaattgaacatgacgttaattgaagcccgtgagcatgatcaccccaaggtagcacatgaacaggacgtcgacgaggcttgtttcttacgctgacgtcggcgtcattttccttttgatggctgtggcggctccattctcagaggtaatgagcgacgaggtcgaatgcctttgaatgagggaattggcaatgcatagaatgccacgagaaagctagtcagctgaacatgcgtgcgttgtgtatggaaggaagaagaaacaagaaggaaaatgatagatatgaggggcagtcaagtcattttctactcaatttgctgagttggtagtaaaaagtggtaaaatagagacaaatcagtggactcggatggtaaaacatcaaagttatttgggaagatggcatttgggaatacgtcattcaagaggatggcaaatagtccaaaatccccaacttttgctgctaaaagtgaaaataaataaatataaatttctgtttttacttatagctgtccaaatggaggattgagatactctgacgtaaaatcaaaggaaccgtgtggtggctgacgtgtggcccaccgctctcggacccacccgtcagtgacgacccaacacggcacgggcctgcaaatggcatgatgcatgcctgtgcctgtgctgtgtcgatgcgtgtgctaaactgctgaggaacaagttcacttttggtcccttaccttgtcgtcgagtcagaaattcgtctctaaaccacaaaacagattcagtgtatcccccaatatacataaaaccaatgcaaacgagattcctcgacagtattattcctagttttcacgttagctaacatgacacctacgtagcttctttaactaggtttttgtcttacatggcattgatgttgacgtttacgagttacgtgtcagtgtgattcaaaataaaaataaaaagagcaaaactgaaaactaaaatattaaaacaaaatatgtgggacccacatgttagtcaaacaagaaaataaaaaatagtgggacctacatgtgggtcccactttctccacctcaccctcgctacctattatagatggctaaatgggccgcccgccacggccgggcctgggccgaagtcagtcaggccgacacggcccgacttatacgccggggcatgccatgccagcccatgggctgcacacacaacccaggcccagtaagactcgggtcgtgttgagctagcccgaaggcacgacagcctatcgtgtttcttcatagaataagtctatttgttcttcctaaacctctgtgggctgtgtccatatggctggaaaataagtctattttgtattcctcttgtcttcggccttgccttatatggttaattaagtctattttacgttcttctactattttttttcgatcgtgccgtgagggctggatcggcccaccatgccgagggagcgacccaagcacagggtggctgtcacccaatcggactgtgccgtgtttggcccaggccaaattggtatgccttggaccgggtcgcgggccctaggccatatgaccatctatactacctatatctctcctctctccgcaaacgagcgcgtagagagggacgagttggggagttcagcgaactgggcgggaaggcaggctggcgagtgccaaagaaggcctcccacggtctcggctaccaaccacaaatccgcaccaaccatgcctctcctcgcccgcctccgactcatgcttctccatcaccgcggccgcctgttgctccacctcctccagggcccgccgccaccgcccgtgtgatccacgtccgcgtccacgcagcagcagcagcagcaagaggtcaacatctccgtccaactattttttaattaactacatgtataagtaaattttgagagaaaattctgtggcaataggaacaattttccatttcttataaatatataaattacattaccgaattacatatatatgcaaataaatagagacacgacacacatatatagagcgctctggaacacgtattatttctcctgaaaaccaacacgcttgtgcactgaagtctccaacacataaatcgatcgttctcacacactcacactcctcacatcacaacttttattaattctgcacgaacaagctgacctggaaattaattaatcacgcaagaaccgaacgataaaattaaccatgcatgcaatcaaacagaccatgtgtgggttgatggaatggatgaatttttcagtggtagacaggcggagagctgggagacggcgcagctccgccactgttcccctcggcgccgccatcaccgtttcctgcaccgccaccaccaccgttcgccggcaatggcgtcggcttggggtccggcttgggttcaggtccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgaagagtagcgctcgtgctacatctgccattgctgaatcaatcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttgcttgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtctgttttataaaaatggagaatagttctataatttaggacagctccaaccaaattgcatgattgatactatttttaagtaaatgcgtaaatttcacaaaactacatatactttattcaaactattgcaaaactattgatttaaggtgttatatcataaaactacaaatttaatgttaagtttatcataaaactacaggtttagtgccaatttaatcacaaaaatgcaacttttatagctcaaacataatggtagtgctaaaaatttgacctccaaattttgtagtttcgtgataactccaatattaaatatatagttatgtcatacttgaccttaattctttaggtttctgataaatttgatgctaaattaatctgtagttttgtgatagttcgatcaacatatctgcgctattaacatatgtttggaacgcagtcatgagtgtataagtgtggtgtctgtatttagtggtgactacatgcatgttgtccgtaaaatggtagagaatatacttgttgatagtatatatccgataacagtgtttgttttaaagtatagaagacgttggtatcaaagtatacgcgagattttggtaaagtagacgagagacaaggatttttatattgattcaggccccggtgtgggtactagccataatccaatttatatgaacatctctaggatgtatcaaactgattacaataggagagcgagctagctaatatagcttaccaactagcattcaccgagaataaatccgacgacttagaatcattggctagctattgacttcctcttgattgatattcgatgtgacttgtggctatggcttatgattcgatgctcttctctcctaggggctatatatttatgcggacaatcaatttcttgttaagttgaattcgaggagttaatatgggatacgagcaggtaagagtcttgtcggatcctgtagtcaatggcacacgagcataacccaagagtcttagcgatgagattgccaaatctttcaaaaacgctttcggcatagatacttagggttaaaaagcatatatatcaaaaactctattctgaccactatgataatgttccatatcatcaagggtttagattgcctcaatgtgtaagttcattggagaagatggccagtctactatagaggatattgaccaatttattattcaatgcgaagaagctagtgctagtattttgaaacttagccttttcgcattgtctttatttggtgatgcatttacttggtttatttcacttgcaccactctattcatgattggtctaagttagaataaaaatttcgtgattacttctttagtggtgagaccgaattaaatttgtcatacttaacattggttaaacaaaagtataatgagcctgcttttgaatacattagaagatttagatatacaagaaacagatgttatagtttaacactttctgataaggacttagtagatttggcttattctggtttacttgaatatctatactaaaagtccatgaaacttcctacaaatactcctaagacgccacgtgtcactcatacaaacactcctagacaactacatggcattatctaatctcacagtcgattttcagttaaattggtggacctggtattttggaccattagattagatctactatttaataaaaataccttcctatgctgtgggccaaaaaaaaaaagaacgtacatagatacatataactttgtataactgtggtatacacttaataaacaatgaagtatcacatggaaaaaagaaactcgtgtacgaacttaattacgataaaagcggtaaaatagaaaaaaatacgtacatggtgccattgaaagaaaacgatggtattaaaaataggattttatattatactatttaaaatatcactctatatttttgcgcaaacatacacaattaaaatatattttctacaaaataaatacaaaatattctttcaacactctttaaacgttctatctttaaaatttaaaaattatataccaaaagttcatcgagctacaattgctaacaaggtatttgtgcatcatatcgaatatctaagatatgatgaacatgtgtaccattagacgcataatacagataaaggacattttataagggacatttgctcatttaacccctttgtaaagcttaactatcaatttgatccttttttaaaaaaagtttgctcatttgtccatgtttttcaaaatcgaagttgtcgtctgaccctactttcactacatcgtgagtttttcatttagaaaaaaaagaaaaacatgtatttacaagcccaaatgactaaaatgacactgaatacatcaaccttatcctcaaccactcatttgctcattctttatcccgctctctctcctctctctgtccaaagcgcgatgggcaggaggagcggtggcggccacatggcaacagctgtggagggccctcggctgcttcgcggagggtaggagcgatggcaaagaggcaacattgagtcgccgacaaggaggaccgctgttggtggtggaagaggcggtgacaactcggcagaggggaagcagcagctccatgaagggtaggagggtggcgtcggctcagcgacgaggaggattgccggcggtggcgaatggaggcggcggctgcggaggggtggcggcaaccacggatatggtaggaggagaggaggaagagggatggcgtcagctcgatgactacgaggataggcggtgatggtggacgggcggcagctcagtgacaaagaggaccactggcgcccacgcacatcttagccattagcttgctacttgcattttcttccgcacaaaattgggcctaacttttggaaaataaggtcaaataagtatgggtggaagtggtatttggggcttttgttaacaccgattaatgctcttaagagaagagggtcagagtgtagcttcggttttgaaaagaagggtcaaatgagcaaagtgaccaaaacagggtcaaatcggtagttagacattcaaatagggtcaaatgtgcaattgctccattttataatatagattatatcattttgtttcattttataaacatacatagccaaagacacgtgtgatttactttaatctatctaaaaaaatgtctacggtaataagaatcatagaaatttaaaagacagaaaaactcaagagcatatatcctaataataccctaaaagtaaataaaaattatcaatggctaatccctatgatatataaaattataaagtattatttcatcggtttattaaacgccctaaagaaccctcctagagcatctattaaagcctttaacaaataagaggaaactttaaatttcttctgtaacagataaagcatctaaaacttaatcctcgttaatttaatgctcccattaattttagccattgggttatttcaatgggtatgtgtatacatacattatttaataaaaaaacattcatccaaacatgttgtctaacataaaattatttgagatgtcaggtgaggttgtattgcatggtttagagggttgttgtcaggatgactagcgttgagttttactaggttgccagccatccaatgcatcacaaaaagagcccataggaggtattgtgttttgttgatcgagcgaccatcaagagaaggcaacaagggaaccccagtacaaatattttttatgagtaaatcttctcttaactcaagtatctatgtaatattatttaagtcgcattagcttgaagcatgcataatttgataacatgatatatctagaaggctacatgttagaacattcaattaacccatcttagaaataataatacttagcaagaactcaagcaggtaacaaatttctatctttaattttgttattaaattttaatcgttggaaagggggagatagagtgaatggttcaaacagttaagtgaatattgtccaatttgcaagctaaatgtttttttttttaaaaaaagagatatagcgggttactgattttgaagtattatcatactattcaagagcagagcaagtagtattcgtatccaaaatacatacaaagagccaccatacataattttaatattcggaaagatagaaatgcccgcgcaacgtgcgggctaccttcctagtttaaaagaaaagctagatggtcatactttcttagatgtaagccaattacttcaaaaggctttggctcaagaaagccgagttagagaggccaaaatctcacagaaagttaaagtttgattatccccatgttaatatagttgatcaacaagaatctttgaatgatgagacagttgatatatacacagacgaatgggcttggaactccaactctaaaccattcgtttgctcagctcttaagctggttagtcataagaatcgacaagaggaaataaagctcacgtttgatgtggccaaatgcaataggatttttgactacttattactacctttgtcccagagtataagaacataggactagatggatatttcttagtacaatgtatcttgatacgaagtttgtccaaatacgttgtactaggaaacatcccatctagtcttaggtttttatattttgggatagagggagttgaaaagaagaaaattaaattgtaacaagaccacgtcataccttcacttcaagagtaaagtggtgagcatattataagtggcacaactcctattcttatgccacaaatgattgcaatatattccatcgacaaattcaatcggcaaatgacgaatgccgattgacttttacaaagatgcaggtggatgagctaccttttcctatacacaccgttgaattgcaagagaaggagattcccgatggcaaggagaagaccacattgaagacttcaatacttagggggcaagatgacaatatggagataccaaaatatggcaagcgaccaaggataacaagttcatctaccaagcgagtacggaccaccaacaacttacttctccttcttcatggtattacgcttggtatgcatcatggagtttgaatggtacgtggatgatgcctatttatataccatattattatccattgtgggcattgctggttgccaca

SEQ ID NO: 34933 - DNA, 9191 bp, Oryza sativa
cctctcccatattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaaaactgatcgccctgagcgattaagggcgatcgctcgcccagtagcattcctggccaaggacgattgaaacaacaagcaaccaatcgtcaaaatcaatttatttatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaaggaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagcaagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcagggttgtggggttatggttgatgatgatcgatgatggacaaggaagggattggggtcctatttatagggccagaagaagtggatgagctcgggcgccatcaacgccattgatgagcttggaaattgagcacggcaggggtggcagggagctgtgagagggagggcaagatcaatttgagtggcgggaggccacgttcgaattcttactgacgaaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttggattcaaattcaaattggaatagatataattca

SEQ ID NO: 34934 - DNA, 1137 bp, Oryza sativa
cctgactggtaacattaatgcgcttttattattatgacatggctaacgttattttgtcgagcagctgcaggattggtcgattacgtagagactcttctaaggaatcctgaaactgaatataatgtaatggttttccttccttatccatttttgtttctgcattatacctacataatttgttataaatcttgctatttactgagtcttgtcagatattttggttttcataatttcccagttggcatgccatctgctgcttttatgtcaagaaatcattctatttggatgcttgtatcaaatattcagtgtcactaaaaataataaaagaactgtgtatttactgctcatgaagtcagctttacccactgttactagtcattctttaaggacacctatttttgccccttatggcaggttgttgttcttcaagtgaatggaatcaaacagcctaccgattcaattcatgttctttccatcgggaaactgcggatgagactcgcaaaagggaagacagtaattgcaaaagaattctactcctcaacgatgcaggtattctaggcaacacttttagcactcataagatggtgtagaaacttgcttccatctcactgatgatagctttcattccacatcattggactatgatatagtctaaaatttgcgttgcattgttgttcatttcagctatgtggtatgagaggcggtggagatgctgcaccccaagcgatgtactggcaaccgaggagagacctgagcctggtgctgggcttcgagacggccagagaacgcaactctgcaatcatgctcgctcgcagatttgccatcgattgcaatgtaagcaacctgtcttggaggaagaaaaaaacaacaagaagttgtcgcactctgttgctccagctcgaggaattttgtttcttccccaacgttttttttggactgtgttgtgcgcaatgatcacggagtaattaactttgcttgtccgaatgcagatcatacttgctggtcctggggataaaactcactggtgattgatgaagacgaactgtaccagctaaccttttgtacgagctcaagaccctgtgtttggaatcattgtacatctgtgtcggtgtaggtagatactctaatacatatctg

SEQ ID NO: 34935 - DNA, 7095 bp, Oryza sativa
  unsure (1)..(7095): unsure at all n locations
tactctagtgtatgtaactttgttcatgaaactgtttaccaaacataatggactatccccctttctgcttatcttggctctctgtttggagagcttatggtagatggtgcttctcataaaatctcgacctctcttgaataactcagtttttttaattctcaatagctgtttttcgaaatgtaaagctctcctaagagcaagtttaccgcggaacgtgcgtgaagcgtcatcactgttgtggtgccgtgcagcgcagggctcaatactgggtgagttggcccttggccggtcctcggcaagatgccaagatgacctttgggcaagactgccacttgttgtgactgtaccttggaagcaactggctttgttcggtcaattcccatgaggcagggattcgagggaaattattccacacctattgtggtgttgaattattctccctcaatccccttcaatctccctcaaaccgaacaaggtcttaggccctgtttgttttagcttaagattattgtaatctagattattgaactagattactataagctagattataataagctaacataaaataagctgctagcttgttggttctctagattattatctgtttgttaactgttagccacccattaatctaaaaaaagcacctttagagtggcttaccagattatagtaatttgacttatagattataataatatattataataagctatctgtttatttcagcttacttctaataatttagattataataatactaagctgaatcaaacatggccttaagctggaaaataatcctgggagagcaggtaaaattaatccatacttgaaaaaaactggtctcataggattattttctcttttaaggcctcgtttgaaataaacgaagaaaacacatgaatagaaaaaaaatgcaggaatatgatatagtgtaaagttgataactaagaaattcaaaacacatgatagaagaagtttaggctgtttacatgaaaaaagagagagagagagagagagagagagagagagagagagagagagagagagagaccgatggaaggatgaagcaaagggaatcttcctttggatcaaagtagatgttttatatttcctaacaaaatggaggaaatgttttccgaaggaattcaacaaccccattcctttgttccaaacaagctcatagggaaaaaaagatccaaaggattgcaaacctccaaaaatcctttaaaaaccaatgttccaaacagggcctatgcttgtatagctcgcttattactcactgatcagcagggagcatcttccttcagattgctcgtcttccatgactcctctagtcctcttgaacgcagaaattttacaggaattttgcataaattagttctgcacccacgaaaatcctcaaaatttctactttctgagctcactgactttttcacactacagctatttagtatcaaataacttgaacttcacatctatcaagcaagcaagtcaaaagcaggggaaccaattgacttccttttcctctacggacagacaaaactgtcataaacaagtcaacatgtaataacagcaaagcttcccaagcgggagctttaagaaaacactcagtgagcaacagctttttgagccttgtttgggaggatactgtccgggaggataagctctggtgggatctcacggaccacgccgagcatcgaatcgtactcctcgtctttgtgcgcaaacttcttcctcagcatcttctcgagctcaatctcatcgaaggtcttggcattctcggctgcgtggacttgagccaaattgatatagtttgttgctgactgtgcaatgaacgccatctcctcttcagtaagctttcttaggaacttggcaggattaccaacccagacctagcaatgtcaggaaacgatatggtttaataaagccatgcaatgtattaacttaaccataaaatataaatacaaagcatatttaaatcttgcagctgttcacaacaagtgtggaacataaaacatggacatcagtataaacatgcagccagcagctttgtttagtaatcctccagtccccgattacagttttataaataaggaaattcatgcaaaatatgtgtcaacacatcataactgtaaattaagggaaaaatgcagactaaacctctacctcagaatcattcaattgcattattcgaaaacaattaggtatttttctgaacaaagagcatgccaattttgtaatcatataccagcatctctgagaattacctcattacaaaatgttggcagttgattgcacatttctcatatagcaagtgaaaaaaaaaaacttgcttagcaagaaaataggaaggtaacctctccagaaggaatcctggtgttttgctttacaagggatcctgcaccaaccatgctgtgcttttcaaccaccactccatcaagcagagtggcacccataccaacaaaagcttcatcctcgacgatgcatgcgtgtagaacagcactgtgacctggcagaagctttattgtttaggtaggtgcatagcacagtgtcacagtgaatagtccatgcgaaatgaagctcagaattttaactcgtaaatcaatcacaaagcagcaatggaaaccatatttttacgattttatcaggtataaatgatgccatgtggttaatgtcttccagaaaagccaaatcacaacttcaatagcatatcagagtgtatattacgaattaagataggaagtgctctactgacctattgtaacactgtttccaattatggttgggagaaccttcccactgatattagcttttgaaacatgtacaagggaattgtcttgtatatttgttccaactccaatatgaatgctgttgacatcacctgaggacaaaagaatgaaaaggagctaaaatggttatcaccgcaccgtggaagtatccaaagtacaacttcaacactatagttactgaaactttaaatatcaatatgctagggttaacccagtatgtatgacagcacaaatgcctcacaccatgataaaagatcatatggtgtaggaggaacgttatcatgtgaatgaagctgcttgaatcctttttctacttggatttggttgtaaaggagaccatacaggcattggtcaaaaccattctcacctaattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgctttatggttgggagaaccttcccacatcatcgttgagagcccaacacatcatcgttgcaggttaaaaactcgaacttcatgtgaagtgtcagttgagagcccaacaatgaaaagatgagtgtactagagctgtttgataaaactgtgcatctccgtacgactggtggttctgtcagttgtctatgtagtaccattcatcataacaatgagtgtactgcagtcagaagcaagtttattccaaaaacaaaaatgtacagtaaacaaggtgtaacaaagaaagaaatgggaaacaaattatcaagacaaagcccatgcttactcacatgtgtaataatactacagtgtatatcgaccaagagtttacctcttaaaatggagccataccagattgaggatccatgtccaatctcaatatcaccaatcacagctgcactgggagcaacaaaaacatccttgtggattctgggctctttctcaaatatgttcatgattgtgcgatgccttggcactgacaagggcatacaaaacggtaacatgatagtcaggctcaaccataaagtttatgtaccttgctaaattcattagctcgtggttattctaaaatgacctatctagacataataccaaaacctttttgatacaatgtccaatttatgctaattcaaggccctctacaagatgcagcatggtggaaatcaatcaacaccaactacagcaccacacctaactagaaggtggaacaaatgacattcttcatgatgctacgcaacagaaaatagatgcataaccactcgaaaattggcatgccaaattgccaatgtgacactcccacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacgcccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcggcgtcgctaccgtgcgcggtgcgcgtgcaggcggccggcttcgcgctcgggcaccgccgggacggcagcgtccggcgcctcgtcttctccctcttggacatccacgtcagggccaagcgccgcgccggcgtccgctccgtcgacgtcaccatcgacgcctcacgcggcctgtgggcgcgcgtcttctccccgccgccgacgaagggagaggcggcgcangcgctcccggtcgtcgtcttcttccacggcggcggcttcgtgctcttctccgccggcctcctgttactacgacaggctctgccgccgcatctgccgcgagctccgcgccgtggtggtgtccgtcaactaccgcctggcgcgccccgcgcgccgtttccccgccggctacgaggacggcctcgccgcgctccgctacctagacgccaacggcctcgcggagaccgccggcgtcgccgccgtcgacctctccagctgcttcctcgccggcgacagcgcagggggcaacatggtgcaccacgtggcccagcgctgggcggcggcgtccgccgcctcaccgtcgtcgtcgacgacgctccggctcgccggcgccgtgctgatccagccattcttcggcggcgaggagcggacggaggagaagctggagctcgacaagccggcgctcacgctgtcgctagcgaggacggactactactggcgggagttcctgccggagggcgccacacgggaccacccggcggcgcacgtgtgcggcggcggcgagcacgacgtcgaggtggcggaggcgttcccggcggcgatggtggcgatcggagggttcgacctgctcaaggggtggcaggcgaggtacgtgtaggcgctgcgcgggaaggggaaggcggtgcgggtggtggagtacccgggcgccatccatggcttctgcttgttcccggagctcgccgactccggcgagttcgtggaggagatgaagctgttcgtccaggagcatagaaccaagcgtgtgcagtagatggcttgttgg

SEQ ID NO: 34936 - DNA, 2668 bp, Oryza sativa
cgacaggctcatatgtatgcacatgtactcccccgtcccaaaaaaaaaacaatctaattagagatgggatattacctagtccagcgtatctaaacaaacatatgtccggatacgctggactaggtaatgtcccaccttcataggttgggttttttttttaacggaaggagtatatgacaacacacataacaacacaatcatacgccaccaatactgtgagaggcactacacgagaaataaattttattattcattcctaaggaatactcgatgggatgagaaataaataacaaccttgaagatgagtaaatatcatagagcaagttttatgtcatttaagagatatgcgagaaatgaagacatcacatgggagacaaaaatccatctgcggttatttgctgccttttgttatcataatggttgccacctgctattcgttgcctttcgtcgatatacgattatattactatagtgaagtgtgtgtcgatgggttatacctcaatcacatgattcgttcatatacaaattgtttggaggacgtaggaattgattgttaggaggatacaaacaaatctgtaaatggagcaaggggaaagggatttttatataggtagacccttgatgacgagtaatagcattatttctgttgaccggagctggtgttgccatcgtatatcaatctatcacaagtacaaagtagagaataacctaatctagtgtaccagcgtatcaatgtaaagctcgagtatggttagtcgttggttagctatttttggctttctcgagaatccattcggcgagattggaggttgctctatattttttttattaggcttgtccctcacttctgggatcttgtacttatatttttaggtgtttcctttttaagtagaactaagaagataaacatagatacgatcgtcggttttgagggctctgtatttattttatgtgactcatttcttatctatttaggacttccgctatatgcacgagagttgtttccgtacaaatggtatatgatggtcttgcaaagctaaatacatgtgtatagggtactacatatttagagcactcacggtctaaatttaaagtacttttggttttggcatatatatttatctattcattttatttaaaaattatgtaaatatgcgaatataataaatcatacttaaaacaacttcaataaacaatacaagtcataacaaaataaataattttgtaactttttttttaaaaaaatatcaaacatacattcaatgtcactggcgtcctagagtctcaaaggtcactctaatctcaaatattcttttcagcataaaatatatagtaaactgagaccgaacaggatgtatctttttacaatgaatacgaatgtgaataaaaaaatctatccagattcatgaaatcattatgtatctcatctaatttcaggttgctatattttgagatctcctctacgtcttcgtctcaatctccttgcaagcgactactaccagaatggaaagactctacgtagtccaggacactgcgtgtgatacacttcttgtctatcaggtgggtaactgggcacgcatggcagatagttgctgcctaggactcgccaagaacgtgccacacaggagttcagagaaattcatctggagaaaatggcaaaacggtaaaaacaaaaacgaatacgaaactcacaactcacaaggaaaaagtctagggcctgttttgggggagcttgttccagctgcagtttttcctaaaaactgattctgctagaagttgcctcaaacagtccacaacttctgagaatctgtagttacaaattctgaaaaatgaactaaaaaatcagaagctggagaagctgggtttcagagcttttctagattatcaaaaactagctaccaaacagctgcttcttataatttaaagatcccaaacaggccctaggagtagtatctctctcatgattcattacttgatacatacagaaatcatacaaccccactagctagtttatttaagtctattgcatactactctgtcgaaaaaaaatcctacctacgaacctaaagcatgtatccatgtttataggtaggattgattatttttttttttgacggaggggtatgtatctgtaaatatttaaaattttctcctaaattatgcagaagccagcatgatagcgtcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctggacgcgctcgccgccgaacacgcgcgccggcgagtggtcccgggtggcgccctccggcaggaactcccgccagaagtagtccgtcctcgccagcgacagcgagaggctcgccttgtcgagccccaccttctcctccgtacgctccttgccgccgaagaagggcgatatcagcacggcgccggcgagccggagcg

SEQ ID NO: 34937 - DNA, 689 bp, Oryza sativa
aataaagaggtcttctttgcatagcgagcgccggcatattggacagcggcaactagagctcttaaggattttcatgatacaagtctggcagtatatgtgcgtgcagctcgttatgacggttttggctggtggagcgagacaaatcggacattcgaagtcatctccatcgtcaaccaatgaggccagcttcttcaacagctctgggtttttagacacatctacagcaagcaacatgtttactataagtaacagttactctgtaaatgatattttcaacatgcaagctgttatagcgcgtggttgataaatgtaagcaatgcaaccctataagaattgaaagaggatagaaaacaaacgatctcatcaatacttgtttttaggagtccaataccctaacaaaacaaagtctgaaaatggaaaaaatttacgcgtgcttgtcttcacttaaaaaacaaatccagaaaagtgataaatcatatcatacaaatggtgattattaattcaagcgactcaccaaataacctggacttccaataaatcctaatatatcaatcaaaacagtataaaagaaaaggttaaaaaaacagaatttactattttctggatataagataaagtaatccctgaaaataccaaaaaaaaatgtaaggagtgaggaccttactgctaatattgttatataaacaagg

SEQ ID NO: 34938 - DNA, 659 bp, Oryza sativa
  unsure (1)..(659): unsure at all n locations
atagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttgnnnnnnnnnnnnnnnnnnnnnnnnnnnnnnnnnnnnnnnnnnnn

SEQ ID NO: 34939 - DNA, 1357 bp, Oryza sativa
cctagagcctgatgggatatggacatatcctagtttactacatccgtgatttatactatattgtaatttaagttaaatcctggtttgaaatgacatttgttacagcaaagttgcatgcgataattcacgacttcaacagcctgaagcataagaggtgaagagggttcaatcaactatttcatccaagatagatgagcgatgagcgcgatttatttccccaatcaaatgggatgaaagcggttatataattcaatcaatcaactatttaacgagggaatcatagtcacatccgcttatcgatctctccgcattaagctcgggtcacagcgacacatatccaaccagcacacagagaacacaaacatgcatagaagacagagcagattaaaaaggaagaggctcttcagatgcgttaacgtttactgaatttcatcgcaacagataaaaggaagcaacaatcttttgcaagttcatgatgttcttagccaaaattctacgacatcataaaagacagttgtgtctggaggattgtgtcccgtcgatccaatactaaaaaaacatgccttgcattagcgcaactgattactgatggcgttcatgacgatccaaatcagtccacaagggtgcccaagatgtcatgctctctgaagagaaggtacctggaattccagatgcaaagattattagagcaatggtaaaacataatttatatcatatactgacagcaacagtatcagcataactatcaggaacatacagaatattggatgaacaaaaatcatcataatagatcattttcccactcaacgttcaaccaatagctagcaacagcaagcattctaaatattgaactaccagaagaaagcagcctaaacgaggaagcacgtgtggttcccggttcttcagcaacaccaccaccaagtattcgatcaattcctaactgtagcactcacaagtactttctctgtttcacaatgtaagtcttctagcatttcccacattgatgttaatgaatctagatagatatatgtctagattcattaacatcaatatgaatatgggaaatgctaaaatgacttatattgtgaaacggagagagtaattactacttcgtacatggtagccataaacaacggtgctatagcatgctgccgatagaggtcatgagagcctcattggttgcccatattcccttattagggaataaaagttaatttataggtaaaacttttatatatttgttcctagcaacttaaaaaccaatgctaaaaagaaattacgttgaaaatatcttaaaatcaacttcaaattcaagtttgaaaattcaaatatatgcttttgctttggcttattaggc

SEQ ID NO: 34940 - DNA, 1540 bp, Oryza sativa
cattttaagcaagacacccacgctccaactttaacccccacgcgcgcgcgcatgaacaagatctaaacactcccctcccctcacggatcgcatcacactcgcagccaacttgaagcagcaaggagaagcagcagtagcaccacgagagatcgaggggggaaagaacagcgtgggggaaacctgcttggacgtctcagggaggaaggatgccgccggcgctcttcttgggctgcaccagcttctccaccagcacgcggttcagcgacgggatcagccgcctcgccatcgccgccgccctcttcttcttcttcttgcgaagcaagcaaaaaagaccgagcaaaagttctacactcttcgatcgcctccgccgcgctcgtggggtttagggttttaaggtggaggcgacgcggcggcgaatttacgggcttgcccctctccagggccctctagaacgttccactcctactggaccggcccacctccacggcccatttcatttaagggaccagctaatacattttgtcataaaacttttttagaaaaaaattgatatatgtaaatataatacaatgtaattatttgtaaattgtatgtatataattataatacaaattgtatgtaacttttcaaagatcctgtgataagtgatacgtagtagcatactatttccatgaagcgtgtatgtcttgtaagttgtggcggaataccctcacctatacgcgcactgtcatttcttccttgcttgcttgtataaaccttgaaacaaatttaacgattttataattatataaaagttacatataatttttatataatataattacactatgattataatatatttacatgtgtgaattgtttagaaaaaaaattgcgacaaatataggaaatcactatatagcaaaatcgtcatttaatgcctattacttagttggcccttgtgtaatcgagtttgggcccaacttgattatgagcccatgactctggcctttgtatagcccacgagcgaataaagggtttgggtcgccgactcgccgccgccgccgccacgttcactttagttgcagtcaccggcggcgatggcggactccggcagcgcgagcgagcggcgagaggaagggaagaagggaagggaggaggaggaagaagacgacgtcgtctgtctggacccgtcgttcttcgtcgaccgcaggtgtgcttcgctggttcgctctctgctgatttttgtttggtcgagctgcatcggcttgcttgtgtgctgaagctttgtcccgatttgttgctggggttcgtcgatctgggagggaagctacgagacgactacgttcaccttcggctcgcaagtgctccacctcctctgcctccgcgctgcttccagttagtacctcctgctcctactcgttctttcttgctaagtgtagaggtatagttatctttgatgtggaaatggttccagaaagctgctctattatgcccaattgtgatgcaaaatatggttaatttctacttagctagtctgttctgggtgaaattttcttgg

SEQ ID NO: 34941 - DNA, 2213 bp, Oryza sativa
atgctgctttgtgtaacatagtaactatcaatctatcatttatctggagatagctcttccgtgaacacaaaagttagatctgagcatgatatactcaagtttatttctatttgtgcagtggacaaatatgaacaatcttatttacaaactagaacctctcatcagtacattaacttgtttgggtgtatttttgctctgggcacaatgctgcattgcacttcataacgccagatttttgctgtttccttatcatggggccaacacttacaaacattctaatgatttgtggcagctgattatgatcttactggacagttagtatggccaggtgcagttctgatgaacacctacttgtctgaacatcctgagactgtgaaggatcattcaataattgagctaggatctggggttggtgagggcattctcctctcatgtttacttcactttgtgatcttggaaaatctgacagtattgtgagcttgtgacttgcttcaggcattactggcatattgtgcagccgtttttgcaaagaagttgtcttgactgatcacaatgatgaagttctagaggcaagcttcaaaccttacgaatatcttccagtgatgtcacttagtttgacaaaatacagaagatattgagactttcacattgtgttcacatattattcggtgcagctgctttatcttcaaattctagaaagtggtgtcatagtcatacattataaaatattcaaggatgattccattgtgccacttgcatatctacttattctatataaatgttgcatctatttattccaaagattgtttgacagattataaagaagaatatagagatgcagtcatgttctgggaatgccaatgcaggttaccacttcttaacttctggttaattatgtttcatcattatgtgaatcactgaaatataaatcttccagatatcaaatagaactgatacttttgttgcagtgttgacagcagagaagctagagtggggaaactatgttcatataagcaatatcattgagaaacatccttctggatttgatctcatccttggagctgatatttatatccttctttcttactttgctgtgatttcttctttcttactttcccgtgatttaatttcagttctgatcctttctctttctattctttctgacatataatcgtatatcgattgttgcatcttgtgaattttgtgaaccttgactcgcagaaagctttcagcaatctagcatttcctgtctctttgatactgtagagaggcttcttcgtattcaggctagtaaatgtagattcatattggcttatgtatcacgagctaaagtgtatgtgttttctcaactcaataactcatcatcttcctgtccgagcatattttaccagagtttctaatattttgtgaaatcgtgtacccgaatgctgttccaagttaggaaagccaatttaatgcgtgtctcatttctgatcaaaatataaatgattgtaccttttattgataaaactatggaataggtacatttttattggtggtatccttattgtgtctaccaagaacaaggactgacttagctattgattctttttaatataccgattaacttgcttgtactataggtctgggtttgctacacatggaataatgaatatcttagtatgaaaggtagctgagtagtcatgatagaactgatcaaagatatatacaagtgaaatcaggagtgcatcaatagcaccaaataatcaaaatgctgcatccaaaatatattgatctgatggattcaaatgtaaagcagattaaacatctgaaatatgatctagcgttaattagtacttagagaggatggtcacaggcaaatctttttcctagtgacatgtagatctacagaagttctgcagattttcatggcaacaaggtgttatgtcacccattctctcgtcagcttgtcgcttgtttgagatactctgcacctgacagttcattgtcctctgcaaaatgattgtccagtactccagttgcattcatgagcaaatagaatatacaggttggcttgcagtagtttgattacaattaactgggctagaacaggtagcagcatactgtggatattttacttggtactgccagaatgtgattactgtactgacatcttgcacatactggcagcataataactggtatgtccagattgtactgtttaaaaaactgca

SEQ ID NO: 34942 - DNA, 2274 bp, Oryza sativa
  unsure (1)..(2274): unsure at all n locations
cttaactaagacactgctgctctcattgattaccagcatggatgttctagtgctcaaggaagctgaaaaacatggaatgcatgtcaaagaggtggatgggacaagaacaaccatctcaaatcttgaaggagtcatatatgacattaccctcaaataatgctgctcttcgcgcatgttgatgaagtgcttaggtgatcagtagtcatgaaaagtacatgcaacttcctctgaatgactacatcctttcggaggaggaaagaataccacactgccacagtaaacagcattattgatgaagggcttcaattcatacgctgtcatgctgatttgatgtaggttttttggagagggattcgatgtggtttttgaatgctttgattatcatggatagtagttttgtcacagctctctctgaatactatcttgtcaaggagatgaccaaaaccctgaagttcttgtgaggaagaagttgctgaaagcagtggcataacgtaagcttgaggttgctggttctgagctctgtaaagttcctgaattaccatgagctagcctgtaaaacgtcaattccaactgaagcttcagcaccattcacttatcctgcaatgcatgggatatatggatccaatcctgggttgttctttagcctgttcttggtttcgccatcttttatgttttgccgcgacaatttgtcaaggcctctgcctaatccaactttgtcatggaggcaaatgccacactcttaccggcttttcttggaggcagcccaagtctggatctccatccagccaaatgacatgaactgtactggatcttgttgtgttcccctgttgcagcacagtgcctgttagcactgatgcattgcacatttgcactgattcattgcactgcttcagctgcaaatctgaacaagtctgaacctgttcaaagtgtaggcagtatgcttgtctgcaaccaacatgaacaaaggctctgcacattgttttccatgataaactcatggcaactgattggccatttggaggttgaagctgggtcccttggtagcaaatgtatacaaccaggtgctctgaagctcaaagatcctncctccagccatgatgttgcaaccaacttatntaaagaccaaatcttggtgttcaacatcttgtttcataatctataatgatatanaatccgcatcagagttattactagcaaaatcctttcccctcgnnnnnnnnnnnnnnnnnnnnnnnnnnnnnnnnnnnnnntgacaaaatgtattagctggtcccttaaatgaaatgggccgtggaggtgggccggtccagtaggagtggaacgttctagagggccctggagaggggcaagcccgtaaattcaccgccgcgtcgcctccaccttaaaaccctaaaccccacgagcgcggcggaggcgatcgaagagtgtagaacttttgctcggtcttttttgcttgcttcgcaagaagaagaagaagagggcggcggcgatggcgaggcggctgatcccgtcgctgaaccgcgtgctggtggagaagctggtgcagcccaagaagagcgccggcggcatcctcctccctgagacgtccaagcaggtttcccccacgctgttcttccccccctcgatctctcgtggtgctactgctgcttctccttgctgcttcgagttggctgcgagtgtgatgcgatccggtgaggggaggggagtgtttagatcttgttccatgcgcgcgcgcgtgggggttaagttgggagcgtggtgttcttgcttagaatgtttgatttcgattgcctcgtttagggtgctgatggctagggaacaatttgttgaaattacttgttcgaatgatgcatgattgtgcttagcggggtcagattgcgtttttgtaggccgcaaactgttaatacattttgcaattgtagtaacagaaatttggttatgcctatgtcattagtctctcgtaaagaattgattttttctattatttgcgcttttggattatataatcatgctggattgctagttacactgttactgttttattacactagttgcatcaccttgctaatgttgattgtttaactctgaatgttccgctgaatccagctcaactctggtaaagtggtggctgttggccctggcgaacgtgacaaggatggcaagctgatccctgttgctctcaaggaaggagacactgttctcctgcctgaatatggtggactcgnnnnnnnnnnnnnnnnnnnnnnnnnnnnnnnnnnnnnnnnnnnnnnnnnn

SEQ ID NO: 34943 - DNA, 5679 bp, Oryza sativa
  unsure (1)..(5679): unsure at all n locations
nnnnnnnnnnnnnnnnnnnnnnnnnnnnnnnnnaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaagtgaaatatataaagaggaaatcccacctttttctcagcaaccatcttcaattttttcatgaattgatctgagaaacatgcaagaaaattcatcaatatcagtatatgtaagctggtattctttattgaagggcagcatatgagaaatacatctacaactgcaaccaaagtcttcatccccttatgcactgttcatgcaagtcccacaggaagtaactgacctcaactcaagtcatattacaaatatcaccaagctactgcactagagaatatatttgtctattctaaaaaaatcaatactaccttcatccccaaatgtagctattgtccaggtgcatagctagaaatagctacaatttgtgacagaggtagtattattttccaatcttcatctccacaactattttgaagatctattccttatgatattcaaaactgcacattgctcagaacacagcctttccttatcatttcagtgagatacatctatagacttctcccatgagagggacttgtgctgcaagtatctcatcaatttctacaaccttgtgccaaagtgtacttaagtttgaaggccacaaaaaagatcagtttgtgcgagtgtctatttcaactctttgagtgttctggttctcaattgaatactggtaactcagactgttgttacagctcagtttagccatccaggaaatcaagcttccatatctactccctattaatctagtttggttatacacagcttcagttgttcaagtcaagaacaagaaaatcctaaatggggaattcaatacctacctgacccaattcataaagagtgatcaaatgatttctggacctcaaattgaagagaaattgatatgtgctgtgaataggagtccagcaacatgccaagttgatcattaatatggaattaagtcccatggaagtcatgagtatgtcatgtctaaccatggagaatgaggattgtggtgtgaaatgacaaacccagggcctcagaataaaggcccaaggctagttagcaattggaagaagtgaataagttccccatgggattcacatgaacagggatgaagcaggaagagcaaactttatggtagtgacacaggacgtcattccagcataagaatataaagttaaatgggtattgcaggtttagttttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgttaccgttcaacccagttttctatttatgaaaatgagctctaccatctagttctctctcaaccatagcctccaactcaatgttatgcagagagaaacacaaacatgcttgcaaatagcctgttaaaagttattcctaatattaacctacacacttcaaggggctaaaattagtgtcactaaaaatagcctgaccacataaatggcatgggaaacacaattgcatggctctgtaattgaagtagcatggttatattgagatatgaccaacttagtgtatctctagcttttagaaccatctgaagtacagaaataaaaatcctacagctctacatcttcaaaagaaaattccagatgtactgcattctagcatccttatattgttaaagaaaaaaaaagagttttcctctctctatctcattttaactaacatcactcaggcaattaccagtgcactatcatctctacaacttctactgcgcaaacaactcaggctagaagacaggttcatgacgcaattcgacggatcagtataaccaaagtgagattatctcaacataatgcgtaatccagtctccacgcacatcagcccaaggccacaaatcaacagccacccaaatcaaccaacccatgccctaaaatcgagacccctcttgctcccccaactcaagcacctgaactgctagatcgccgccgaaacgccgattcgcccccgccctacacgtgctggaaacgagagagtagggtatgagaaagggggggaggggaggggatggaaattacgcagtagtcgcgagatcggacgacggggaagagctcgagcatccgccggaactccctctcgtncatggcgccgcgcgccgccgctactccggcgatgagctccgcctccgcccgcgctcgtagggttcgatccgattcgagcgagctcctcctctcccgattcgttgctctctcgctctcgaagcctcgaactcgctggagacgagacgagacgacgacggcgagtccaacccagacggaaccgacgtctacgcggcgcagtcgcttgttggattatcgggtccactctgtttcagattccggcccaaaataaacatctcaggtcttgggctcttctgggctaggcccagaaaggacacaattaaatgggcacgaaccaaagcttaagtacagatgaatttttttcatttttaattttaatttttttaatatttacataaatattataccatccaaaatatttacacaaatggcccctgccgcccaagtggagggcggcaaggtgtgcgcattttacacttaggtcccttgccgcccttgtaccctctacaagggctgcaagggggtaaatacaattttcgccctgccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgnnnnnnnnnnnnnnnnnnnnnnnnnnnnnnnnnnnnnnnnnnnnnnnnnnnnnnnnnnnnnnnnn

SEQ ID NO: 34944 - DNA, 450 bp, Oryza sativa
cagggttagtttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgtgaccgttcaacccagttttctatttatgaaaatgagctctacc

SEQ ID NO: 34945 - DNA, 2374 bp, Oryza sativa
ggcgttcctgccggtgggcgccgaccgcgaccaccgggcggcgcatgtcaccgacgagaacgccgagctggcggaggcgttcccgccgccgatggtggtgatcggagggttcgacccgctgcaggactggcagcggcggtacgtcgacgtgctgcggcggaaggggaaggcggtggaggtggcggagttccccgacgccttccatggcttctacggcttcccggagctcgccgacgccggcaaggtcttgcaggacatcaaggtgttcgtccagagcaacagggcggcgcgcgccaccgcctgaattgagattcgagagtttgatctgcttcgtaccgtacacgcgtcgtacacttcatatacttgagattttgaattgggatttctgtgattcaaggtgaaagtttaaggccgcagttaaaagtttcgtatgattttatgttgaaaactgtataatttgagtatgaaggttttaagttttcatatgaaagttttaaatttgaatttgaacggtttttaattcaaaaatgaaaaattgaggtcacagctaagtgtcatgtgaaagttgtatgaattaagatgaaagttgtatgatcatgcattgccaccgcgatgaaattttggcatttcatacgaagcgagtgtaagatcacttggctaagtttcatgtgttgaaaacatgctcaccccaacatgtcatagacttactagggtgttcgtatttgcagctaactatttttaccctttttttaatggtaggtgtcatacccgctttatactgaaagatgttggatcagtctttggagatgttcatacggatagagagtgggtttacaccggtgcagtccttggagatagtaaggagtaagtgtgggtacgtatgtaagtgtttaccccctccgtccaaataaaccaatcctaactattaatctggatatatgtgtgtccaggttcatttttagagtttgttttttttttgacaaattagtatgtttgtaccgtgtttggcaaaaataaaaaataaaaaaaaggcatttggtatagaaattatgtatgagtcgacgactcgtaagagtacatacctccaatagttacgcattcgggaatgtattttctacactcaggtgtatgcatgtagtttaaatagttatataaaaatttcataaaatttgataagatggactacgataatataagatactacaaacatgtaagtctaaattcgatatacacatgaaaaacaaaaataataaattttatctgcgttgtacgatatcgattattattttggtttatctagttgtagatcaaatataatcttgcatgtttctgtatagatttatatcatcgtaattaatgttactaaattttttctataagtatttaagtcgtatgtaaatgatgggtgctatggcatttaggcgtagaaaatccttgttcttacccatccttactcacactctgtttttcatcaaacagtgtaggcctagtgtaattcaaaatcagcctaatactatctgggatttttcaggatattgctcctgttaaacttcaaaatcccatgtcagacgcttctaaatgttcagtaaactaagctatagtacgcactgaacttactgatcagcaaaaaagattaagttttcaatacttaagtcaagaatcacctgaatttgccttgcgaaaaggaagagagatgtgataactgataagcgtacaaacaaattgcgacctcatatagtcacatgtcgtatgtgttgcttgcacccttctcacaacaatcctacggcgtgagaccgcaaagatagcgtctgcgttatcttcaagtacggagaattggcgatctccataactccatgtcacctctatccaggcctcaatcgtaatatcaatttcatatcactttgaaagttgttttcagaccaaggaattcctaaacttctctgaattttgtgcctgcctgaacactcactgaaagacacgcttcctgaaccactgaattttgtggctgcttgaacactgaaacaacactttctgaacctctgaattttgtggctgcacactgaaagataaaattcctgaacttctctgaattttgtttctgaacctgcatttttttatcagtctcccaaacgaaaaggtagaaccgtcggagtagccaagaaatggcgggcgcgcacgggcggcgccgccgggtggcactgccgtggccggtgaggctcaggctctgcgttttcgaggccgccattgacgcgacgcagcgccgagacggcagcgtcaaccgtttcctcttctccctgttcgaccgccgggcgccggccgacccgcggccggacgccgccggcgtcagctgggtaccgagctcgaattcgcccta

SEQ ID NO: 34946 - DNA, 5206 bp, Oryza sativa
aaaaaatttcattaattatttttgccgctaagctcttgccaaccaatggggactatgtctcgttggaaattatcggagtaacatctttagtttgttttttatgaagaaaaaagtgaaggaaaaaaaatgatgctttagctcatctcagcaaaaaaagatccaactatagtttgttagtttgtttttagttgcgagatgtacaagttaaattttaaattatatatttataaagtgatatattacatgttaatacatccttttaaacttttttataactatgtgagtatatatacaataacaataagaagatattcctcaagagtccccaataggcagccatgcatcgccatcaacgtaagcatggtcgttgcgagagacttgagacgttaaccacaaccacaaatgtacgtatcagataatcagatacacatcattgcaaaaggctactggattaattaattatatccttcaatcaaacaaagaaaaatcgctacaaacgtgtggctatgtgctcatcagttgagcagtacacaataatgagattggatcaaaatcatatcgcattgaagctattgggttgtacgtacgtagtaccaatgtgttcaactataaaacttaaattgaagacgtactaattatactcaaaacaaacagaagcaacggagctatatatggtcgtatggaattgcattaaaatacctgtacatgagattatgagaggtatcaagtgccaatttgtcaaatttgaacgcagctagagttcattggttcgacgatatggtcatgactcatgaatgccaatttaggctaaattcggcgctggggacttaaattctaggtagtacgagtagttacacggtatttcaaatttctactatcaaattggaatattcacgtaaaaatcaagggataattttggtcctgtgtggatcccaccccaaatcccaccgaacgtttaaacacctacatgaggtattagatatagactaaaaaataactaattgtatagattgtgactaatttgtgagatgaatcttttaagcctaattgttccatgatttgacaatgttgtgctacagtaaatatttactaataacagattaaataggcttaataaattcatctcatggtttaccggcggattctgtaattagtatttttattagtgccgaacatttatggcacaccgtatataatacctgatgagacacgccgaaactttactaaacaccccctttatttccaaaaaaaattaatcggttcacctatatatagtgtcctctggacactgaaatgactcccacagaaaccggctaaatgctgcacgagaaggagcaagaaacggccggcgacgagctccggcggcccgagccgccggcgttgccgtggacggtgcggctccagctcttcgccctcgtcaccgccgtcgacatcgtgcagcgcggcgacggcaccgtcaaccgcttcctcttctccctcgcagaccgccagagcgccgccgcggcgcgcccggacgcccacggcgtccgctccggcgatgtcaccgtcgacgcgtcccgcgggctgtgggcgcgcgtgttctcccccgcgagcagcagcgccgtggaatccccgccgctccccgtcgtcgtctacttccacggaggcggattggcgctcctcaccgccgcctccagccagtacgacgccttgtgccgccggctctgccgcgagctccgcgccgtcgtcgtctccgtcaactaccgcctcgtccccgagcaccgctaccccgccagctacgacgacagtgtggacgtgctccgcaccttgccaccggtgggctacccgacgacgtagtagcgggcggtcccgtcgacctcacccgctgctttctcgtcggcgacagcgccggcggcaacatcgcccaccacgtcgcgcaccgatgggccgccgccaccaccttctcgagccgccgcgtccgcctcgccggcgtcgtcctgctgcagccgttcttcggcggcgaggagcggacggaggcggagctgaggctggacggcgtggggccggtggtgagcatggcgcgcgcggactggtgctggagggcgttcctgccggagggcgccgaccgcgaccacccggcggcgcacgtcaccggcgagaacgccgagctggcggaggagttcccgccggcgatggtggtggtcggagggtacgacacgctgcaggactggcagcggcggtacgccgggatgctgcggcggaatgggaaggcggtgcaagtggtggagtacccggcggcgatccactccttctacgtctttccggagctcgccgactccggcgagctcgtcaaggagatgaaggcgttcatggagcgcaacgcgccgcccaaatcgaatgcttaattagaagcgttttatttacctttggcatttcaaaatgttaacctggactgctatttcatatatattttgctgaaatttgatcaagttttgcgatgatgaattgctctgtgaaataaacagattttactttttttagataatgaaataaaacatctcggcttttgctcatcagagctacagccaattattataaaagtaacacccaaacactgaacgtagtttaaatgaattaaacatacctaataaaataaaaccgattttactagcagcgtattttttattccgatttcatcgcatggatcccatgatgctgacggagacattaacctaccatacgattctgttcacgcgaagcacgagcacagctgcacatttctgacttctttttgacgcgccaagagaaaaagagagagagagagaggaaggctgtgttttcggtgcaaagtttagattttggttgaaattaaagatgatgtgactaaaaagttatgtgtgtatgacagattgatgtgatggaaaaggactgaagtttggattcactttagatctaaacacacagccttgaaacatgataagaattactttttgcgacaagtaaaatcagtctgacttttgagacgtacgcgacgcattacacgtcgatagaaaaaatcaaattcaaaagctattttgaagaacacttttcgtgtagggttctatccttttcttacaggctctcgttttgagcctataggattagattctcctcgttttctgttagcacgcttttcaaactgccaaatggtatatttcgtgcgaaaactttctataaagaagttgttaaaaaaatccaacaaatttattcataaaaaagttatatattaataattaattaatcatatactaatcgcatttctcgttttgcgtgcgactaaaccgtccaccgccccagccgaaacaatcgcacccttattgggccagaaaatataatcattgtgttatcatacaattatttcgtaagtttaaacaacttctatttccaactttagtcgtctattacacggtccaaaatgaaacacactcttttgtttaatgatattttctaattaagtagagggcgttttgtataaaacaaatgtttaatgatttttttcacgtgtgccaaagtcgaacactttaggagcgtatgctactacaaaatcgatcttttatggcgtcaccttattattttctacggcggccatacgtgaaaactaccagcgacaatggggctatagaccgccagcaaaaatggatcttcgctggccaacgaaagtgtatctttttgctggcggctcactgtaacgatttccactgtcagctgaagaggactgccatattaaaagatcagttctttccatcgcacctaactatttactacctctccatacctatcggtacgcactcctttactacccctcttcttttgcttctctgcatatgcccaccggagtgcacccctactactttctgactgtggcacacccccctactccgtcttcaccgacggatccagccacaacgaatcaagcgggtggcagatctggtgacggcgagtcaagcgtgtggtggatccggcgccggcgactttcgcgggtgacagtctggtggagtcaagaaggggaggttggtggcagcaagccagcatatggagcgtcggtgcaagcgccccactcccccttccttcccaaatctggttggagggaagaagcccagggcggggggttgccccactctctcccctcacctccctctttttgatttggctgaaaaggagaaggccggtggcggcgcggcaacaagggggagagcggtgcgcggtggcccctcccctccatgatatgtgggtccaatgtcaaagagttaattgtcacatttaaaagtgacactcttaaggataaaataaactacacggttctgttcacgtggagcacaagcacatcggcacatttcagacttttttttgtcgcaaaaaaaaaggggaaacgggacgagaattaaatcagtattaaaacgagagcgatcgacttacacgagtatatagagaaactaaattcaaaagtacagcagtacattttgaagaacatttcgtacttttattacaggctcttaatgggccgagataccggcccatatcaacacaaggcccacataatagcatttgctcgagaggccgaatccgaattggaataagttcacttcatgaccctcaaaagtgatcgaaatctaatccatgaccctaaaccacaaaaccggatatctcgacccctaaactcttaaaaccggtgcaatttgactccctgggcggttttggagggcggtttcgctgacgtggcgcctacgtggcagtattgactcggtcttcttttccacgtggcgttgatgtggcgcttaggtggcattagaaataaaaatatgcgtgggatcctctatctccctttcttcttcctcccttctctctttctttctttttctcctctctccttcggccggccgcggggagcatgggaggctggagcggcaacgggcgggcgccagaacggcggcagcggcggaggaagctgaagcggtggcggcggcctcgccaagtggagagaggagaggagaggagagcaggtgagggaggaaacgcatgtgatgggtcacatgagaggaggcggcggtgtgtaagggccggaagggagaggggagaggcggagccgccgagctcgtgttgtcgccgccaccgccgccgccggtgcctcctcccgcactcgcgctcacgacagcgctgccgcgtgctgacccggagtggcggcgacgcg

SEQ ID NO: 34947 - DNA, 3268 bp, Oryza sativa
agtcagttgtaagcacatgtggagtagagaagagaagaaagaaggaaagcgatctccagatttatagccacctgcacaccaaactccaatacgttgtgtgtatgagagacgtgaccatatttttttttgatcaagggctgcgcccctattccgttactagaaatgagcagagctaaaaggttcgaggcgtgaccatatattaatggtttatagataatataaccaaactattaaattagatatagataatttaaagtcagtagttgactatactattaaacttgctcttacttatgttagcagatttgcagataccaaccgcgctagctacatgtatagcccgctgttcccgggatcgattcaatcaatcctgcgaagtcaaagccgagcacatgcgtagcaccaacgagatgcagctgctaaccacatctattactcttgtttgaaaaaaaaagaggagaaaaaaattaaaaccatgtgattgacgatgctcttattaacttctaacttgacgatgctcagaggcgacgcaatgtcctttttatttttggtgaactcttcagctttataaataaccacacatgtggcttgtgaagactgacaacacaactgaacaaacaacttcctactagcaagttagcactacatgagaaccctgtgaaaaatcatgcgtcccaaacgccctgaaatcaaattgaatattccaatttgcagatgaagttcagctcccctgaaaattcaatcaaaatgaaaaaaaatacgaagaagaaaaattcgaagtgcagacagaaacagacaagaattatcccaacttcctactactacggagtactaccggtggaaggtgtggggtccacgacgcgccccgcgccatcaacggaacggtcgcgaaaccccttcccactatcctccgccgtccgatcgagatcctacggcccgcagcgccgcccggagggaatctcggggggagcggagtcgagtcgtgtcgtgtccccggatcgcacttgcccctgtgatgactctcacctgacccgcgatcctccggtgggcccactgacatgtgggccccactttttccttggtagggcccacccccgcgtcgccagtcgccactgccattcaaagctcgcacccgctcgcgagagaagaagagagaaaagagaggagagagagaggcaaacccgcaccaaaatctctctctctcccccagatttgcgccacattttcctcgccgaatcagcctcgcccccgtgggtgcagctgccgcgggatcccggcgagcgagcgccatttgagccggctgccggcgggtttgcgttctggaagctccttggtaagacctctagctccctctcctgttttctctgtgcgttttttcttttttagtttctctctctctttttcttttgtgtgtgttttttgtttgttcatctttctacttactgcttttgaatggctggacgattgggaggcagattggcagaaggttatattttttttctctctctctgtttattttgctagtatgagtctgctatagtgcattatttgatgaaaatttaagcaaattatatatatttttgaaacaagaattgtataaggaaattagtacggaattgcactcgcatttgcgtggagtggcgaggtggttagcgcaggagtatatactagcaatgatttgccaacgaacctactagaaaacatgtcccgatagtgaattgaattcatgcgcctttacttcagttttaattttcgtacgagtgccgtgtagccagaagcccagaagaactgtgcatgaattgaatagctctgctatgtctaagcttaagtttacccatgaattctgaactgtgttgtttagtttcatttgtaataaaattgcaaaggtctttcagctccaaattatttttgttgttcgcaagattagagtaactactattttttggctgatgccagctacaatgtttgaaaatttccaactgtacttgatgctacctggtgattggttaaccttttgttccccaccgatcactttaatcatacatgaacgtcctttttccctattccactgacaaatttgcactagtagtttatagctttaccatctggtactactaactgtccttcatagtggaatttaagtgtaacaattacttggtctgtagcctccaatacagatttgtaactttgagtttagtgaccagtattgtttatacttcaatacttgcgacgcatgaggtttggttaattggtttggtggtagcacttgtgtgcagctagatgatactatgatatccagcacttattttgtttgaaaccgaccagcacttgcttttgtcttatatttttattatctatggacactgcattttatttgtactctttcctttttatttttttgatggtgttgacttcccctaatgattatggatgcacattttaaacaaactataattatcgagcatttcaactaatgataatttactgtggccagctgtaaactattgaggggtaaagcctgctatttagtcaaggttgagggtgctgtataaatgacgcgggcgtccacaattgatttcgggcggaagacacataatgatgtcctctggtcagggccattgcgtcctgcaaacttcatcagaaataaattccctacatacaagaagagtttgaatgggatagttatcaaattgacagatgatcaagaaatgccatctctgaaagaggctgttgccaaggaaacagcagacctacttcatcggagtcagcgcctttcagtccgtgagcttgctatgaaatttgagaagggtcttaacactgccacattgttgtctaatgaggtatggaacttttacctgttttaggccctgtcctcctgaatgctctttgacgattggcccaatacttgaatgaatggagttatataaatcaaagttgtctatctggcctcaccttgaaatcttgaactctcaggttaaatggagacaagctgctttattggagcgagacatccttctgaaaaatctaaagagtgtattagaatcgctgagaagtcgagttgcagggaaacataaggatgaaattgaggagtccctttctatggtttgtttcttgttatgaaccatattttgatttttcaccaaggattgttgctactcaatttgtaacttttctaatggtgttgctatttatctttaattgtgtagcatgtgttttcaaaagaggctactattctgtccttttttttccctccaagctccatatgcaa

SEQ ID NO: 34948 - DNA, 562 bp, Oryza sativa
tatattcatttcaggattccttagaagagtctctacgtaatcgaccaatcctgcagctgctcgacaaaataacgttaccaatgtcataataataaaagcgcattaatgttaccagtcaggaaaactaaccaggatccacagggcaagcagtcttcacgacagagatttcaccgcaatgggtgatctcagcttgcaaataccgcccaacatcatgtggttctggagcatatgcttgctttatggcacctatagaagatcggtagcaagtagcaacagtcatcagtgttacatcgtatgtagaaacaagatcgttttgcttgatgaaaatagtttcacctgaaattatctctttcttgtttccttcaggctgcacacggaaccactgtattgtacttcttgataaatcaacatatccatcactctgggaaactatgcgcaacattgagcctaagctttcaaggccctccagctcatacgaggacacatcgttttcctcatagctttgatgcaggtgtaactgataaaaaggacagccaatcatgcatggaaataaataccagat

SEQ ID NO: 34949 - DNA, 1240 bp, Oryza sativa
gtcaacagcatccatggcagcggcaaaccgtggtggggaagagcagaaaacatcaatgctttgggctcctgcatgtaaattctcccatcgccgccaagctgctactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggtgtggacgccattgatgagccaccggatccgctggcaaagaaatcgcggctgccgcatccaacacccacagcctccccttcgagtctgcgtcagcggcggcgtagcaaggagagcaccggcagtgagggcgctgcgaggacaccacccatccacaacatcgatccccttcgagcggagaatggcagcaacgtagggaggacacccggcggcggccacggcactgggaggacacccagcggcggccacggccaagccaaatccaggcgccgcgcaggagagagcgagagagatgagaggggcatggcggctgggagttttttccttttttttttacgcgcctgggattctcgcgaaggggagagagagagagaaagaaaaggaaattttgcgaaaatgcccttcagtttctaggattcagggcgcagtccttttttcctctttttgtctcctttgtattgaatttcgtaggatgcaaagggcctaaacgcaatattttaaaccgagaaaagaacagagaggacgtataacaaaatatctataaaagagagggcttttctgtaaaatttgcagaggcgacgcggacgcatgaaaggccgtgaaatccatccgctctccagcgcgcgtccacgcgtcgcgaccccgtgatggccacggcagcgcaaaacgctgagggcgctgcatttcccagttggtttgaagactttagatagtcgaacaaacaggcgacaaatcgaattttcgaaaaaaaaaattgtccgtgcaaattaacaaatgagcaaatcccaaactggcttaagctagctagtaggctagtagccgtggcatctggacatgatgggcgggtcggcgaacgggccgtcgagcacgccgcgcgccatgatccggtacaccgcctccgtcatgtgcaggccgtcccacgagatgcgccgcgacgggtccgcgcactgcgtcgcgccggggtcggagc

SEQ ID NO: 34950 - DNA, 763 bp, Oryza sativa
gtagtggatgaagttgccggtgtcgatcagcgagttgccgaaggtgaacaggtggctgtagcacccgccgctcggcgccgtcgcagtcgtcgtcgtgacgttcgccgccgacgccgtggctgcgcacaaggctaaggcggcgacaagtatagccgccactgcgggagcagacaaccgcgccggcctcgtcgccatggttggagcttggatatgcaaaatggcttctccagtggcgcctctcctttctcgatttgagcctatatatagagagattattatgactcggctcactgcaaaaaaatgcttacgccaaattaattaccaaaatgtttcggttagaatgtggctttcatcgggaagaagacaattttttaaaaaaaatattacaaaatttcgaaattagcttttcgatcgagctggattcattggttatgatattttttaagattgcggttgactttctactgcgtttaaaattttccatttgttttgcaccgtatttcgtcaactcatgcacagtgatcaccctttaaagtaatgctaagaaggatttggcagttggggggtcagcataaacaagaatctcagacggattaaaaatataaaatttgtactataagttgtaattgatgtggcgatttggtgatcgaagaactgaagagaaacaggaattatcatctgctgccttgcgagtatagtatgagtgatagagacgcgatcacgcggtccattgatttcggggatcctctagagtcgacctgca

SEQ ID NO: 34951 - DNA, 3275 bp, Oryza sativa
aaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagccggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaagaaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatc

SEQ ID NO: 34952 - DNA, 1706 bp, Oryza sativa
acattgtatataaaaaagagagatttaattagattgtttatgagataggattttgtaggattattgcaggaatgactccaattttctcctaaacagtttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttccacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacgcgtggttcgccttctccgtcgtgttcaactccacggggcgccgcggcacgctcaacctgatgggcgccgacctcatgtcggagaagacgagggacatctccgtcgtcggcggcaccggcgactt

SEQ ID NO: 34953 - DNA, 1599 bp, Oryza sativa
  unsure (1)..(1599): unsure at all n locations
nnnnnnnnnnnnnnnnnnnnnnnnnnnnnnnnnnaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagttagctcattatcatcaggtgaacggcagaatcgcatatcttggtggaatttcttcatcaaattatcaattattttttttcgtgtcaatggatctcgttccagtgcagtgcaagcaagcttcataaaaggcattgtaaaaggccggattccatctgcttcctatgatgtcaagaaagtttggtatcagtatatgttacataaggagctagaaattcggatacataaagaagagactggcaaagaagttatattcaaatataattctgggctgtgtagatgagaagcacatcaagtaaacaccattcgttgtaacatctcctgtcacttgtaaaatagatgatgtt

SEQ ID NO: 34954 - DNA, 524 bp, Oryza sativa
  unsure (1)..(524): unsure at all n locations
nnnnnnnnnnnnnnnnnnnnnnnnnnnnnnnnnnnnnnnnnnnnnnnnnnnnnnnnnnnnnnnnnnntatgtggcagatggatgacctgagtggtcagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatcaagtggaatggctctgggagccgataagtaatgatctgacccgggaggtcggtacattaccaaatgagctgttgaaaaacatctcttaaagtcgaatcgagacgcaagtctcttttcggcccaaacttaaaaagaaataaatcacttagtgatttcaaaatgtcttcaaataaaagatttgcaaaacaaccttacctctctttcaagcttgcattaaacacctaaattctcgtgacttgctgagtacgaaagtactcacccttgctctatataaatatatatatatata

SEQ ID NO: 34955 - DNA, 746 bp, Oryza sativa
aaaagacaagtcacgcacaaagtattaatcatgttttatcatctaacaacaataaaaatacgaattataaaaaatctcatataagacgaatagttaaagttggacacgaaaattcagggtttgtctttttttttttgagacggaggaaatatgtatctaccagtttcatcaagccccacgaatctcggagtcgcgttgcgttgcacaacggagcaccacgaggcaaatactgtaggctactactacctgcccaggaaagagttgtggctagagaaagagtttgtactcaaagtctgaaaggccacatcgaaggttggaataatggagaaagagttgtgaccagagaagaataatggagagtgccaaatatatactatactgaaaggccacattacgatgctaaactgctcaggtgactcgctgacagtagtacttaggacacctacaatggttatatataggctctctacgagagatatatgtcagcatattttcctacttggaagagattaaatgaagagagagagcaaagctatctactaacctggagatagtctatagagaaaaacgaggcaatggattagagagctatagatacccatgtagacatactattgaagtggtttactattaatctagtatattgctgagatgtacatgtttttatagataataccttactttaccattgcgggtgctcttagtactactaatatgcaatttattgtgcttgcacttagagagta

SEQ ID NO: 34956 - DNA, 3239 bp, Oryza sativa
ctaccatgaagcccttttgccagcccttgttgtcgcccagatgagccaccggtttgctccatgtggacagatcccagaccagcaaccagtgtccgaatcaaagcaagtacgcagtctgacaatggtgagaaggccattaacgatggcaatgtcccggcaaagcgatgaggtattgaagctcattggagagttgatgagctctggcggcagtggcaggtgacttccaggacagccatgggcgagcacgttgcagatgtggattaattccccgcttgagatcaatgaaggccacctctccctgcccctcatccagagtaattaccttgttcgtcaaatggaccaggcacagatgtaggataccagcggcggtggggcggtaaagatggtggccgttgccgagatcggcggcggcggtggtggagttccggcggtcggcgatgtaggcgcggacgtcgaggaggatccatggtagaggctggtgtgcatccagagggtcgccgccatggcagggcgggcgcagagtgaggtgctcggttctactccacctgtaggggaagacggtagccatggctcaggaggcctctcctcccgccggcgatcgtcgtccgcccgcccgggctagcttaagtagagcagagcagaggagtcggagtcggagaggacatctaaatcgatctcagcaatcctatcaagacaagttggaattgacgaaagatggtttggatagaaacggattgccggcctgatcaaacacacagcatagtttacagtcttaactaagcaaagtattttcagagttcagacaaatgcattttcagagtagagaagagtgtattcaggggctcttttttcaacttcaaactttattttttttcgtttttcgttagcatgttttttaaactattagatggggtgtttttttaaaaaaaaattatatataaattgtttaaaaaattaaataaatcgaacttttaagtttataatagttaatacttaattaatcatatgctagtgagttctcttgtttcacacgaactgaaacatcttctccaataggatgaaacgaacgggccaatccactttttttttccaaattacaataacaatatcagcacgcatacaaaacactagagtcgaacgcgcggcaccagtggtgcaagaggggaatttgttgttatttagttatacaaagttaaggaagaagcattatggtagaagagtaatcttgatggaaaattaattaacaatttataatatatatgaccaaacatctttaaagttataggaatttgacatgatgttgtgtgctgtatgaaaaactaatattaagctagtatcaaagatcatgtgctatgaaaaataaataatagtttgaccataattgtatgtggtgctctgaaacaacatgataaggaaaagccatgtgtggtatttaggaagatgaaagagcaagatgtgaagccaggtgattttcagggagatatgggtcaaattttaaatctcgggaatcagatggttgttgatggaatgcactgacaaaattctcaaccacccagacctatcacagctactttcactaatcagcacacccctgtgttccaaacctaacgaagaatgaatcaatagatagttccaattccaccagcaagtatccaagaaaaagatgtatatgtatcccagtttgtaggagatagatctgggatcagagaacctgaaatgcattgccctatcgcttgcatttcagattttctgatggtcagcaccaatgcctgtcgcttgctaaccatcagagattgctaacaaaagagctctatatctatctcagtttggttgcactgcacatttgcattttaatgtatattcccaaaggcttatcagattagccatgaacattgtaccatcatatgataatgctgcatgggacagcatcacctttaaattccttgtacagcatttcattccaaagcttgaatgctttgtttatatagcacctatcttacagagctgaggtactataaaccattttgcaaacaattataaatgaattccaagaaaggaagcaattaaatgaagcaactgtgactttttttgggacaggttggagctgccagatttttactgtgattaaaatgcagcaccaaaggatgatttataacagatgctatattgttgtagaaaataatcaggaaagtgaagctatgttattctagaagataagaaaggaaaattaaggcaaaatagcaccattcaacaggactgactaagatcaaagatctataaagcttatgttgctagacatgaatctaactgggaaaaaacatgtctcccagattagaaacaaacatgtatcccagcttaatacatttctatttttccataacaacagtaatgtaggtcatcccagattagcaacaacagttggctgagagctatctcatgcatatttttatgccatatctttaccctgaaaataaggagcatagcaaagcagtagacatccagagtaataataattaagagttataggattccaaccataagtgcttggtcatagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttgtcctgagtagcagaagatagctcaacagacgatgcaatctgcggaggttctcccttaatttttgtctcagttgt

SEQ ID NO: 34957 - DNA, 2188 bp, Oryza sativa
  unsure (1)..(2188): unsure at all n locations
gcttctatctttgatcctgtactgccttcacttgttgctggtgctagttggagagagctgcttgagtctgctggcataatagctaatgtctgttgtgaactgcttggtgagataggcagtaggccctgcacttcagcattggatgagataatgttgttaacctgtaaggtttcttgatttttcataatagtatcttgtgtgaagctgatgttccagataaaggtttggttgaaaagagctacaatctcatctggaatatattcactgtcaggtggattttggtcaatgagagtctcaaccggtttgcgtacgaggcgttgtgctattctcccaaagaggataaatgtagcttgagcagtatcatcagcagcgatcaacacaaccttgtatctacatgcagaatagaaatagttatagcagttttgataactgtgaaataagcatggaggaaattgtgccagcatattcttaccttggcactggtatgcctacattggagcagctggtgcatttataggtggaaccatatggttttgaggtcttgtagcatatgtcacatgaataataccaccaggagctgttgcttgatatgcctttaatagtcactctgactataaaacgtgctcgctgcaaagaaatatgattttatcatttttgtcaaataagaaagnacaatattgcagtaacaaagcttgaggtggcactgaccgcatgtttgtgtgggttgagagcaaggatttgtgntatggttttttcttctggaatatcctggttaaaccctgtggtagcagttcaacccacttgataggttgaaagtttgcgctaaagctacagaaagaagatatcttaaataataatgtatcgcagggaaaatgtatatgtaaatggatgattgtgtaagcattaaaacaataatataagcttgtggtgtcacctttcttttaactcaagcacttcaggcatatcaaggttaatctaccatttgcatggtgaacttccatttaaagttagtcctgtatataattgtattaataaatatgtactgcagatttacagaaggcatgaaaagattttggtacaaatttatagagatatacctatccctttgtagttcttgacaactgttccaacaaaaacaataacctgaggtttcttttgaccagcattgtataattcttctgcattgaatgcagctgcagtatttccccatagtgtgataggcagtgtagaattgctagttttataaaatgattataaatttttggtgatcaatattagtaacttgttacaatagttagtgtggataatgtaaggtaaaggcagtttataacaaaagaaaatttcagtctatactgtagcttaccttgcatcccaaatctgcattgttcttttcaaagtttctgtgtttcttgattttgggcgtagagtgtctgttgcaccaatttcagttatgacacccataatatctggttaaagagaagatatatgtaaacaataaaccactaatgtataagaagtaaacataggaagacaaaaaagggataaggaggttataccaacatagaaagcatttttgtccacaagagacgggacgtcttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaagcagtgagaaaatagcannnnnnnnnnnnnnnnnnnnnnnnnnnnnnnnnnnn

SEQ ID NO: 34958 - DNA, 1579 bp, Oryza sativa
tcactaaacaattaaatcacaaattagatgtgaaggcttcttaaactatcaaatattgcttttttttccttctatcatttcttagaacagaaccaccattgaaatctctagagacaacaaatcgagggagcgcccatacttacttcataggctaaagattttatttcctaccctctccgtttcacaatgtaagtcgttctaacatttctcatattcatattaatgtgaatgaatctagacatatgaatgtgagaaatgctataataacttacattgtgaaacggaggaagtatttatctaacaaagtatgtatactcacatagccacacgcccacaccactctatattttaaacattttaaaatgtgaaaaattgtagatgggtggtcgaccattttgcatccatcccttcacaaggggcatgcagcactatgccttggatgttcatgctcccaagtcccaaatcgcaaaccttttcaccctagctccattcacatacttctcaacattgcatcggaattcggaggaatacacatatacatacataaactttcttttagttttagcccgctaatatggtatacaaaaataagcaaaaggaaaaggacaggatgccggatgcaatgcaccactgtacatacatgccgtgcatgttaaccacagttaaccacaaaaatacatgcacgcatgaatgtctcctactgcctcctgaagccagcactttgtttactgacactgaggcactattacgaaatgataaacgctactactacctattgtcagcaagaggcacctattgcatttcatttcattcccatcatcatctggagctcttcaacacggatctccttgtgctccttgcctcctttcttcctaccaaatgcgccgctaatcagcttcttcttcctctcctgcagctccagcatcctctcctcgatgctatccttcacgatcagcctcaccactttcacctccttggtctgcccgatccggtgcaccctgtccatggcctgctcctccaccccagggttccaccaagggtcgaagaggtacaccgttgatgccgcggtcaggttcacgccggctcccgcagccttcaggctggccagcagcacggtcggagaatcagggccaacgcatccgaattggcggataacctctgacctcttcttcgccgtcatagagccgtcgagtcgtagtatgttaaagcctgctgctttaagtggcccttcaagcaagatcagcatcttcctgaactgagagaaaataacagactttgacaaagggtcttcgctctgtgaacgcctcagtagtttcagcaaggcttgcaccttggaagaaagaggtctatcaagattgactgaggaatcctcatcgggatgtttaatctctggcgcaataaagaggtcttctttgcatagcgagcgccggcatattggacagcgggaactagagctcttgaggattttcatgatgcaagtctggcagtatatgtgcgtgcagctcgttatgacggttttggctggtggagcgagacaaatcggacattcgaagtcatctccatcgtcaaccaatgaggc

SEQ ID NO: 34959 - DNA, 1790 bp, Oryza sativa
aaacatttcagaaagcggaacttttatctgtagaagtataaacagaaatggactagagaaaataattcaaggaatatggggaatatgatttcactggctatgcagcgatttctgcggtttactaatgtatattgatataatcaacagagcagttgacccattgagaaaatgacggataggtagcaagtttgtaaagttaagctgcaagcagcaatgtactgatgcaatttgtcgattcaaatagataaaccaattacactcaacttgctagtttgacactctacagtaagatggaacagttctaagaaaaatcaaaagaaatactactatcatacaatgcttagtgtgcgaaatctctttggcaacaagatggttcaatctaaacagcacagtttaattttgatgagtgtattatggccatattatatcatcacaaaataaatccagaattacaaacaggaaaaaatgccataccttcaagggagctgccactgccaggaagccatgatttcaggtctaatgggcatagtgctatgtcattgcagagctggcggagcctcagaatgaaataaagcacagttgagtaattacgcaaaatcgaatccctgtcaccaaactcccgcagtttgtttttcccttccaattccatctggtcatagtactcacgttcctctgcagaaagctcaatataacaagctaaaacagttttgggcggaatgctgaccaagcttttgctaccactctctgtctctttggttctgcgcagggaaatagcacctaggaggctctgtaataagcagataagaagaatttaattatcagaaattgcaggtatgcacgtgactctttcagatcctttccaacaccattattaaagtactacctaagtatagttactagttcatgtgaattgtgaattacaaaaaaatgacatgtaatgacaaggcaaacaattttccaaacttacctgcaatcgtgccaacccaattccgttattctttctctctaaggggagctggatcaagctctgccagtagctcttgattgagaatggttggaatctcaaaaatgccatgagcgggtaaagatcaaatgagctgttctgaatgggcgtccctgtgaccacccaccgcctctccgcgttcaaagcaatcaccgccttggtttggcgtgctgcagagttcttgatcacatgggcctcatccagaatcacacggaaccattcaatttcctttaccggtgagccctcctgctcaagttcttgccccaaggtgctataagtggtaatcacaatgtcatatttcaacagctctttcttctcttttgtccgctctccatggtacaaatacaccttcaagctaccggttttcgtgtgctcctccagttgtgtcacccaagatgagaacaccgatggcgggcacaccacaagcgttgttcttgactcctcctccaccgcctcctcaaccttcctccttttcgcccctctagccttcttcccacctacattgcgagctttactccttccgatcagcgacaacagcgtgagagtcttccctagccccatatcatcagcgaaaatcccacccttcaacggcggcggtctctcattcgtcttctgatttgtaagaacattcttaaatcccccatcattatcttcctcccagaatggtggaaggtcgcatgactcctcacggtgcaccagccaccccagcgccgccttctggtgctcgaacagttcggacaccaccacatcccgcggcgcctccatgggcgcaatccgagctctccct

SEQ ID NO: 34960 - DNA, 4012 bp, Oryza sativa
  unsure (1)..(4012): unsure at all n locations
gtttgaatcgaatgggggcaagtcaagcggaaggagatgagttcctctcgacttctctggttgggtgggtgaaagattggggaatttttacagttttactgtctcgcagactcgcactctcggccttagttaatactttttatacgtttgaccattcattttattcaaatcttttatacaaaatataaaaatatgtatatcatgtttaaagaatatttgatgataaattaagttaaaatataataaatgataattatgtaaattttttaaataaaacgaatggtcaaacgtataaaaagtcaacggcgtcatacattaaaatatggatgtagtaccatttttctcttctatcgataagttatatcatcctaattatttctaacatttgaaagatagatctataatctaaattgtctcttctttcttctcttttaaaaacatgcaatctcaattacttttaggctcaaaattatatcaaattatttttagttttgtacaattatgtaacttaattttccacagcaacacggggtattcattaaccatttaaccgttcctttgaacagaagggtccgattattagccaccaaaaaatatttatgagtatattcttagagacttaaaagtttgcaccaaaaaaggtactattaaaacattttaaaattaactttaaaattaaattttagaatttgaatattcgaattgattgatttcatatagaacaacgatgaggagtagagctgattctatttggaaaccgcgaagcgagcttcttttatcgttgcttgtacttaaggggagccacctatatactcctattaggttcaaatcctgttgcccacaaagattatgtacataagtgagctttcaacagaattttctatttagtgagaccagagatatgacgcaaacttccatctctttaagtgtgtattaggggggacattctctggtgtgttgttgtatgtgtagtaatgtttgcgcgtctccatgtaactgaaaaaagaaacacatgtatattgaccaagtttaaaaataatttaagcattttttctactttttgataaaaaaattatctagtttttcttgcttttactcggtaaccgcagctcaccacagagaaggggtaaccccattatcgtcaggattgagatcatctgtagttaaaaacacggtgcctttatcactgacatgagaccattccctaacaatctgttatcagggagaagcacaaccgctgaacaaggtgtgccatgaaatcaggctaaaaagcctctttatatagatttccgggcagcacagctagaagaaatctcatatggatcgtaaacgctttgtcaaacttagcaaacaaattcagaagttatgatagatttctacaatacatgctgccgtgcaaagtgcaagtgtaaaatataatgcacagctatctcatgtagcatccagccaagtcgaaccagaatcacagtcacagaggaaagaaaagaagggaaatccagacgagcaaacaagcatcatgtgagaactgagaaactatccacgaaatcgtcaagtcagtcatcatccttgtaggggtattcctctgggacttgcttggtaagcttcactcgcatctcgtaggcatcatccccacgaagcatatcacggacccatgtaacctctgtcttcatagaaacctatatgacaattgcaattcaatcagagtagcacttgtaaaagatttctctcgactgataaacaagtacaaaaatatcatgtgctgataaggggattttggtatgctattatggtgagaaacacgagggcataaccccacataatagagcaggttggttgctgatggcaccttaacagtcatctagtcattatgaactaacttaaatatgtataacaagaccatgagaattctgatacgaaaacgacaacatcctgtcatgcatctatagatcgttcaacatgaagagggaaggagaaggtagaggtagctgaaaaactaaccatttccagtgcacccctaataactccacttagcacattgcagtactgaagaccttggcaagtatcaggaagttcaacaaaatctacaagaggattgtcctccaatacaaagctgcagcttgtaccctcagcatcccaattggtgacagttgcagtcacacccaagaacattttgaatccaagctgttttaaggagagacaaaaaaactttagaccatacacccatatcttaatgcaccaccaagtctgggatatctgaataagggcaataagctctggaaacatgtaataatgttaccgactgataatgttcctattcaatctgaaccatataataacaagtttaacgaaatacctttgcaatgacatcggcagtctccttgaagtcaacacaccttgatacatttgatttggccaggaactcatcaaccaaccgagttccaatgttgtagcccctgcgaagtgaaaataaatatagctgtgacttatttaggaaacagataaaaggcaaaggcagatggtagtagtaaattatgaaaaaatgcagccagcaagccatagatattgattactaaataagaatcccaatattcgccagataaccacttgatttattatctactacttcaaagtcaagattcagttaatatcatccttacatatggagatattaattgtcgtggcacactaaccccattagtgcttaactaagtaaagaagttccaaaactggaatataataaatttgtacatattatttccccacattggaccatgacacatgaaagtgttgtgaatataaggtgccgtgagcccgtgaaatgtcatatcaaaatgatcaattaccattttgtcgcagtgtaaaatctgcactaaattggaaagtcagattatccaggtataaggttgaacctctaaatcccaaatcgctgtaatacaccttcatgaagaagtttactaaaagttacctttacaaatacttcaatcattcagactacctgaacgttacttagtttgctcaaaattccatagcaaagtctacatagatcctcttactgaggccattgcagctgcttcactgtaatttgaggggtggcaaaaagtgaatatttccgaattcctactcctataacacgatcggtccaaagtacccacgaaactccctaaaattgaaccagaaaattagacaccgaggaagagaagaaccacacatacatctgatcaagctgcttgttgacctcctcgacctcctccagatccgtgagcagctgcctcacgatggccccatacgtgagcgtgaacagctccgcgttctgcgagcaaaacgaagcagatcagggcccagatccagtgggggtttctgactccctgtgaagcaaacagggggggaggaggggcgggaacttacgacgcgctcgacgctgccgaagagagcgtccccggacttgggccccgtgagcggcggcatctcccggatcgcgcggcgcctctcgccggcggcgaccggagctcgtcggcggcggtggtggtgatgcggaggagagagagagagagagatcgggggagaggccacgtcgcgagaacggcaagtctataggtgcgatggctcacccgcctatgggcctcgtagaccgctagttgggccgaaacgtaatcgcgggctcacatgcggcccatattatctgggcccgaatgtattgcggcctacgtgtggggccgtacttattgggccaaaagggtaatgctggccacgtgaggcccattattgttggggccgaaggcatgggcgtagccgcgtagatacaggcaaaatcaatcgttcgtactattcataatgttttgcaggtgatgtctcttcaaccatactcccagtcccataaaaaaatgaacgggacattattacaacaaatctgaatatatgtatatctaaagtgtttcattcatttctatgtttgttttttatggggcggagggagtaagnnnnnnnnnnnnnnnnnnnnnnnnnnnnnnnnnnn

SEQ ID NO: 34961 - DNA, 3193 bp, Oryza sativa
ctacactattaatatatggtcccacctatcatacacacactgcgtcttggagttcgtgctacagctggctacaaatctgtagcccactacccttctctctcctcagttatctccttaaaatatatttgcagctggcttatagcctgttattgtacctgctctaatcggcctcctcccactttttcatgcagtggttcgtttccctgtaaaaagatcaatttatacagcactgtactaccactcctaattactcctatctaacaccatatttagacactaaactattactgcaacgaatataaattcattacactcgatattgtttaattgtattagtatattttaaaatggatgaagtataataatatagtactgaaatatactgtactggtattccagcatttttgcatctggttttgccttgatcaatggtcactatttcgttttcttttttcttttggtcaaagcagagtactagcattgctttgcttctcggatagttggatgtcatgtttgacagactgcttctacagatcttttttaaccttaggcgtccattactgtgtggtgagcagaagatgcacgaagtcaaaccgcatgaaaaaaaaaactaaccaaatccatgtatatatgcaaagatattcacggtggtattaatcctaattatcgtactactaatagtacattttgcatccccgcaaaaaaaaataatagtacattttgcagttggaatatactacaagtataattgaacttgtttgctgttcggcaaacgggggtccctcgtacaaactggaccaactaaaattggatgatattaacgtcctctgatcctaaccaactcgatcatgatttattcctctccaaatatacgaaattaaatgccgcatttatgcgagaatggacattgaaattgttatgaaatgaattagctccactaaaataatacatgtgctctctcacctgttattttctttttcagtagattccttttcacaaattagagacaaataatctagtattgaaatgttggcgggaaccaatagcatatgtaacttattgtgtagaaaaggatttgtcttgaatgtttagacgccatttgatcacacaccacaagttcttttttctctttaaaaagacttactagattttatctgaaaggtgatgagaaatcatcgtagtatacgatcactactccataaaaacggtaagtaagataaatcaatcaaacacacctgacatctcatacttaattatcatcaatattgatcggtaactctccgagagcaataattcctagctaatttggtgtacgaacaacaactaattagctgatatatagcaaatttcaacaagtggtaaaaggcacatcaatttttttatatctcaaaaaggtgttatcacactacaatcactactccataaaaaaggcaagataaatcaatcgagcgcttcatacttatcatcaatgactatctctgataaataactcactgagtacgtgaatttctaatttgctacggagacaacaactagccaagtaatagccgatatgtagcaaattccgataagtggtaaagttgtgcactaagaagaaagtagcaaatatattctatttatgtaactacatcgtttcttctcgattttatctcaaacaggtaatgagaaattaccatagtacaatcactaatcacgaaaaagacaagtatgagaaaccaatcaaacacatccagcgtcttatacttatcatcaatgactatcttcgaccgttaactctctttcaacaaaaattcctaatttgcaacacagacagcaactagccaaaacaatacccgatatgtagcggattccgacaagtggtaaagttacgcactaacgagaaagtaaagcaaatatattccatttacatagctacattgttccttctcaatctctccctctctcccctacagttcccctcacttacaccagtggtttccccacaacacaagcagttcaaactccaataatccgtgtgtgcccatagcaatttcgtttgtaggctaagctcaagttagagcaatgggccttggcggcgcgagaagtctcagcgattggcttaatttcaagttagtctaaaccaaaagatctatcttgtgcgtgtgtagcttatttcttttgtacagttattctttctatattcaatgaaattagcggctcaccgattcgcttaaaaaaaatagctagagcaagtaagaaaaacacattcccataccggcacggtaaattgctacggccacacgggaggtgatacagctgatcggctggagcaaagcaggatgagattgcggctcgtaatctgcgagcaatcgcaagttcgcaaccaccaccaccacaatctctctctctcggttggcaatttggcgtgtcccctctttctctttctctctcctctacctctcggcgtggtggtggtgagcgagagggattgggatagataggcacgcacagggtaggggggacgacgagacgagggatcaatcagaatttagtcacgcaccccaggaacaccaagaaaaagaaaaggaaaaaccttttctttctttcttcactttggttgcgttgcgtctccaatccagcgtgcgttgagtagatagatggtaatgccgcccacgaatccgtggcgagttcttgcgtcgcagagtggcaatctgtaagaagttctctgggggtttgttttttttttttttaacggaagaacagaatcaaatcgaatcgaaactaaagagaacgtaaattaatctgtggtttcttggcggcggatcgatcggcggcgatcggccggcgatggcgccgccgtcgatggattactggctcggcttcttccgcggcgccggggacagcatcttcgacgccatcgacgcggccatcgccgtcgcggcgtccgaccaccccgccgcgctccggtcgaggcgggacgccatcgccgagcgcctctacacggcgcacctggtccccggcgcgccgccggcggggccccccgcgggcggaggcgccgccgacgccgacgcgccgacggcccagctcctcctccaccccgagggcgccgccagcgtccctagcctctgtagctccgaccgcgccgaggtcatcaccgacgacggcgccgtccctcgccgcgacgactaccccgtcgccgccgagaccgagcgca

SEQ ID NO: 34962 - DNA, 3277 bp, Oryza sativa
  unsure (1)..(3277): unsure at all n locations
nnnnnnnnnnnnnnnnnnnnnnnnnnnnnnnnnnnnnnnnnnnnnnnnnnnnnnntttgcgaatcgaatgcagaggttggaagcgcatagtcgatgagtggatgagcagccgcgacgccattgtaggtaggaagcaagcaagaacagttcatcgtttctaagtttcaacctctgtatcatgatttagtagagaattaagcattctgcaatgatatgatacacagatcatactcctcaatccatgcatccctctggcttggagcaggatgaacgggggctctcttctccttccatggatgagggcgctctcttcgctacgccgagcacttccatccgcctatctgaggtaattggaattgtcggcacatccatccgaaatcatatctggttggtatgatctgacacagctccctctgagttttcctcaggaaaaccaaggttccaagttcttcgatggtatggatgatgatggaagtgagtgatcagacccttgttcaatatttttttgtgatggttgttggcttcttagctggtgtttgacatcttgattgttttgtggattatctgtagacacgaggagcaatggcggcagggataatggccggctgtatacaaggaatcaagaaccagctagaaggccgctgccgccaatggcccagcaatatgatccagaccagagctggaagcaagaacaatctgcgatgaggcagtcgagaccacaggaactgagcaatgggcagacgagagagcaattcatcgcggcgatgcttgcaaggccctcaaacccagagtccggtcctgggcgacctcaaccgaggactaagcagcatcaagatgcctcgccagctcaaggcagatcgcaacctatgccatctgatgtgagcatattgctttatcgacaaaatatacatgcttatttgattgatgcaaatgcttgtttgaggtcttaattctttgccatggctgtagaaatcggcgagccatcacgatgaaaattcagttcgggcaaagctagaactcgcgaagaatgcaaagcttgaactcacgaatagtgcaaagctagaggtgacaaagagaaaacttcaggaaggctaccaagaatttgataacggtatgtgttccgccatgaaattgggtctattatcacttgttgcaacatcaactggatcatggaatttgtttacttgaaccacaatatcttgtcctctgtttggaatattatagtactactactattttttgctgatcagtaaatttcattgatttgagtttctatatgcgacgagtcatggttatatttttgtgtaaatgcagcaaagaagcagagaactatacaaatggtggatccacaaaatttgccgaaacaagcgaaccggaattggcagcctaatggcaggccgaggaataacagcaacttcaacaacaaccggaattggtcaagatgaggcaccaattccatcatccagcaccaagggatcatagactcccatctcccaattccatccaaatttttcttgcttttttcggctaaagttagtccagccaagtacataaacagcaataaggctttccttcaaaacttgcttccagtgccacacacacacaccacaaacacttcttgagagctgtgttgctggtttgcactctcttttaaccttttgatcacgatggctggtttttttttcctagtggtttgtcaaaaaaacttgtaaagatagtgctactgccaatccgagatgagtttctgcaataccgatcctgatcttgagcccctaaatttgctgtttgtgttggtgtttcctcggttgaaatgcaaattgctttctaccctgccatcggaatgaggatgtttgctgcctactttgggtctctgcgccctgcttttcaggctcaaagaccttttggggtctgtcttttcgctgaattcagcgtagcttgtcccccctgcgaagacttggactggaacgccaacgtatcagactgtacatagcctcaagtgaaagtttcttggtaaattcaaaattctagttgatgccaggaaaaattaactatgaagttacctatggtcaagatcacactgtcaaaaatagtaggaccatactctccgtaagtctttttgtcttgttaaaaataaaaaataatttattgatttttttaatacatttgttcatagcgatttaaaagtcaatactgaaaacaaattacgttgaaaatatcttaaaattaacttcgaaaattcaaattttagcttttgctttgtcttattaggccaattgatgcggccctaaaatggttgaatatccaaaagattttgtaatgaccattcgagggcacttccttcgtactcgtaaaggaagtcgtctagaacaatatttaagctaaactttgggaatataaatcatgaataactattaggttgtcgagtttgaaaatataaaatttatataaatagatttgtcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgaccccccaaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttcccagctatgatcatctgtgttcactatctctgtgtcccatgtgtggccatggaaaaaaatgcatcatcttatacttatcagctaaaatt

SEQ ID NO: 34963 - DNA, 3844 bp, Oryza sativa
aacgagttggtgaattataggatagcagcaacaataagaacaacatcaataacaacagcaagaatttgtacacactccgagacggttacatgggtgggggtacaaagaatgcaataacttggctaaaccgagcggactcctaagggaagggtgaaagaaactaagcaaagctatgtgtcgtgtaaatgttgaatatttgtttgcaaatagttggattagttcttttgccagttcacgcagatatcatcagcttataagagcagatgcgtaagaaactgctgcggaacaagtcatcacagattatcacagtacaacaagagtgtgtccaccaacgcagagcggaaattggagaacctctggatttctcaacccactcccagcatgctttggtaccaatattgtttactactcctgcatatgttctagctgttgacatggtaaaaagacagctacatggtgtgacagagtttggaaccgtcagggaactggccccaaatatcatttgtctccctggtaatgtctctccccaagcataatcaaggtaagcctgaaaataatctcagggtaatttacattgtatcatcacttctccagtcagctgcactactgctgctgataagatattagatttaaattttagtcatggctaaccagctgcagataacaattaatagagccgaatatccttaatgaaatcggcagagctcctacctttaccccttggaaaaaaaaataaacagggcctggagaatcagagaaacaatggccttggtgtcttttgctatgagaaagtgagagatagaaggtgcggatgccatcctttttgacttggtcggctgcaaatgcaaactgccagcgttacagtgtagtgcagtgtgcagcaccgatgaatttggcgcctttagccaccaactcaacacacattattttgcgtccatcggcatgtgatgcaaggggcccctggctggcacgtctatatcttctgaaattctgatcctttactgtgctatccatgtccacgacgatactcctactattgtttgtgtttatctgagcgagagcgaacatatgctactactaacaccatcttcatattttttttaagataatggaatgaaatatttcgaactttgctcatcataactacagtcaattattataaacgaagagtatagttcaaaataaaattaaacacacccaacaaaataaaagaccaaaccgagataagaagtacacatttattcaagtctatttgtgaatctccatccatagtttgtaaaaagttgcataactgttgtcacaccccaatctgataccgccgtacaacggcacctgataggagcgtgttgtagggaaaacggcgtgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaccagcagcagcagcagcggaaccaacggtctaacacccaacaccacaggcgacggctgggaaccaggacgaaaccctaatattcacttcactttgccttctcttcagggcggaggaactatatatatatatatttatatagagcaagggtgagtactttcgtactcagcaagtcacgagaacttaggtgtttaatgcaagcttggaagagaggtaaggttgttttgcaaatcttttatttgaagacattttgaaatcactaagtgatttatttctttctaagtttgggccgaaaagagacttgcgtctcgattcgactttaagagatgtttttcaacagctcatttggtaatgtaccgacctcccgggtcagatcattacttatcggctcccagagccattccacttgattaatcggctcccagagcctttttcattttctcggactcccagagtccagctgcctagcagcacaacaatccgcttccactcgggaagcctagtctatgatgcccgcagacatcccgaatcacccagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaatacaccgacaccacatgtcgggttttgaaggcttcacaaacccatttcccaagttttcgacaaacaatggtgtatgtgggatatttggtatacgtgctcagagaacacgaataccgaggtaccacaagggtggagcgacaaggaatcagggtagtatgacctacggaaattagtgcgactactgggtaggtccgtcggttttggcacgcaaaccgaggccaagcaagttaagtgtgtgattctaataatgcaagttgcaaacaaaataataatgaattttcaattataggggcaattgatcaaagggtgacttgccttgctcaaggtcttcacgaagcttcacgaatcttcgaggaaacccgcgatcgacgaaaatccgataaccgcaactatacgcaaacaatcgaaaacctaaacaaaggaccaaaagaaagatcctatttagactaattagtagtgccaataaatagatctcaattttacggaattactggaagtggaacggagtcaatcggagttgcgaattaggtgatatgaattttggaagtttaattggagtttctggaataggagaaatggtttatggaatttatagaaataatattctcaagaatattattgacagtcactgacgcgcgggaccaaaggaaatgatttgtggaattttgggaataaggaattgatttatgggacaaaggaaggaaaaaaaaaggatttattaatcctttggataagaaatggaaggagggatgggatttagacttctttgggcggctcgggtacggcccaagggataagcacggcgcggccgagccaatgggccgggcgcgggcgcggggaggcggcccatggccgggcaaggcgcggcccaagcgggcggggcgcgcgggaggagagagggggatgggtccgggtggaccgtatccaccttgcggggtcccgggtggggcccgcttgtcagtggcgcggctctccgtgggagcggcgcatgagggcagcgctagggtttcgggtgagcgcggttcacgggcgtgcactggatggaccagggatgcggcgggcccacgcgcagccggttggtgcaccgtggaccgcgcgcgagagggggggaggaaggaggcggctgaccggctcggctcggt

SEQ ID NO: 34964 - DNA, 8315 bp, Oryza sativa
ctctacaagtttacctccagctattccaaacataaagtactccaccggtattgatattattgaaattatacccaggacaacacacatcaaaccccaaaagctagcatccttttttagtttgtctgctggctcaaagaaagttttgatggcattggaaatcattactccaaacattgggaaaagcactccatgaactcctgcagccagtgttgctaacaaaagtatcggtacctctggcttgtttagtctagccagtcgtccaataggagctttctgttggacctcaccatcaccaccctgctctgtctgttcccccacagtcgaatcattgccttcaagcaattcaactgagccaggcaagccaaagggaagggctagagaatgcctgctactatttcctgcagaatccctgctaattgatcgcttgaatgacaaacttctacttttagaccttgaatcagatatgtgatggtctaatttcttctcttcttcttcgtgggtttcttgtagcctaatgagttgcgaataaacaccattggggttcattaccaattcatcatggggacctatgcaagtattcgtgtaagaaattgatcactgcagttaaattaagctgaataactcacaatcaatacaaaatgaacagtggcaaggggatcctaaccttgctcaactatctttccttgttgaacaactgatatacaatcagcattcctcactgtggtcaagcgatgagcaaccacaagtgtggttctgtccaccatgatcctgttcagtgcctcttgaactatcctctctgattccacatccaatgcgctagtagcctcatctaacagaaggattttggggtttttaagtattgctctagcaatagcaattctttgcttttgtccccctgagagctgtgcgccacgttgaccaaccattgtatcatagccctggtacaagataagagaaaacattagacccagatctgataacaaaaaaaaaaacttagacatgcaggttaatttattggagttatcacatacatcaggtaatttgtcaataaaatttgctgcattagcaagctcagctgctctcctaatctcttcaattgttgcatcctctttgccgtatgttatattatctttaatggaggtcataaagagcaatggctcttggctgacaagaccaatcttccctcttatccaattaagcctcaagctcttgatgttaatcccatcaatcaaaacctcaccagcctgtggatcatagaatctttcgacaagactaataacagtggacttgccgcttccactctccccaactatagccattgtcgtgccactagaaacatgcaatgaaaatccatcaaatatcagttgctcaggccttgctgggtagctgaagtacacatccttcaattccacatcacccctgatgtcctccaactgtttcccagttatgtcatcaggatcaatctgtggttttctcttgattgttttgaacaatctataagctgcagattgcccttctgcaaaggctgccatacatggggtcgcattccctaaagacctgccacaaggaaatggaaatttttacctccattcgttaaaattaaaatatcataataaattaagaactcacattgccccagtcatgacagcaaacaagatatttatgatgtctcctcctgagtatcctttgctgactaccaacttgccgccataccatatagctaaaccatagctggagaaaaatatgaagaaaacggagcccatgccaaaaccgttcgtaagtccttcctcaacagctgccttgtatgccttgtttatgagtttattgtacgatgcaacagcctgcttttcaccgttgaaggaaacaacctgttttcagataggaaccacacaaaactggtgagttcatgccatttcagatggaggtagagggagtgaaattattctaacaaatgaacttacagtttttatggctccaattgtctgttcaacaacattcgctgcatcgctatatgatgcttgacccttgctagagatttttgctagcatcttcgatacagctccaccagcaatgacaacaggagggatgcaggccaacatgacaagggatagaagccaacctttcacaaatgctacaacgaaaccaccggcgaaggtagccacaagttgtagaaacttgccaacctgcagaatttttcatcacaacaggaaaaaaatatttatgttgtagtatgtcagttagtgctattggtcttcatataataaagatatatgttgacaattctgttgaacttgagagaaggtgattaccttctcaccaatggcatcctgaactaacacagtgtcaccggacattcttgaaactatctgcccagttgtcatttctacatcaaagaatgctatatcctgtctcaggacagatttgaggtatagagatcgaatgcgtgtcgcctgccgttctccagtcattgtccagcacgccacctctgcacagacatcaaattggcattggttatttacagtgatgtgagcgccatatgccttgaacatgtagaattatgtttcattttttctaatcagtttagtttgctaaatcaaaagtagtagtaccgttttttaatgtgcagtttgacatatgcttattcattttccactttcgaaagggaaaagtaaaacatgtgtgctctgtatctcctattcaatagtaagaggataggtttaacaggaatattcgattcacaatcttaaaaattatgtgagtgaccttttgtggactgtgatagcattaataaagagaattgtttgaactttgaactcatattaccaaaagtcaaactttgactctgcattgatggcagcgtgcaggtttgaaacgccaatattggcaaaaggatgatatggagtagtagtattagataagttgccagcttgctaagcatatgctctcaccgttctcttaatcatgactaatttactaatgataatccataactagcagcaacagttgacgcatgtgcagtgtgccaagtgcatacacataccaacagaacagtaaattctattacttacgaagaaatgaaacaaccgctgtcgcgatgcccaggtagacaaagttgagaaccgcctagagaaattgaaagaaaatgacaccaaagtgaaaagtgtattcatgtcatcactacctttaataacgtgtaaccgtaaaggtaacgaattcataatgcactaggagtagttaactgcaagctgaatgttaatggaaagaagttttctgtaatatgacacactggcggtgataaaaaacggcgaaccgacaaatttgacagtgtgtatcatcaccactcattcaaaaaagattaaaaaatataacgtgtcgatctctgacctcttgataggaaaaagattccaaccattacattgattgatactctgttatcctatatgacatttctttactggaaatgggaaggactttgatccttcttgctccaaaaaaaaaattgatactctgataactcttctgttgtctcttgttggaatattaacttattattacaagttgcaatcatttggcataacatatttactttattgaacaattactacaaaaacatagctaactgaaagctgcacactgtaaagtttgccggtataaaagccagctcccaggtgaacgagaaacaagctacaataccactgaatattttgggagaaaaataaacaaattcattatccttaataaatagacgtgagaatctttaaaaaaaagaagagagagattgagagaagaaatatagaaaagtactatcccagaaaataaaatgcaacaatatttagttgaaaaaagaatatcgcggtacgagaggctgtttggtttaagttccatagatcgaagaattatcccaacttgtcggaagaattgattccacaagcgaatactctctttttttcctttctcaagaagcaaagcaaaggaaagaaatgagtcgagaagacgactgaaaaaaaaaaaccccgaaggcaaaatcgacgaggagttaataccgccaaaagtcaagatacgagcacatcgttctccgagctccaaaacatcaacaaatttcaccggagctttctcaagatcaaacccacatctaaaaagacaaagaccgcaaaatgaatgaaatgaaagggagtggaattgattgaattggccaaagctcgatcgagcacgccgctaatccacggcgcgcgtttccttccacatcgacggcgagaggattaatcgaccggaaagttagccgcgcgcggatcacggccggacgggcggcgctagctgtggcggggaggcaggcaggctcacctggttgacgcggtggaggacgtcgccgttggtggcctcgccgaaggcgttgatgacctggccgaagatgacggtcatgagcggctgcgacaccccgttggcgagcgccgccaccgtgccgaccgccatcagcagcaggtccgtgccgtcggcgtaccggaacagccccgtgaacgacaccttcttcccggcgtcgccgtcctcctccttcttcttgtcctcgccgtccctgccgttcttcgccttcttctccttgccatccctgccgccgttcgccgccgcgtccattgctggcagctttactgtgtgtacaagatagatacgcccggctcgatcgcctcggcctgcggcgccggattcctgagtcgtagctcgcggctcaacgcctcaaccctttcgcgggtatttattgggttggccacatacacacaccgccgcacgcagggagagatgagacggagaggagggtttggacgacgaatagaaaatatcactgcgccagctatttccaaatggtctatggagaaaatgttcggaaggatcattacaaaaaaaatggggacaaaaaggtgtagtcctgtgcttttttttttgggaagcgtttttgtttctttgtacttacattttttttatataggcgaaggtcatagatgcatgttactccactaagatggggtatgaaaattcagaagggagttatgtggatgattaatatatgatacagctggtagtagtatatattgcttagagctggctagaacagggatttcctctagatgctattgtagtggaaagagttttttttttgtgaggaataagtgaagatcgtagcctaataaggtattatagatgttgatcatgttattctacaaatttagttaaactttaattgtatatttgtcctaaaatacgaatgattacattgacaaattcacttgtgttttggaatatatgcagtcagtttaattaggacaaattaatacttcgtatgtcccattttaaatgcagccatgattttccgtgcacaactttaaatgcctgtcttatttgaaaaatttttgaaaaaaattaaaaacataagtaacgaataaaatattattcatgttttatcatctcataacaataaaaatactaattgtaaaaaaatttcaaataagacggacgatcaaagttgagcgtgaaaacttatgtttgcacttaaaatgggacggaggagtataaaacacatgccttttatattggcatactccttctatcacaaaataaattagtttttcttatgaatctagacaagttctaatctagacattaagatttgatttattttagatgaagggtgtagatgtcatcggttagaacaacttgtatccatggcttcactcaaatacttgagcttagttctaatgtgcaagttgctttagcttttcaccgtcacttaaaacaagacgagggatagggtataattaattaagtattttttattataaatgaataaaatagatttatttaatttttaaagaaattttcactataaaaaaagtgatatgagacgtcgattaatataaaaccggcacatgtgatctttctccccatccttctaatctctcatatgagtctaaactaaaatcggcacttacaaacacattattggtgttgtttaataaaaaaccgccaaatataagtttcagtgcatgttttttcaatcacacaatttaactggtacctatgaaatagccaccggtgcgttttttttattaaactgacacatatcgagaaaacaacgttgagccgaacggggtggaagaaataatccgctgagctcgagcctctctcccattccacatgtcccatgtttattattttacttcgatctactctccgtctctttcccacaccctccatatcctctctgtctctataccaccgccacccgcagcccctcctactcccctctccaccggtgcggcatcgtggcatcctccccctcaacggtggtgactccggcgggctgctctgctagctgggacaacgatggctcccatgggcagatctgtcggtggcgacggcggagactgtgcagatccataggctgcggcggcggtggctcccgcgctcggatttgtcagttgcaacgacgatggctcccgtggccggatccattggttcagatgacgacaagcatgggctcccatgagcggatccggcgatgtctcccgcagatggatccagtggcgtcgatggctctcgcacatggaggcagcaatggcaacctcggcgccccaatgagcgatggcggcaggcggagttctcgtctgcagtgagtgactgcacctcctttgatttggtttttgatgaatgcttgattctataatgtgcaattgttgatggatatccggttgaaatttttgtgatttgtgctatgtgattttgtgcaggggatgttgttgttagatggattgatgggtgatttgtgttttgtgatttggaggatgttgttggataaatcgatggtggtatgggggtgatagggagcaacttaatttaagccgatgcatcgagccagcgttttttttttccgcattcgtggaacctcaaaggtgctagtttctaaactgaactttggttactcctcatcagtgccatttgaggggtttcggttgggaaatccaatacctatgtgatgttcgcaatcagcacctattaggttttagtgtgtgataactgatatacaaaataaaaaagaaacatctattaggttttagtgtgtgataactgatatacaaaataaaaaagaaacatcgtaaaactattactctctccatttcaaaatataatatttttcattggatgagatacatcttaggtagtgttcttttctcctaaaggtgaagatgaagattaagtttttttacgcaaaacgaggtggtattaacgtatgattgattgagttttaattattacaaagctgaaaatagattgatatgatattttagagcaacttttatatagaaagttttcgcacgaaatacaccgtttagcagtttgaaaagcgtgccacgaaaatattaatcttcatccaacacttgttagtactacgaatctagacatattgcctgtctaaattcatagtattagcatgtatcccatccaacagtggcggatccagaaaattgattcgttggtgtcataacgtgtctatctgtgtctagtatactaattatgcttagattatggtgttataatgtatgaataaaattgattcgttggtgtcataacgtgtctatctgtgtcatagtatactaattatgcttagattatggtgttataatgtatgaataagtagttttgctataggtttttgtaacgacccgcctctcccaggccgggctaaattcatagtattagcatgtatctgtgtctagtatactaattatgcttagattatggtgttataatgtatgaataaaattgattcgttggtgtcataacgtgtcaatctgtgtcatagtatactaattatgcttagattatggtgttataatgtatgaataagtagttttgctataggtttttgtaacgacccgcctctcccaggccgggcccacttacatctggcagctttcattggtcataaactaccctcacagaccaacacatgtcttttctgcacactttgtcctcactcgtgtgcacccgggaagaatttcctggtcggtcacccatcccaaattgctccaggccaagcacgcttaaccctggagttctttggagattggcttccggaaaagaagttgtaacttgttgatatattaatcctattaagccctaggccgggatgttacagttttgccaaaagtcatcggtgtcgcctgacacaggcccttataatgtagatccgtccctgccatctaaccaaaacttttttatattctaagacggatggagtattgtataagctcattcacataagcata

SEQ ID NO: 34965 - DNA, 6851 bp, Oryza sativa
tccctccctccacccctccacctggtttacttttttggcaccgcattacttttctattttagtaaatttatacacctaaagtttatacacctcaagtttacacatctaaagtttagagaccaaaagtttataagtcaaaagtttatatatccgatttaaatttgaattcaaatatttttttatatatagtatttctatacatctaaagtttatacacctaaagtttataagtcaaaagtttatatacccatttcaaatttgaatttgaattatatctgattcaaatttgaattttgaatttgaattcaaatattttctatatatagtatttctatacatctaaagtttatacacctaaagttttaaagtttatagatccaaagtttataagtcaaaagtttacatacccgattcaaatttgaatttgaattatatctgattcaaatttgaatttgaattcaaatattttccatatatagtattcctatacatctaaagtttataagtcaaaagtttacatacccgattcaaatttgaattcaaattttttatatatagtatttctatacataaaattttctaacttttatttttttaaaaaaaattgtgtgtactgtggtagaaagagaagaagggggaagaggaagggggagaagagggaggagtatagggggaggggggcaaaccgattgctggcgatcgcccatgagcctccccaacgtaattggggttatttaggttttatatccgtcgtcttcctgaccccgcggataaaaggggccaggggttcgtactattagccgtgctcctttcatattaccagcaacatctcgtggcagcctatcaggttaattagctgcacacgacgtcaggggtgacgtacgcgtccgttggagaaagtccagtcaatcgcgccgatcgggaagggaacctctcgcgatcgagttgtatatgtacgtgatgtcaacgaggagagttgttaatgtcagcgaggagatttgttaactactgcaaaaagttttcgcggacgatgttttacgcacgttggtggccagccgcttttctggtctacgcgggtctccctagctgctccctcgctaggacacttttcgtgctaaaataaatatattttttaccatctcgctaatatgaaaccggaaaaacaaaaatacctttattttattaataataaatcataatataactattttaatttatttacttccaatataattattctctacttttataaactctaatttaaaagaacactttaaaaataaacttattacagcgcggaggggtgcatagggagtatgacctcagatggtgggacagcgggtcgcgaatagccggtagacaagacaagagaaaacctgtgatgatacacaccacgacgtgtgtggtgtcgtgtcgatggaccgtagttagattcgacccgctaccgtggaggggtaaccggatgagtgctattaacttgaaaagttagctacttcatccgtgttataatatagtaatttagaatttaataggatacattctaattataagactataaatcggatagaacttctgtctaaatttatagtttaggatgtgttatattcgattctaggttgctatatccacatcagattaattagaatacacgattcggttactatagatggtttgatcggtaaccattgtggtatttatattgtctgccttttttgttacagcacatgacgacctaccagtaattaacagagagctatgtacaaacacgctacgcgcgcgaccgagactgctgacactgtatttaattattaatctggacgctcgggagagttatggacatttcgaatcctattttagttgatgcacactaatttctaaaactcagtatgtaagtatactacactatcatacactagtaattattatataaagtattttaaatcacatgcaagtgtgccacatcattacctaatagcaattattatctaaagtattttaaatatcatgcaaatataatatatcatttacaaatttgttgtatttttaaaactcaatatgtaatcaatgtcaaataattatctccatattattttcatgttatttaagtatgtacatatatcattaatataatgtataatatatattcatccacgtatctcgtaggaaagcacgatgtatcatctagtcagtgagaagccaatcgccagctattatcgatcgatgtcaagctgtgaacccgcgtctacagaggcaagcagagatagcggccgcacaccattaattctgtatattcgcacgttcgtaggcccacgatctcaatcagagtaggacggcttacccgtacttacctaattgccgatatggtgatatatatggtccgtccattctacttaatcaaatccacgtcattatatgcattaggctgtgtttagtttcacgctaaaattagatatttaaataaattagaacgatgtaacgaaaaagttaaaagtttgtataggtagaaaagttcgatgtgaaaaaaaaattgaaagtttgaagaaaaaaattggaatctaaatatagccttaaacttttgtgtttccatgcctggccatggcttagcatggatgtagtatatatcaacctaattaataatcaatagttccacattcccacgcacttaatcagtactatagtagaaacgctcgtcaaatttaacagaaaacatgattgcacgtaagcggtattttcaatttttctttaaaaaaacttagcgagtttgtataatctctaccatctaccgtcaatttcttggacacttatccagttgtatatatgcatgtgcaaatcagtcgcacttctgtcaaaaaaaaaaaacctaaaagggatgtgatcttttttagaacaacgaatttaaacaaaaggctatctaaattcattgtactaagagatatcacatcctcggctaggttatgtttttttaacggagggagtatggtcttgtggacagaagcgcctttattatgataatgaaattatgggtgtataacttaatataaatatactactaggatttgaattctattgtacacaattaaactattttacgcttatgagcatatccctatgattaagacaaattgggaagttgcttctattatcttaaaacattaagattacatgatctagaaatataaaatgagggtaagagcgatgcagcttggcgccgcgcactcgtgaacctactaaccgcacatgcttcagtttacaggggtggtcattctcatttggtaaactaacctcttgtcatttagtcatcaggctgtacctgcagaggagtggaaatgaacatatactcgcaatgcatctaataagtgaagctagctagctagcacagctgtacaaggggctggatggctagctctaaaagtcctatgacgaatttagagcacgaaacaggccggattaatcatgccccgaattattgtcgtggattatctctataaattatgaaaaattaaatatttttttaaaaaacttaatactagtagtttataaaagcaagttgtataataccctctttgtttaggcttaggcttattggcctaaacttttaagtcagcttattggcttatatgatttataagccagtggatttaatgtcctaagtttaatggtagagtcatatatctatctcatataagccaaaaaaagcttctccaatctagcttttggcttaatagtgttagagtggcttatggcttaaaaaaaccaaatgaaaaagctgcttgtttattttggcttaaacttttcgacttataagttggcttataaacctaaacaaagagggcctaagtaatacggtagaagaaagtctttggagaaatatattttaaagatgtgaatcaaataatctgcagtaataattaatttgatgacgtagcaaggagctgaaaccaacgggcttaatttgttcaaaataatttgatgctcgtactcccagaacaagtatacgtccctcacaattggatccccgatcgaagtcataaactccatctgtactaaaatatgagattttcagcatagtgtcaagttaggtatttaatttttactttaactactaatagcaaaacaaaaataaaaagggtcaattgtgtaaaattgatatgactagatttatcataaacaaactattataatatgcaactctttttatttacaacattttatttttatatatattgttggtcaaaatagaatctcgaagactatatcaaagtcgaaaaatacttatattttaaggcggagggagtatacaatacccctgtgcagctacagtattagagtagaacactagtatacatacgtgcaattaagaaacttgtgtgtagtacatactctctctgtccctaaatataagagattttggttagatgtgatttatcctagtgcaatgaatctggactatataaggtattttggttagatgtgatttatcctagtacaataaatctggacatattttatatataaattcgttgtactcgcatccaaccaaaatgggagtagattttatacgactggtcaatagtcaaacccagagcttgcaccgcaaggaaaagaaagtgtctttctgatccagatgattacgtgagtacacatgccgcttgacaggtacgtatagctagcaatatagctaattaggtgtcaacagataaatgtgcgctttgaccacccaatccttgcacgtatattttctgaagggcatgcatatgatcgagcattctgcagtacatacgtgatgctcttgtatatattaagatagtggagaagatatactacctccatcctaaaatgttgacgccgttgactttttaaaaaatatttgaccgttcgttttatttaaaaaatttaagtaattgttaattctttttctatcatttgatttattgttaaatatatttttatgtatacatatagttttacacatatcacaaaagtttttgaataaaacgaatggccaaacatgtttaaaaaagtcaacggtgtcaaacatttagggaaggagggagtatatgatagcatgacagtgagaggaactttccgttcaaaaaaaaagacagtgagaggaactatattaccgtacaacagcacaattcttgtccggacaactaacgcagctaaaatagtttcaatgctgcacgcataccttgtctcactgattggttgcctttcactacagggcatgcaacttttcccgacggcgaaatcaccgttggtgatccaaaaaactgtagggaatgctgcagtcgaaagtttacgatcgggaattgttggtcgagaatgagtgtgtcggggatttgtaatcgacagtgatcgattctatgtatcatcgacaatttacatttccaatcgaatattgtggaccataagcccgtcggggttttttggacctccgttatatcctccgtaacggattttaggattcccaacaaattataaactcgtgacaatatttgttaaactaatggaattgataacactattagcagtttatatcacattatcacatcaacccaatattaaccacaaatgattgtaaccttgtcttatgggaagcattttttttggcagttcttggtaacatagtttaacagtaaatatcaacaagattcatgaccaaacaagtaccctaagttttccactacttcatcagtataataaaattgaccaaacatttggcttaatacaaatagttttcttaatgaatctcaagctaattaaccagttcgaatgaacgccaagaatatgacttcaactatgcataggatcatcaccatagttctcctatatcatcatcatgatcagcaccagtctttaacatcatcatgagcagaaccaccatcttcatgatttgattcacatgcttttcttttttaggaactttgatgcaccatacattaagcttgatgacggctgcccattggtagacaaacttgtcaatttcgacatgtgtgaacagcaagaaatatgttttccttacataattcatgattgtttttacataatctctattttataagatatttttttaacttcttttgtggtactcctacctaatactctcattactccctgctccccccccgggcggaggagagtaagtgcaggtttaagagtgtgctgtagacaaagtacaagcacatgtggaggaaagagataataaaaagtggaaaataatattggctcttatgcaagaggtagctatacccatgctgcaagataaatgcattagttatatactctcttaatttgtttcatattataagtcgttttattttttctaagacaaactttaaaatattttgataaaatgtttattttgtgttttattatatttttctataaaattagttaaacttaaaaaaattgagtagaaaaaaaatgaagtgacttataatattaaatggaagaagcgagagaaagagagagaatagaaaaaaaaagaataaatctctgtagctaatctattatacatgttaggtataatttataactagtagtgttaactttattattaaatttactcgagggcagatgctctctgataaacggtgacggtaaagcatcatctttctcatcattacatgctgtctttaattgctgattttaaggttacaacgcagagataagtttttttatcctccttcaactagttagctacagctctgtcttacgataaacttatctacttagtactccctcctggatttttcacattttggtccttttgaaaaacttatttcgtaaatagacccctgaaaaaatttatcctagaaatggtcctttttggggcgccagagtggctg

SEQ ID NO: 34966 - DNA, 5959 bp, Oryza sativa
gcgccgtcctcctgccaccgtggcgcacgcgaaccgacgtggcaggagaagggcgccagcatggctggcgccgccccagggaggagggcgccagccatgccgcctccattcctgtttctctgtatggagttgcaacggtgtcatttttattttatttttttggatgttttttcacactcaggatcacgatacaaccaaccacaaaaaaaatttaaatacgaactaccacttagctaagtctgaaaatatctagcataccacttagtctactttgcaccttcactaaaattagaccataactcctttagtaaaaccctttgatcaacacgttaaacataatgcactctaccactatatgaaattacttaatataattcaaaatataaccacatgaaatgacatatataagttaaatagtatatagagatgcaattttttatttttatttcatttttttgatatttttttcacacttaggagaacatagtaaccaaccgtataaaaaataaactcaaacggacaaaatatgtgacatatagaattttccaaaactctaccgaaacggacaaaatatgtcatctattaaaataggcgtaactttctcatacggactcggaatcagtcaaataatatatgcacggacatctacagaaaatgttacatccgattctccccggctttggcgatattaaaacctccaaattccgcttgcaagattgtgtttttgaggagagaagtttttcggtggagctttggaaaattccacatgccacatatttcatccgtttgagtttattttttacatggttggttcctgtgagttcctaagtgtgaaaaaaaatatcaaaaaaataaaataaaaataaaaaagttgcacatctctctcctctgcaatagttcggagagagaggagaggagaggaaaaattctacatgtcacatattacgttcatttgagttcaatttttctatggttggttcttgtatgtccctaagcgtgaaaaaaatatcaaacaaataaaacaaaaataaaaaatttcggggggggggcgctagccactctggcgcactccccctagccacctcagcatcgccccgccacgtcggcaggggaacggcgccaaagaggctggcgccgtcctgttgaacgacggcgccagccactctggcgcactccccctagccacctcagcatcgccccgccacgtcggcaggggaacggcgccaaagaggctagcgccgtcctgttgaacgacggcgccagccactctggcgccccaaaaaggaccatttttgggataagtttttctaggggtctatttacgaaataagtttttcaaaaggaccaaaatgtgaaaaatcgtcttctaatattttgatattttgcttgcactgtttgatcacttgttttattattatttttaaatataaaaaacgaaaagttgtgcttaaagtactttgggtaataaagtaagtcacaaataaaataaataataattctattttttaataagacgaatagttaaacagtgcaaataaaatatcaaaatcccttatattaggggacggagggagtacatcatatgtatactattattagtatgaatgtagttaagtttttttttcaagatttatagtagtaatgtgttattattttcgtaatagatgaagtgacaacggcgcgtgtgtgcgaacactggcatttcgaatgagttggaaaacgacgacttcgattagtagttgatcgaaaaagtaaatcaagtcgcttgttcggattggtgtctcgtcctgataatgatccgcgatctgcttggagttcaaacacacgcacgtgcgctgcgctgccgtccgcgcgctggattgctgggaacaaaacgctaccgagcgtaccgcgcgctgtggcgttctgcctctgcctgcctccatgtacaccacgcgatttcctgcacggatggcatcaaatgtatctatccgtgacacgtagcttagctattatgtaaaagcatttaattttacatttttttgcggggaatttaattttatatttttataactctatttaattttatagttgagatagtgttctgagaaggacataaacaataaataatattttcattcttacatattttttaaatataatacataataatcctgtctttgttttaacataggctactgcctcttattataaagttttttttctctaagttgaaccaaatatgaattaagcaacaaaaatatgatgacaaaacaggtttgaagcacatgaacacaaaagaagaaatacatattattgcagcctaccagtaaatctccatactaatttaaagttgatgaatattgacatgatcggtgacttcgaattgttgcatgcaagttaaattacatatttattcacgtcgcaccttttgtagttgggttcgaaaccgaaaccagaatgttgccgtgaaaacaaaatatctttatcatgaacttttgatatatgctttattgctctaatttagcaaataatttacctctacagctccaagtttttttttagctttagaaattattggagttggagctgctgatatattagagttattaggatgagacattttattcatattttacactcctccttttcccctttaacttggactactaattaagatccattaacggctaatattagtgtattgcctttttcgcttagctatcacacgcatgccaaacatgaccataatgcacattatgggctccaagaaaaccatggagcgcaaagtcatagagagaatgggagaggaattaatgccgtacattgtacgccttttttcttttatattatatgcggcgttacactacagtcatgcgatccatcaagtcagaagtcgccttctgttccgttaggcaggcagaggcctccttcccctttttgattttcttggcgtccaaggtgctctgcttaataattagtctcaaattaatggcctgtcaattggtcaaacctcctgttattttatatacttcgtcgtaaccaagagccagcagctcatggacttttcgtattatttccaccttctgtttttgatctgagtatcagagtatcatgaagcagatatgatgcttggtctccaaggctcatgcttcgcttccaaggcggcgccagtacggaggtccacttgatatgatgattaaactaagaggccatccatgtggggctgtgggcatgcaactagatcttaatttaccatcatccaagatttgcctttttttagtttcaatactccgtatgtactccctccgtctcataatataaaagattttgagtttttgcttccactgtttgaccattcgtcttattcaaaaaatttgtacaaatatagaaaacgaaaagttatgcttaaagtattttggataataaagtaagtcaaaaaaacaaaaaataattccaaaattttttgaataagacgagtggtcaaacagtgcaagtaaaaacttaaaatcccttatattatgggacggagggagtagctaagatcgattaacctatataaacataacatcaaatttctgctaagctttcacacatgacatgtatcatcactactctctgtcccattctaagtgcagccatgatttttcgtacacaactttgaccgtccgtattatttaaatttttttaaaaaaaattaagaaacataagtcacatataaaatactaggtttatgagttcaaatcagtaggatattatgacatgtatggattgaatctgatctctaagctcaattaggcacgtgctcgataaagatagcctgtttaaattgatatggacacttaatcagcctctctctctttttttctttttttttttgctctaaagaacttgacgacgttgctattatacagcatgggtttggttgataatcctcgcagaaaagttaaggacaggatcacatcgattgcacaatccaccaatccaatgcaatctcatggggtttatctccgattaaaaatgagctgaatcgtacggttttgactcgcccattgattgccgaaacgaagggcgtcgcagttaatttgtggtctcgtggatggccggaaagagctctttcttaattactaatccctccgtcctaaaatatagctatttctagcacagtgtcttatcctaaaatgaagttatttcttcatctacctcctcctctcaaccaatcacaaccattctttttcacctactttctcttttcaaccaatcacacacttcctccaatcattctcacctactttcttaatacctgtgccaaccttaaaaatagctttattttgggacggaggaagtagtaattcttgtcacttcctggtgatgctatcttctagaagagagtactgtatgtagctgtctcgtgtccgtgatgcgactgtgcaagtggcgtaatcgatggtgcaagtggagtaattgggaacacgaaacgcacgtcacatgctacgtacaagctgccgttgagctctgcacagcctagcagtttaatttaaaacgttgatacggttcatgagatgccatgttctcgtgtttatcgtttagctatccctgtcttctgcatagagacgcgggcacaagcgatactcaatcatacaaaacaggagtggtacagaaaggcacgaaacttagcgtaaaacaaaactggaacaacaactcaccaacaccagcaaattgaacgaatagattgctccatctgccttcccgcttaatcagcgtagcaggcatgcgggagacacgccctccaaatcactaaaagcagcactaataatcggcagtttatgaatccgaatgaacatttcaggccattttggtttgactccaaaatatgccatattaaattgttggtattttattaaatagtgaaaaccttgacctgcaggagtaaaatagcctcaagcatcatgcgtagaaaaccttctcacacacataggttaagaaaacccctgaactttaccccaccataacccaggcatcatgcgttgaagaccttctcaggcatgtcaagaaaacccccgaacccgcccccatctttacacagcgacaccgtaacccatgtgagaacaaccaatgacctggcatcatgcgtaacgtaacccgtgtgagaacaaccaatgacctagcatcatgcgtggaagaagaccttcttacgcacgtcaagaaatcccccgaactcctacccccacccttacatagcacatcgtaacccatgtgagaacatctaattacctggtccgggtctaagagctatactttgacatgggacagataaggggattttttttaaccctagcctggaattcgctcccatggagaatcgaatccagtgaggagtgctgttagagccacctgaccaactcagctaaaggctcattgtcagggttatggataccacatacctaatagtagttgactaaatctcggcaggatcgactacataccatgtcctatacggaagcaaccttcggataaagaaagacacccagagttctacatggaaacgacaatgactactcggattgtatctatattgattttcctagttctacttggacaaggagacacctataggtataaatacaagccccctaggaggagaggggacacccacgaggggacgacacacacactcaccatgaagagacaatctgtagcgcccgttccgtcgtggcgcctagcggaaaaattatctcttaaaaaccctattgcgaaatttgtttctttgcttgttgtctagtgtccgtgccatctcagatctcaaatccccgatctatcgtcgagttcaatcccgaatccaaatccttccaaatcaaatccctccgcaaaagtctattttgccttccccagggtcgatgggccgaatctctctcggcccatctccccctccctcccggcgctctctctctccctctctctctctctctccctctctccc

SEQ ID NO: 34967 - DNA, 20225 bp, Oryza sativa
  unsure (1)..(20225): unsure at all n locations
accgtcccgccgtcatcgccgtcgtcatcgcctcggccccgccactccgcgcgcaagccgccaagggacggaggcagagcccctcctccctctgccgcgtcgcccccgctcccctcctccttttcccaaagaggcaaggggcaagccccctttctctccctccttttccccttttcctcccgccggcgtcatcctccctccgccctgtcgccgatttggccgctagccggagcgccagctcgcgccttgaccggccaaagtcggtttccaaaccgacatgcaccctttaaagcccaggcgccctcccttcctctttcccccccattcctccccgtttctcgtccgcgccattgccgccgccttccgagctctgtctcgcctccgccattcatcgccaagcgccgggagagctggtgcgttcgtggacgcggaaggggactccgggcgcgccctctccttcctcttccccggcccgaggccggagagattactcccgcgccgtcggcctctcgtcacagcgccccacctcatctcggtagtgcctccctctgttcttcctcctcgctccatctcctccccttagactcgggtagtagcacgagtagcctccccgtagctagccagcgccgccccgaccgttgtcgccgctcgccatgtgctcgccgccgtcgccgcccgtgctccgtagcacccgctcgtcgccggcctcgctcggcgtagctccgcccaatccgacgctagcaacggattcccgtagccgcgtagatgctctcgccgccgggaatcggtccctcgtgacctcgtcgcctttttcctcttccctccccgccggttgccgccgccgcaatccgccgtcgacgcactccctccggtgaatccgagcagttagctcgtctcccctcgtcctgagcaaccacccggtgtgctcgctctcgcctgtatcgccgtggttcactccgccgctcgtcgctgtcgtccgccgtccgttccggccggcgtcgtcgtctacctcccgccagcccgcgtggcagccacgtaggcgccacatcggcgccagctcgcccgagatagggtcgggctgaccccggtcagcccctcccgtgcgcgcgttccaccgcgagccgtgaggctgcgcgtgggcccgccgcatccgttcctccgcgaaccacgcgcgtgcaccgcatcccttccccgcccgcgcgtgtgcgccgcgtgctcgctccgcacggtgaaccgtgtcaccgacaagcgggtcccaaccgggaccacgcgtggtgagcccggtccaccggctctctctctccttccctcccgcgcgcgcgccttgggccgccttgggccggccggcccgtttagctcggccgaaccgctccgtttctctcgggccgtgccctagccgcccgaggaaaagtctattttccctccctcttttcttttcttttcttttctttttcaaaaaaggatttaattaaatccttttcctttagaccaaaaatccaataatcttagaaattcaatattttcccaatcgtaaatccgtttgactccgttcaacttccaaaattcctcaaatctcgagatctatctaatggcacgcttagaggtcattaatagagctttattttcgccgtttgttgagttgtcccgtttcgcgtgtagtttcggagcccgaagacccgcagtgcgaggatttcaaggatcaagctccagatctcgagcaaggcaagccacctttgaacatcttgagcctatatttgaactaaattatgttgcttgaaaaatattatgcattgataggattgcacttaatctgttgtctcgtctgcaaggcagattggcggacctacctaatttgttgcatttgatccttcctttgttgattgatataccatgtccccttgtaactatctagttgcgtctcgatattcgtgcaccctgtgcgagtatcgacggacgccttcaaacttaaaatctgagtaacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccaaacataagacaagtacgaccacatgggtgaaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactattcgaacagccatgcccacggtcatgggcggatgtgaggtgattcctagcttagttttgtttgactactgcttgtgaaattactgttgtggaaaggggttcgatgtttgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacaagacgcactgtctcatccgtgtcgtttgagaagcactcacttagtcgtttttagaaaagagttcaaataaaatcaattgcaaaaacaacagcctctccttgaagcctgcattaaacacttatttcccatggcttgctgagtactcccgtactcacccttgctctatataaataatctcccccccagttgctgaagaagatgaagcggatcctgctgatgaggaattcttctaggagcaagccggctacgatgagttttagggtttcggcctagttcccaagtcgcgcctgtgttgtttggtccaagtcctggcttccgcttcccttttgtaatgcagttgtgagctcgggatctgtccacagcccaacatgactgtacctctactctttaataaagagacctctgtgctgtggtaatctgtcttcctgtgataccagcactgtgtcctgggactggtatcgattaacagttaatttggagcgtcacgggctagttccggtcggtactagttcggggcgtgacacaatcaacacccaccagaagccacaacaaagaagcctacatacgccaagacaaaccgccggatatcgatatcagagatacgcctggatcgaccctatccggtaccttcagaggccggccatagggatctagtactgtctctgattccgtcgggcgctagctcgaggaggaaggctaccctgttgtcgactacgagtcagatcgtcagaccgccatgtcgacaacagttagataggctaccccaaatattgtactggtgtgattattataaataagagcaataccggctttggccaacaggatgtagggttattacctgacaattcaggggcccgaacctgtataaaaatccatatctccgtcttttttacctcagtctcgcatatatcttagcgccgacgatccccatactatgcaaataccagaattgcgacatcaaacgtcgacactcattcacggtactttaaatagtcactttactagtgtttggtttgctatcaatatatgccaacaacacacatataaattatatattaaaaaaagatggcactactaacacttacttcatccgttttatattgtaagttgtttgattttttttcaaagttttttatgtttgatcaaatttatagaaaaaaatttgcaacatctacaacactaaattagtttcattaaatttaatattaaatatattttaataatatatttgttttatattaaaaatattactatatttttctataaatttgataaacttataatataaaaatggagggagtaccaaggttttagtattgtcaacattttaacatgtagctaaccagacataccctttggatacgtactaccaaagagacgtgccaaggtgtacggggagtcaaagaaattgcgtcgccgagggaggaggatgtacggcagttattagtatagctgcaacttatattgttagtaactgcgaaaagaaaaattgttattacacgtacactgtagataaacctgaactcttggattcggatccaacacggaagccatcacacacaccatagatttgcagcagatccggatctctctcacacacaaacacaaacacgactcacaagtcacatgtgacagtgcaggattacagggcattgacatcggcgagacgctgacgtctaagctgacgccggccggagcacgggcacctcctcgctcttctttcgtttttttgtctggcgtcccccgcctcttggtcctacactcctactaactcctaacctggtcgctttgcttcccctccgcggccaggcccaccgcgcggccggccgagacaaggcccaacatactaagcccactgcaacagcaaaaccgtataagctcgcaccgtgccgtgccgggccaagccgccacacctccggtgcactgaagactgaacagcggcgtgtagacttcgcctggtggcaagctctaggtccccatataaaaaccaaagagtcctgcgaggcccatcatcacccatggccacgaacagacgaactgatcaaattccaatcagaccatatgtagtaatgccggtttgccggtctagcgaacaacgtgaagatctggttacagcacagtattacatcctctgcttgactgcttcagtaacaaatttcaggactccgtcgatcacacggtccccaggtggaaactgtgtcttaatcaacgagatagatgatcaagctagataagtttgttaggggctaatagatattcatggcgacaaattcatcaacatttatgccaggaagctggaaggctgaagaatgcttgcttgcccggttctctaaaatactccagtgctcggttatattctagcctctaggcaaggtcttacagttttcatctgcacagccttttcttcagagtgtcacgcagagactgatcatcagggacaagatactccagtcaagatccgtcagaaaaagacagctcgaagatacatagatgacacggaaacagggatccccagcttgagaacctttccgtcggcgcagcatttacctccctcaccggcaataagatctcatagccgcaagaaactgacatgttcccatccagaaaaaggcaacccctgttgtagaacagagtcctggagaatatggcattgcctttatgtcaatggatcatcccagagaagggaaggccaacttgcaaaatcagaatgctaacaagccattgttaatcttgatatctgcaacataaaatgtaacatcagatttaattcgggaacacctagtagtgcacgtgcacgaatagtgggtcagtgaaagattatccctgccacaacataggtaactacgacgataatcctttagccaacatactgatgtggatagcatatgtgaaatgaatagtttcaggtgagcgttgacagcatagtaaatctaatttaattaggatatagatctagcaatgctgtttcagatatcgaaagagagaatatacccgtcttttccttccctttcatcaattgcctcttgtatcagctactatgcaatatactggaaactacgtgatataaatgttgcaataaataagaaagatatgttttgagatttgatacactcctttcaacccagaaagagcaggtaagtgtacatccttgattgacgaccatctcgtggttaccaattccatcaccgagatcacagcagaactgccatggatataaattgatgagtacagtcctgagaactgcaagctgtgagctgatgaatccaagatctaacatgtctaccatggaagagcacctgctgcctgtagtccaccgtgatcaagtatactcttcaagacaagacagaagaaaatcctccgatgtcccaaacaggttcgtgacttcctttcacccaagtacaaatagcaaaggtaaccccaatactcccaatcatccgttacatactagcggaaatggcaatatagttaccgcacaaaatttccagcgggtgcattcttctccttctatgttcacatcaatcaaagaaactccctgtgcagatgagttcaatgagcaaagccatgctgcacaacacgtaccatcatttgcaaggcaggctatcgttagcgtcatcttgtacatctcaataggagtccttgtatacatcacaaatgttgaaggcttcaaggggaggtccacactgaagttagttgatggcctttacttcaccatcataagcttgtgcaccataggatacggtgacatagtcccttgcactaccttcacaaaggtgttcacatgcttgtttctactaatcggtgttcgctttgttgacattgtgctaaatgagctgttgacaaatgtacttgacaagcagagaacagtcttacttagcacaatggatgataacaagcttaatagggtatttgacacctatatgattgatgctgaaaagaaaagatcaagagggaggatgaaagtactacttgcgttaggggttgttgtaggcaccatctcaatttgtacaatcatagtgcatgaggtggagggtctaaattggattgatagcttctatttatcagtcatttctgtgacaacagttggatatggggattatggcttctcaacaccagcaggaaggctctctgcaacagtgtgtttgttagtgagcactttggcagttgccaaggccttcctgttcctaacagatctaaggatggatagaaggaaccgaaaaactacaaaatggatcctccagaagaaaatggacaatgagccactggctgcagacctagaccatgatgcttctgtaaggtattgcacaaattttccatgaaaccatatacctgcatatgttgtttaacaagtacgttttcatgttttgcaataagaataccaagagttcaattaccaaaaatgtaagaacatttttctttgttagtgatgaaactagggccagagtacagttttgtttgaacattgaaaaatgtttgataaagaaacagagttgagttactcaaataaacatatagatagggcattagggcaaggtcacatgcccgtgatgtaggtgacaccatgaaaattaacacctcacggtccttcatgaaatttactttcgttaccttttgtttttttctttattgtattaatctgaaagtaatttataatgttgcattacagtgtgaccttttgtattcaaggcagttatccagtcctaactttgtggtctttttctttttatgccacagcaaatcggactttctgatctacaaactcaaagagataggaaagatcgatgacaaagacattgcaatgatctcagaccagtttgatcagcttggccttgcaaagtgtggaaagatcactcttgcggacatcattggaaaattataagtatgatttacagaatgtatatgaatacctgatatcatagtgatagttgctgtcttatactttgttaaacagacactaaagcatgcacatgtgtgggtaacctattaaataacctcgctattcgaagtactctgtttcttggttagaagtaaaagtccatgtgctggttgaatgaattcaatcataacttcagcttcaggatttcttgcatatttgtttctagattgtattgatatttaggtatacaagcaaagaggcaggtagacaataaacaattgatattaaagaatcataagatcgtctcatacaagaaaatagtgataatctaagctatgtgcagtgaaatcaaaacaatgacacaacttaccatgttacaaataaaagaaacagggtttgatgtcatcaatacattgctttatatacttcgctatgacctcagtcctcagatccagcctcctttactgtattatccacaatctttgcaatcctgaaataatgggtggttatgaagcttaagtatgtagtagccatgcagtaactgtataattaaaaagtatcatgccctttgaatacgctgtgtttctcttcctcctcctcctcgactcacctttctctagtttcagttacaagcttcaatacgtcagacaatttttgccacttggcatttattggcttctgaatgtccacctgttctgctagttgggaactgatatattgttcaatttcacattctaatgaatccagctgaaaaccaatatggtctagaaaagcatcataagaagaatggttagttatgctgtttggtgattcaagatcactggaaaatgagaagctatcggacgtctgaagttcactttgctccaactggccagtcatgcctgaatgcaccacatgttgcagatcaaatgccttttcagatgatttcgcaggagagctagtagtctcatcagcctcatcaccaactttactagagaaaactcttatgttgtcattggattctttgccattagacatccctggatgcaatgcatgttcaattaacatgttctgcttcactgaaattgcctgaatccaacaaagtagaaaaatagtaggatcatttacataatagaatttcaaatgcatagatgaacataaatttgaaatttgcttccttagtaggagtggtatatgtgagatatcagatatgttcttgttaatgaccaactctataaagaaagagaatctgtaacttttcgtacttgacacaatcagcagaattgccaatttagcacatcaacagtacagcatgtaactgctgattaatgttttggcaattggcagtagctaggtaccataagcttttggcacaaactacataatatattcgttttcctaagaagaaatagcatatggtacatagtaaaaaaaaaagacatgacctcagtacctcactgattttcatggaagcttatcaagcacctcaatgcgctgttttatgctttcaagagctttggtcagcttcttcttttgcacaagtaaatccactgcctcattctctttgcccattcggatgctgaccgcagctcttttcttaagattctcagcagcctcagtcaaccgcacaagccttaccctcgtgctatttgctacaagaacaaaccacaaatttgagtgcagcagataccacagtggctgtccactcaattcgcatgcacatacacaaacaatctcaccatttgactacaagatcctactcaattccaatcaaaattaacttgacatggatcataacgtactatcacaagtctggagcatataacagataagttcccctgtccccgaaggattcatcattccacaactccccaactactgaaccagtagagccgatctgaatagcagccacgggatgccggaatgcgtatacctttggattgggtgaggtcggcttctgcgtggagctgtaggagctgctcccgcagccgctcgaacgtcggcggggccgggtcgccgtctctggtagatgccgccagcgcgaaccgcggaggagttgccctcgcgcggcgcctcccccatgccgccgcgggagaaggtggaggcggcgctaccggcggcgcgacggcgaaggccatctccggtgagcgtccagatgggcttggcactgaaagcggaaacttagaaatacgcgacctccttaaggcttctccgtgatgggccgaaatttcggcccatccaacaagtccttaccggacgacgtatctcggtgcagtggtctactgcagtactgctaaataggaacgccccaaaattcttctgaaaaatttcaaaacatttctcatgtgaagctcttgaattattaggttctgatcgagaatttaagtagatcgcatgaagggaaaattctactcctgaataaaacattttttcacaaaccgcaagttcgtagctaccggtcaatccaacttaccaaaatagttttttcgtacctggaacagaacacatttctgtacagatataaagagggagataagttgcctgaatttcatggtccagtccaacctgacggtccatttgggcgacggccggcccgatcgctcggcggacgaacagcgtcgttgctatatagcatccactgccagcacagtgccagtgtccctaacccttcttcttcctcaactcctccacacacaatgtccatacatatggagcttgcaatttgaagcattttcaagtttgcatgcccatgagaaggagaagcagttgtgtactcacactgaatgcgcgaatgctgtcgctacttcttgattcaaaggtcatttccgctctgtcaaattgtgcgatgcattatattgcctatctgttttgattgaagtttgaagttattgttggctgtgattgacgtttgtaggttcagaccagtgttcttgcttactggtattcagatgctataataaaaggttataatacatatcttaggttttggatgtgttctttgctttcatgcttggcattactctgtgcacttatgcgctgtctgtcagtgtgcagaatacatggaaacctgaaattaagtgatagttaatctgtcctggataagtgtatattgcaggctttatccacagaatgaagtgtatatggcaggctttacctgaaattgtgtatttgtgcgtctcctagtatgactggcactctcgaacaaaatgaagtgttagactgttaggtgttttactgaatccacacacaacagcggaaacatttcggatgacatcaatggcagtatgttctggaataagaacagatgtagcaaacaaaaaaataacactaatgagctgcgcatacgtgcatatatagacagacaaacctgcagggttgtgagctgcaaatgctcaaattgatcactcgaataatgcacacagcagtagtataggtgcaagcattaagtcgtacatacgttttcttccatcacatacacatcaccggtcatgactcagcagacaagctgttcttacatgttttctcatggtcaacttattccctgatcaatctcccgaaagattactgtttggattccatgacgtctccatgaccaatctcaccattgccatgctcgtgatcgttgccctcgacgacgaagagatcgcctaactgctcgtcgttgatcagagaatcaagaaacgaggagaagtcgtcgtcacccaccatggcggaagcggaacccatgtcgaagccaccatgaactgcatcctcggcacagaactgatcgccaaatcctccttcgaatccctcggcatcggcggcgctcaccatcgctgcgaagtcaccgccaccgtcggccggtcgggcacgatcgtcgctgcactcaatgccagcggccggcgaggatgccgtcctcggcggcttggccggcaccgccttcttgtaagaagtggcggcgacggcagcggcggcgttggagtgatcggcggcggccgtcagcggcttgtgcgtccgcgggtcgatgccctgcgcgatgagcttcttgctgagatgcgagttccagtagttcttgatctcgttgtccgtgcgccccggcaacctcccggcgatcagcgaccacctacaagcacatgcacgggcggtcacctcaccggaggagcagtacgacctttgcacacgagcgatcgccttcggtgcatcaagaattgcttaccggttgccgaggaggcggtggaggcggaggatgaggtcctcctcgtcgtcggcgatggggcagcgcttgatgtcggggcggaggtagttcatccaccggaggcggcagctcttgccgcagcgcagcaggcccgcgcgccgcggcagcgtgcgccaccggtcgcacccctcccgcgccacgaaccgcgccagcacctcgtcctcctcgggcgtccacggcccacgcttcagcgccgccgccgccgcctcctccccgccgcgcagcgccgccggccgcttccgcttcatcgtaggatcgatcggcgattaatttgcgcgcgagctagcttggcctcctcgagacgtctcgatttgcttaattgcttccggcgatggcttagctcacaaccagatgagacggtgtgcggggctttttctcgccgtgcaccgcagcgccacctccccggagaggaaatggtcggtgggggtgggtttgttctcctcggcgtgcggcctgtggcgttttgcgggaaacgggaagaattctcggggacggatccatcgggtattcgggttggggtacaacgtgtcacgctttttatccgaaaaggcactgcagatgcaaatgtacatcgtcgcgatttcggcaattcggcgccgcggtgatagtcctcacggggaaaaagatctgtagcattagcaataaaatttggagcaaactgaatagatggaattatgaggattatttctgtctacattcataaattacatggctatgtataacttctgtgaacgaataatagcctaaaattaaactccaaggcttcgtcttttttcaactccaaactaggtttcctttttgttcgttaacacattttttaaaatgttaaatagtgtgttttttctttaaaaaataaaataagcctatttttaaattttgtaataatttatactaattacagatgtgctaatggtttgactcattttgcttgtgctaaaaagctaaaccaagttagagattcaaacagaccctaactacagttcaaacttgacagttaaacttggtggtcaatactaaaatactttgagatggtctttttggacaatcggtttagtaatgggtccaaaattttagcctataaattctacaaatttttttatttgagtaattttactttgggtcacctttttattaccggtgtctcgctttggatcaccatttaactaatgtttacattttgaaccaggtaattttacctttgtggcactttgaaccatccctcaactcttttatccatctacatcaaaattatcatatgtcaaagaaacaatctacatacatttgagggggttttgacgaggagaagccgacgtacttgaggtcgttcatctgctcgagaagagagtcggggtagtccaaagttaaggaaaggcaagattacttggtccaaaatgaaaacattggtttaaagggtggtccaaaacgaaacatcggtaataaaatttgtcccaaatatgaaatttactcttttttgtttttatattttttgttaaaatatttttaaaatattttttcaaacttttgcaaatctatagcacgcattaggagggcatttcctagagggcttctttatgacatggtagatggttattgacgtgtacgtctatatatgaacgcccctcatatttgtatccccagctgtgagagatcagcgtcgagagggttctcgtggtccatagtggcggaagagaagagaagggagccgatgagctcaagctcaccaagcatgtgcgagaaggaggcggcggcggtggcggtgggcagctagagtggatgaggccgcagcctacagcagcggaggaggagaggacggaggtgatggagaagatgcgcccaaaattttaaggtgtgcttagttccacgataaaattggaagtttgactaatattgaaagtttgaagaaaaaagttggaagtttatgtgtgtaggaaagttttgatgtgatggaaaagttggaagtttgaataaaaagttgggaactaaataagggcttagtctataaatttcaaaagttgaaaggttgggctgatttttttttttttttatgttttgaggttaagagaaatgattgagttggactatgaaagatcccatggcctatggcccattaccaccctttcaagctcaacaagttcgagatggcccaacttgttgcagccgatcgagcctatcctaccctagctaagcatgactcgaaatgaacaagacgtgccagcaggagtcatgctgccttgtgtaggaagcacccgagccgctgaacaatcaactggagtattgaaatttgaaaggtgctctcgtggaatatttgcacagctggtggacgtgcgaggactaggagacctcgaatcgggctacggaaaatcccaaaacgctagcgacgtcaacgtgtgcttttcttggcttccaagcaggtctgcctcctgccttcctgcctcctatggtgtccaccagttctctcctggtcaaagtatgtaaagtttaactgggcgttcggcttgactagaaagggatagattattaatgaataattaattaattattaactattttcaattttaaaaatagattcctttttattttttaaaaccttctatatataaagtttttttaaaagaaatatatacttttaacaatttaagaagtgtgctcacgaaaacgataaagttgctcagtcaaaatgtggaatcaaatccagctaggtgaaggccttgccatttgcaaattgcagtggcacattcatgagggtgtgtcgctaaggtgacagtgacctgaagaattcctagttctagatgtattgatctgctctaccgtaaaggatactccaggtttatattactctctctatttcaaaatataagaagttttgattggatagaaaatattttttaagtacgaatcagattcataatagtatgatgtgttccatctaatcaagatttttttatattttgaaacggagggagcattagtttgctcaaagctcgtacgaaattgaccgttggtatctgcatcagaaaacatggatcggtattttacacacgtgtatgtgtggcgctaggcattttttgcgatcacgtggaagattcacacgtataacacgcacgtaacgtatgtacgcgcagacgtcctattgcccagctagccagcatcgattgcctgaacgtacatgcatcgggacgccacgacgaagatttcggccccagttgaaaattcagctaatgatcacgcagaaaaggaacagcagtacgtacagctgaagaaaaacaacacgggtcttgggctcgtcgcgctcatacttgtggttgtgtaatctttgcaaaatcctggcgtaatcacatggctagtacatcccgccttccccgtcagttccattttccaagcaccgaaaaaacaggagtgcgcgtaacagtcaaaatcctgcacaggaaatgcctatatatgcaggtacctcctccacccagtgatgtcacccagctcgagcaaataggctgtagctagccggccggcgagaaaaatggacgagtcaggcagaggaacaggtgatgatcatggccgggagacgaaggatgctgcggcggcggcgtcgtcgtcgtcggggaagaaggtgccgctgttcagcttgttccggtacgccgaccgcctcgacgtgctgctgatggttgtcggcacggtgggcgcgctcggcaacggcatctcgcagcccctcatgacggtcctcttcggcaacgtcatcaactccttcggcgcgaacaccagcggcagcgtcctccgcagcgtgaccaaggtgagtgcccgcgggcgcttagtgatacgcgatggagacacaccggccggtagccaaattaactttggatcttctttctcctccaggttgtcctcaacttcatatatctgggaattggaacttcagtagcttcctttcttcgtaagtaaaagtcctttctctgattggaacacctctttagtgaagtagagagaagctcctgcccttttcgctgaaaaaaacaaagaaaaaaaaagaattagtggaacctgtagcttcaaattatggatgtgaaacatataaatagtattcagcaagggaatttgtagtaaacagtattagaaattctttcaatatctaatttgttcctattattcaatgagtctccgggtatccataagtcaataagaaatttcatttaaagggtctcagagtatccatcagattccaaagcaaaattaacactttttattcaaagggtctcagtatccataagtcagtaagaaattttgtaggatagtgtgaaattaggctttgtttggtaaatgggattgagaaataatatcccaccctccaaaaggtaatattgcatcctagctatccattcttcacacctcatttaatcctagccatttattctttacacctcatttaatcctagtcattcatccatttccatttcccaatcccacctgccatatcccatttgccaaacacacccttaggataagtaattaatttgctcttgcatggatgcgcaatcaccaatacataatattcattattaacatcatggttgtcagttgttactacatgttagaattcggttattctcaactgtgatacactaacacagtataaacatcatcatgcacttatccggtgagaagtaccaaatgcgttccctaaccatataatcctcagcatcttcgatctaatctgttcggttaaatatatcacatgctaatggtacaactgccagtaaaaaactcaccttaatttgtcccagaggtatcatgctggactatggcaggagaaaggcagtctgcccgcatccgttctttatacctgaaagccgttctgaggcaggatattacattcttcgacacagagatgacaactggtgaagcagtttctagaatgtctagtgataccctcctaattcaaggtgctcttggtgagaaggtactaaatacctagtagctccgttgtaaggaacatactattttttattaaattgctactgaaaaaaaaacatatattttcatcacagtgcaaacaaaagtgtggatagacacaagttgatggcaggcataattatttgcatatttaggaagatatatcaaacggatatagttatcatatttactaactgtattatttcatatattcaggcagtaagttacaccttgtgctactgttgctgatgtgttcttggatttttaatcttaacctttacagggagggaagcttgtagaactgttatcaagcttcatcggtggctttatcatagcattcactagaggatggcttctcactcttgtcatgctaacatcgctaccgttaattgctattgccagtgcagtttctgcacaggccctaactagagtttctagcaagagacaaacatcatatagtgatgctggggacacagttgaacagaccattggatctataagaacagtgagtttcacatatttatatgaattgtttaatgctataacacacttctttttttggagtagcagacagtaagtttgataaatatcctgtgttaacaggttgtgtccttcaatggtgagaagaaagcgatagcaatgtaccgtaattttataaagaagtcatacaaggctactattgaggaaggcattatcactggttttggcatgggctctgtcatgtgcgtcgtatttggcagctatggattagccttctggtatggtggaaagctaatcattgagaaaggttacacaggaggaaaaatcatgactatcttgtttgccgtgttgaccggtgcatcgtaagtttcagcaaatcctccactgttgatatcaaaatacatgctgtttagtgcactacaataatgaacccccaatctattcatgtattatttggattgatggaaatataacaagaaatttatatatattacctcaaaatcaagaaggctggttagcatgcaattttagaagtgcaaatggcagttttgttcatttctcaggtgttttttagaaaacttctcaggatttcaagatgattttcagaattaccttaaattattttcaatattttcttgattactatttacaaaaagacaatgctaattgccaatgcatgaaagtaacttgtttcttgtaaacagaatggaatgaacttaaagtttgatggtcaagtcaattgcttgactatacataatccctaggccctattaccattttaggcagacataccaattgctaaggagtagttattaattccagttagtaaaaggggatcatgaactgagatatagacataagtacctaatagctaaatcaaggtatccttagcaattgcaagagcaggtttaatcaatatgttctgcgctaacaggagaagtagacaaacgctaggcttttggaatcgtcacgaagagaatattctcctgagaagtacattacatgttatatgcaaacgattgcattgggtttcactgctttacctacattacttgctatttctcctaaaatcacattaaagttgaaagatttacaacaaaatagccattaaaattttatcatttgatatggtatataatgttctgaacatggcactttccaattgtttgtgacagctcattaggcaatgcaacacctgcagttgctgcagttgtggaaggtcaatctgcagcatacaatttgttcaaaacaattgagaggaaaccagagatagattccgatgataacaatggcatggttttagaagatatgaatggcgatattgagctaaaggatgtgtactttcgttaccctgcaagaccagagcagttgatattggatggattgtcgttacaagtagcgagtggaacaacaatggctatagtcggagagagtggaagcggaaagtcaactgttatcagcctagtcgaaagattctacgatccacagtctggcgaagtttaatagatggaattagcatcaagaaactgagacttgattggataagagggaagatcggtcttgtagccaagagcctctgctttttatggcctccattaaagataacataatatatggtaaaaaagatgcaacgcttgaagagatcaagagagcagcggagcttgcaaatgcagctaacttcattgacaagttaccaaatgtaagaaaggaaaaactgaatgctccaagttctcaaatttaattgtatattaatgaaataatcagctaacaatgttttcatgtcataccagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggttgaattaacttgaaatgcactgtttttctattatagaaaatttctgcggtcaaccttaaatgattcattataccaaaacatgtcctgcgtacacaggtcctcatgatgcactggtgaaggatcccgatggagcttactcccagctaattaggctacaagagactcatcgtgatgaaaggcataaactaccagattccagatcaaaaagtactagtttgtcattcagacgatcaagaactaaagattttctcagcaagagcaacaggtattccttcaagagccccttaggattgcctgttgatatacatgaggatggaatgacaagcgaacaacaaaaggttgaccactctgacagtaaggccattaaaaaaacaccatttggacggctttttaatcttaataagccagaagtgccagttcttttgttaggttctatagcagcatcagtgcatggagtcattttgccactatacggtataataatgccaggtgttctaaaatcattctatgaaccgccagatcagctgcgaaaagattctagattttgggcattgatgtctgttgttctgggggttgcttgtttgatttcaatcccagcagaatattttttgtttggaattgctgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34968 - DNA, 30337 bp, Oryza sativa
attccacttgtgggtcttcaaggttatgctcaagttaagttcctgaaggggttcagtgaagatgccaaggtaatccatcaaagggttgctcttcttcttgtgatagattgttttgcaaataacttctgaaactaaatattactcatatttttattaattatataaagctaagattatgatcctattaagttcaagaagtatgattgagtttctaaatttcatgacgaataatgagaaacaacattcactctagatacatttttcacaacttgcttaaattgtgacaatgaattcctggtttggcagatgttgtatgaagatgcaagtcaagtggctactgatgcagtaagcagcatcaggactgtagcttccttttgttctgagaaaagagtgatgacaatgtatgataataaatgtgaagcttcgaagaatcaaggagttagaacaggaatggttggaggccttggttttggtttctcattcttgatgttgtacctaacatatggtctctgtttctatgtcggagcacaattcgtacgccacaataaaactacttttggggacgttttcaaggttagtaaatgcaaaactttaatattaaactttttacccttcagagttttcctctttttaaactcataatccctccataaacaagagatctgcttttacgggggtgatttgacatagttagtcatgttttgcaggttttctttgcactggtgttggcaactattggaatatctcaaacaagtgcgatggcttctgattctacaaaggccaaggattcagctatctccatatttgctttgctagaccgcaagtcacaaattgactcgagtagtgatgagggtaggacattggccaacgtcaagggaaacattgatttccgacatgtcagcttcaagtatccaacccgcccagatgttcagatcttcagtgattttactcttcacataccctctggcaaggttatccaatttatatgcttgttgcatagttatattttctgcattaacatatccagcaacttactatatggatttatgcagaccgttgcacttgttggagagagtggtagcggaaagtccacagcaatcgctttgctagagcgattctacaatcccgagtcaggaaccatcttgttggatgaagtagaaatcaagaacttaaaggtcaattggttgagggatcagatggggttggtcggccaagagcctgtgctctttaatgacacaatccgtgctaacatagcctacgggaagcatggggatgtcactgaggaggagctcatcaaagctgcaaaggcatccaatgcacatgagttcatatcgagccttccccaaggatatgataccaccgtgggggagagaggggtgcagctatctggtggccagaaacagcgggtggctattgcgagggccatattgaaagatccaaagatactacttctagatgaggcaacgagtgccttggatgctgaatctgagcgcattgtgcaggatgcgttagataatgtgatggttggcaggactacgattattgtggcgcaccgcctctcgacgatcaaaggtgctgatatcattgcagttctgaaggatggtgcgatagcggagaaaggaaggcatgaggcattgatgaacatcaaagatggtgtctatgcttcacttgttgaactccgttcaggctcatcataatactcaggataagatttttgttttttatttaccctctctggggatgtaatatatcttccttgacccttttttgttttacaattgagggttgtagtagtattaattatttggattttaaagtgggatttgagaaggtgctctctgtatgtatctacgcggtgtcggtttattaagcaacgagaaagaaatattgtcctacagatgctgatatgtgggattgtccatgttcgatgtgcatgactgcaaatgagctcatttttgtgctgtacgtttatacctatgtggttatcccaagattaccgtatatgatatgtaaattctgcacatacattttcatatgcagcaattcaaatgctctacctatgtcattatcgggaattaattaaccagatggggagaagcaaaacataccatgataccgacgcaactgaagatcgtgtttgttgccgttggaggatcagtgaggcacacgcacgcgccgggatccataccgccaacggcgccaccgcgcgagcagagcggagatctcgacgaatcccccccgtacagcaagcccagccacggccgccggcgacgctccccgagttccgaaggccgctcgccgccaccgcgacaaccgcgtggtcccgtgggcatcgagtagccccagcaccgtgcggcgcctaccgtccgcaagcgtatcccaagggggcccggccggatgatggccgccgccgccggcgacggcggcggcagccggcaggcatcgcctctttcgccgcgcactgggccgcttggggaaatcgaactctacggcgaggcttctgaagcgaaaggctacgtcgggcgttcttgggccagatcaggccggtttagaggcggcaacgcaattttgcttggaataagttcactctaggtcccttaagtcaaaaatttatcattaaaccacaataacagataagtatgatacgtcctcaactccgaaaaccagtgaaataaggtcctaaaacggttcggaaggtgattttaactgacgttgcacttaaagttaagaaaatactatgggactcacatgtcagcgagtgttatgttaaaattaaaaaaaattgcggtgggcgccggcggcaagccaggcttgccatgctcagccccagctgccgttgccacactcttcttctcgctggcctctgcatccctctcgacaacgcctctgtacccgaagctgaagtcgtcccgctccacgccgtccgctgccgatcaattagtcaagtagcaagaacagagcattataagctcgccgccatatgcaaccacggaaatacgggtgcgagggagggtggtgtgtgttgtacctttacacggcgaagcgacggtgatgcggactttcttgacagcgatgcagacctagatctcaatatttttttttataaaaagtataaaattttaactcatcctattttaaatgtaggcctcaaatttagtaggctaaaatattatgtccatttccaccatgcgtgctcgcatgcctcatgttggagatatatagcgcaactctatggaaaattgaaggcaagtaatgaagagaacaactagtagagatggaaatggtcaattcacgattatttcttagcgttgttttttgtaataatcaggcaagaaacattttctttagaaaaagatgcaggaggcacatatccaggctgtaaagacgactgacaatatggtcagctggtagtccagccgagagcaacgtgtgccatcgtttgggttacttggcactttcgcactctccaccatggatgacagatgttctccggtgtggtcgatgttgtccgggaattgaagtggcgaaatacatagcgactgtgccactgccactgccagccgggcgccggccacacccgccagccgtctgggatctacggtggttatggtcgcgagagctcgatccagcggctttcgacggtagactgtagagagatcgattggtgtcaaactgtcaataatgaagcagtggagcgctggatccttgtgtctcactcagtcattaatttggtctaaagatttccaaactgtcaataatgttctgggtcgccaagaacatcaaaatgtcgtgtatgcgacgattagtctcgcttggaaagacttggacggacaacgggtcgatggaaacaataggacgcaaggcacgatcaaagaagtttcttctcgatcgaattaacgcagagcctacttgaggacgagaagatcatgatgtcgtcgtggatatataccttaccatggatacaaactgcgtccaatacttgacgtcaacacgttaagtccgcagtcttaccgcactaaccaccaaattaagtggaaattaatttgcaagctgagaacgatgccacggactaactgtatcgtgccaaactatcaaacgactcacgttatactacaatgttttggaaactgttttcattccatgggaagatatccagtcttttttacatatcatttaaacagttatcatttttttaaaaaaaatgacaagattcttactataaaacatataccgctccacaaacttgcaaactaaaatttaatttctataaattgtataaaaaatatactaactacgaatatacgttaattattttcagtttatttcatgttttttacaatttgtagaaattgatttcagttttgtatattcatggagtgatatattttatattaatctgtatatgttgttaattttttaaatttaataactatttagaagacatggaagaaataaaaatccatgccccaatgtttatataaacgatcgaactccattcgtccagatcacctcatgcataacacattacatgcatttgcaagccatacgctctctgtaatatggataccaaattgggagcgcttgctctcatgctcccgcttctactgctgatttccgctactcgcgtagcctacggcggcatccaacccacgccgcctcccgcgagcttccaagccgccttggtccgcatcgagcccgcaggcatcaactacacgcgcgccgtgcagcgctcccgctcccgcctgtccatgctcgccgccagagcggtgtccaacgcgggggcggcgccgggggagagcgcgcagacgccgctgaagaaggggagcggcgactacgccatgtcgttcggcatcggcacgccggcgacggggctgtcgggcgaggcggacaccgggagcgacctcatctggaccaagtgcggcgcctgcgcgcggtgctcgccgcggggctccccgtcctactaccccaccagctccagctccgccgcgttcgtcgcgtgcggcgaccgcacgtgcggggagctgccccgaccactgtgcagcaacgtcgccggcggcggcagcggcagcggcaactgctcctaccactacgcctacggcaacgctagggacacgcaccactacacggagggcatcctcatgacggagaccttcaccttcggcgacgacgccgcggcgttcccgggcatcgcgttcgggtgcacgctccgctccgagggcggtttcgggacgggctcgggcctcgtcgggctcggcagagggaagctgtccttggtcacgcagctcaacgtcgaggccttcggctaccgcctctcgtccgacctgtccgcgcccagccccatctcgttcggctccctcgccgacgtgaccggtggcaacggcgacagtttcatgtccactccgctactcacaaacccggtggttcaggaccttccgttctactacgtcggtctgaccggcatctcggtcggcgggaagctcgtgcagataccttcggggaccttctccttcgaccggagcaccggggcgggcggcgtcatcttcgactccggtaccacgcttacgatgctcccggaccccgcgtacacgctggtgagggacgagctgctgtcacagatgggctttcagaagccaccaccggcagcgaacgacgacgacctgatctgtttcaccggggggtcgtcgacgacgacgttcccgtccatggtgctgcacttcgacggcggcgccgacatggacctgtccaccgagaattacttgccgcaaatgcaaggccagaacggggagacagcccggtgctggtccgtggtgaaatcatcgcaagccttgacgatcatcggcaatatcatgcagatggacttccacgtcgtgtttgatctgtccggcaacgcgcggatgctgttccaaccgcccaccgcctgatacgggagattatgaccgttgattttgtgcgccgtatgtagtactagcactctagcagtgtagcacgtacaattgtgccgtagcgaataagttctgcacaaattattttctgccatccgcgcttagttgtaagtacgcgagcttatgtaatagtcttccaagagaaattgaacgggcataatactgcatgtacggttacaatatacttataaacataaacgtttaaacacatatatagtataccatatgattagtactactagttattattttccggttctaatgtaaaaatacaaacgaaactatagagagtggaatttaaatgtaactctcgacggacgtctagttgtttacatgtaaattaaatagtcatgatttttttgcaaaaaaaaatattgaaaatgtcttaacagtaatatatctctatctccatctctatatactattataaaaattaaagatgtttccgtcagactttcgacacgtcatccatgttagaatcggttttaattttatgtttgtgttaagtcctatctctttttcttacgccaaagtgtctatcttatctaagacgtgcgcgatttaattgggccccgcaccttttcacgcgtccattgccgcacgcaacaattgggcccgtgcccgggcctgtttttcacacgcgtctttgcgtgccatggcgattgggcccgcaacacccttgcgcccacgattttgtcgtttctgcatgtccgattgggactgcgtcaccctcgcccgcgatttaaaaattgaagatgtttttgccgaaactatagtacgtcatctgtttccgattcccgtcacgtgtaacattcattgcgaagtcacgactcgcgagcgaactacgagagagagtccgtgtggatatcatgtacgtcattgtcctaattatccgattctattcgtattacacggcacgtataatatgttagcatgatttcaagtcagtctccacacatgctcgtatgtactaccagggccgttacaacgatccataagaatacaacgatccataagaatcagttttactttcgaaaataacatcctaactaaaataaaggataatcgaagttgcagattccgtctgccattgattctctgccggacttgagataaagctacgcgataaatcgagctcgtgttttgaggcctcattgtttggcttatgcttattcctagccaaattttaaattttagaacttaattttaaaattaacttttgatttttttatcgtactttattttatagcatttgcttttgagtcactaagaacatgcatataaaagatttgcacacaaataggagatggattctaatctctcgggtggacgtccacccgtttcttgcatgccacctaaatgattataaaaaaattttccaaaaataattataatataggttaatatgtaatgtatcatatcacaaatatgtaagttcaaattcgacttctataagttgtaacagaaataacaaattaaactctaactagtatacacatattcacagtccaatttgttatttttgttacgacttgtagaagtcgaatttgaacgcatgtttgtgagatgatatattacatattaatctatcataataatttttttaaaaaaaattataactatttagatgttatgcaagaaacgggtccacccgagtgtttaaagcaatttcccccacacaaataatctttttttttagtaagtgattcgaataagcacatgaataaacgaaataatgggctttgattatttatccaccgatacatatgtacaaattaaattggttctagccattgcaacgcacaggcatctttttagttactctaaaaaaatacaagttaaaatccaacttttataagttgcaacaaaactaaatttaaccttgcaacatgtaaaagttcaaaattgaccttgcatgtgttatgaagtgatctatcacatattaatctatctagttaatttttaaaaaatatttttacaatcatttaagtaacatgcaaataattaaggtcatctgttttgacaagatgagggcatgtttggggggcttctgacagctgcaacacttcctggaatcaaaagctctctcacaaatagtctagcttttcgtccaaattctgaaaagctagttgtcgaatttaaagaaatgagctagaatttagaaggaaagaaacacatattttttagattttcaaaaattagataccaaccagtaacttatcaaaatcttttaactccaatttagtcatggacactagtgggccttgcaggctgcaggtgccgattgtacgtacagtactacttggaataagttcatctaaggtcccttaatttgtcaacgaatccgattttcgtccttcaaccaaaaaaccaattacaattggtccctcaactatcaaaaccagtgcagatgaggtccctcagcggtttggatggtggttttggctgacgtggcgtcttcgtagctaatttgactttgtctttatttgacgtagcattgacatggcgcttacgtggcaatgtgagctggaaaataataaatctcgtgggacccacatgtcagtttcacacagaaattaataaaaaaaggtggggcccacgtgggccccacctgtcattctcagccctcctcttcttcctcctctccccatctccctctctcttcaactctctcccctctcctctctcgcgacgcgcgcgacggcagaggctcggctccggcggctatggacggaagaggtagggggcggcgggaggtggacctagctgcggcgaccggcggagaggaactgggcgtcagcagcggaagcggagtctcgaaggctggcccccaggcgatgcggaatcgacagcgggagctgcgggaagacggcagccgctgtggccgcccgcgcatggaggagaggtgggagccagagagcgcgagctcctcctcttccgcgacgccaccggcctcaatgctcgatctcaccctcctcgcggcgttagagctccgtctaatattcttgtcgagatccggccagagtagcaccaagcccacgaggccaagctggccatcgtcccgccacagctcgatgagacgatggtgctcctcgattggtgagctcgagccggcggccagatgcagagcggaagaggacgcagagcacgtgctacgacaagtccgcccggcggccggctgtgtccggtgttctgtgttcatgtgcgctcctccatgggggaagccgccccggtgtggcgtgcaaccgcggggaagaaacaggctttcaattttttgcagcggctgcatttttcgcttgatttcgtgctaaaattttctgcttgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgctcgctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgctcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggtgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccaacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattccagttcaatcacaccaccagaacaaactgatatacacatgaacttgtctctgaggaggatgtcagtgaagctcctcgaaggagtaagagacaaaggacggctaagtcttttggtgatgacttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaagacgaagatttctttgacacttactcacctgttgctagattgaccacaattcgtgtgctactttccctagcagcctcacatggtcttctcgttcatcaaatggacgttaagacagtttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcagggcagggcaggcggcgcgcgtgcacgacgtacgcgtcgaatggtccgaaaaatggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacactgctgaggtactggcgtactactctggcgacatgtaccagagcgtgccgactagctgcgtccgcgacggcggcgccgcggccgacttgctgaggcccaagtcgcagatcctgacgcggccatcgacggcgccgacgaggacgttgcccggcttgatgtcgccgtggatgaccccctggcccctgcgcgtgcagttgcttcacgccggcgagcagctgcttcacgccgacgtagtccatgacgaggtggagcttgctggtctccgggtggcaagtcatctcgcggagcctcacgattgcggggttcccggtgcacgccacgagcatcgcggcctcccacacctcctttccgcctccctcgccggccggcgcctttttccttctccgtgcgcgctcgccggccggcgaggaaggatggccgggagggagagagaagaaggcgccgtggatgaaaaggatgtgggtcccactatttttacttttgtccgactgacttgcgggccccatgtttttgtttttattttaaagttttatattttgcttctagtgccacatcatcgctacgtaagacgaggaccaactcaaactagccacgtcagcgccacatcagccaaaaccaccatcgaaaccgctgagggacctgctttgcaccggttttaatagttgagggacctgttatatctgttttctgatcgaaggacctaatcgaattcgttgacaagttaagggatctcaagtgaacttattccgtactactttgggggcaggcgagacaaaccgttccagaggcccatcgttgactcgtggtaggcttgggactaggccaggtcaagtgccgcacatggcccagagcccagacgaaccatgagtcgcgcgtgaatgttttttttaattttcaatttattttattaaaatatttaaaaataatttttggttttaaaattttacaaatctacagcccaacgctttctgagagggcgtttttaagaaaacaccccttctaaagagcgttttatgtcatggcacatatccgttgactcatggtaacgtggaggacacaccattttgcaggtagcctcctccctgcccttgccttatcagctctgagcccgagatcagtcaagccggcatgacccgacttacacgccaggctgagccgggctcgccacaggatgcactaacggcccatgcatgacccaataagattcgggccgtgctgagtcggtccgaaggcacagaagcccaccgaactcctccttggaataagtatattttttatccctcacctttctgggccatttccaaatggttagaataagtctatttttcattcctcatccctcatcttgtttgtgtcatgggccgggccgtcggttggccatctatacttgtcgggatagatcagtagctcatgtggctgtctgaaaccatgagaccggaattgatgggcatcaaagataagctttcacggtagagctcgataaatcgtgcgcttcgacctcggaagacactcagaaagctagcaatcaatcacagatgaaactgaaatcatacgtttgtctactgctctttttaccccaagagcaaggaaaacaattacggtgtactcaagacagcatatagtacgaaactgaaatcacccaaagtcccagtcatgaacgacccatctctgtggtggcccaactcggtggttacgtgcgtcactttaatctccacccaacaacacagcccaccacctcattcaatcatccttcaatcatttcccacgtcatgcgctggccgcttccctccacgactccaccagccgcgccaacgtcacctccgactcgccgccgtcgcgcagcgccgccttcgcccgccgcatggccgccagcgtccgctccaggagcgccctcccgccgtcggactccatcagccaccgcaccttcgccgccacctcctccgccttcacggtcccctccccgacgtcgtcgtcgtacccttccaccgccacggccagccgcatctccttctccaggaacaccctgttcatccgctgctccgcgtacagcggccacgccagcatcggcacgccggccacgatcgactccagcaccgagttccacccgcagtgcgtcacgaagccgcccaccgccgcgtgcgccagcacgtcgcgctgcggcgcccacgacttgacgacgagccccctgcccttggtccgctccaggaaccccttggggaggagcgcgtccaggtcgggctccggcggcttgtcgaacttcttcgccgggtcgtcgctcggcgggctccgcaccacccacaggaaccgctgcccgctcgcctccagccccgcgcgccacctccttgatctgctccgcgctgaacaggccgatgctgccgaagcagaggaacaccacgctgccgttgggctgcgtgtccagccacgccaggcactcctcgctccggttctcgcccacctccgccgactttatcagcgggccgatgcagtagacgggcggcgtcgagacgcccggaggcgcgcagctccccgcggcaatggtctcgacggcccgcggctcgagcgagcggaatgtgttgacgaggaagccctgggtgcggcagaggtcggcggacgctttcagaaattccgcgtaggccgggtcgtcgcgttccatgagcggcaggacggagtgcgtcgccgggaacgaggggatgccgggggcgtgcacgagctcttcgcccatctccccgaagttcgccgtggtctgagcgtgcaggaccgggaggtacaagaagaaagccaggatctcggcgccggaagtgtagaacatgtaggcggggacacccagctcgtcggcgacgtcgagggcggcgttgcagaagaagtcgatgatgaggacgaccggggaggcgccggcgaggaagtcgcggaggccggggttggagaggcgggtgacctcgaaggtgagcgactcgtggtgcttggacgccactggcggcacctccaccttcggcagacggtggaacgtcatggccgggttggccgcggtgacgccggcgaggaaaggccccgtcgcgccggtgttgccgtacggtgggtcgacgacgacgacggtgacggcgaggccgcgggcggcgaacaccttgccgagctcgatcatggagaccaggtggcccatgcccggcgacgggtagagcacgaccggcttccgggccctcgtggtggctgcgtcgccggcgtccatcagtccgtgacggatcgagcactcgagcaggtatagaatctcggatgcgtcgagacgagtggagatgggagcgacgacgaacgaacacgtaaatagaggcgcgacgaacggttgctgcgtcacgagtcactactccaacccccgtggtccagtggtagtggtccagtggtgagtggtgaccggtgagtggagacaggatttataccgccgcgatgacgagacacagactgaaaggacacaacccccatttccgggaaaacccccacaacccccatttttggctacaggtattttaggtgtcacgccaaaattataagtttaattgaaattaaaacgatatgttggaaaaattagaagtttatgtgtgtagaaaagttttgaggtgtgtttaagccgtgtttagttcccccaaattcccaactttccatcacatcacatcacatataaaacttttctacacacaaaactaccaactttcttccaattttaaaacttttccaccatcaaatacagccttagttcacgctaaaattggaattttggttgaaattgtgacggaaaagtttgaagtttatgtgtaggaaagttttgatgtgatggaaaagttggaagtttgaagaaaaattttataactaaacacggccttgatgtgatggaaaagttagaagtttgaagaaaatttttggaactatgtgtttagttcacgctaaaatttaaagttttattaaaattggaacaatgtgataaaaaagttgaaaattttaagaaaaaacgagcatggtggcccgcgcagattgcacggccagcatcattatattttctcttatataatagcatatatgttttttcaatgtattattcaaatatattaaaatgacaacataattttaaattttatactaactttacgaaactactaatatgtaatattcatgttgtattttataaatgtattagttgttaattatttttaatatcaaattttagttatttgtaaattatatttctatatggactctagtctcgtctttcaatatttctttttctaattccgaattttcgttatctgtaaattgtatttctatatagactctaggctcttcttacaatattatttattttttaatctgaattttttattatttataattgtatttctatgtggactctaaacttatctttcaatattctttaatttttaatttcgaatatcagttacttttaaattgtattcctatactgactttagtttcttcttcccatgtttttttaatttcgaattttagttatctgtaaactatatttttatacaaactttaaactttacttttaattttatgtttattctgaattttagttagttttaaattcctatatagactctatactctatttctaatatttcttatgtttaattctgaatatctattatttcttaattgtatttctatatagactctagtctcctcttctaatattccttattttttaattccgaatttcaactatttctaaattgtatttctatatggactctgtttttctttttctccaattaatataagaatttctaagccgtgagagcgaacgtggatgttactttttctattcttttaataagttaatagattgggaactaaacaaggcctaaactcggccttactctactccatccggaacccattgataatccaccagaactgctcgccgaaaatacagacggaaaaaactactgttgtcgttaagactggtcacgtacagcggccaacaaacatgacactgccttgaagtcaggaaaatgaaaaacgcctataagtccttccctcgttgcgccagctcagattttcaccgatgtgaagcgggcgaccgcgctttgctaggtttctcgcttcctatgtgagcgacgcagaacctcgccaaaacgaggacgcgcagcgaggagaagacgagggtcgcgcacgctgtggacagcgtagcctcgtgctcgtgtgccctagcgcccaaaatccccttccgccacagcaatatcccctattcgccctcccaatatccccttccggcacagatcggattggaagagcaaagcaaaaaaaaatcttggggattgaaagggaagaacagatcggattcaacaagatgaaaaagaaaaagaaaacaaaatcatcacaggattcgcgctgcatcagctccaaccgtcacgacggcggcaacgtcgccgctggcggtggcgttgagggcggcgaactcgtcgaggctgatgaagccatcgccatcgcccacgaaaaaccccaccccgatctcaacggcgtcggagcatggcattgccgcgcgccgcgccttccccatccggcgtcgagggggggggagcagcgggtggtggtggtgttggtgatgacgtcggcggcgccaactcgagctttaggcggcgcggtcgaccgggacgaggcgccacggtcgacggaaggcgaggcggcgcggtcgataggaccggggacaacgccgccaccgtgcccgatgtgcagccgtcgcacgttgtgcggcagcatccgctcgagctccgccacgccgccgcggcgtgggaggtgagaaggctcgccggcgtgggaaggaggagtaggagggggccggcgcgcctgagagaaagagaaggggcgaggtcgcgagaaagagaagggtaggtgaggaattaatttccttcacctgcccgtgtcccccgtgcgctagggtacgctcactatgggctttgtacccttcaacaatagctttatcttattaggtcactcaataaggtacttatattgtgagcttgagtgactttggaccattttcttaggttaagtctctcattacgtgccttacaatatcaataccttaaggtggtgggctatacgatctaagtttaaaatcttatcccttataattatttgtattaggttatttcctaatattcttgtttttttaagtaaggaagacacattcgaatcgggtagttggatcgaaggattgtcggcttgtcgcaatgtcatcgattacgaatggaaccacgtcacccgttcacatgtttctcccgaacctgcatgacaaattaaatactagtaggttataaccaacgccgagtttatatactggagtactactccatgcatggttgatggctgatgtcattgctaccgtatgtgtgtgcatgtactctctcatctcaaaatataaagcatttttagtatagtgataatttaaataatttaaactttaactattaatagcaaaaatataaaaagcatcaatcacataaatttgatattaatagatttatccttaaacaaactatcataatatgcatatcttttttatttaaaacatattaattttatagatattattgattaaagtagtatctcgaagattgtatcaggtaaaaaaatacttatatattttgaggcgggtgagtatataattcgtgttatgcatggccacatgggcatatataggagtataatcctagggggtctgtgttatgcgatggcaatgatacggcaccgtgccgatagccaaacttaagatcttcttttgatttcattcgctatttcacatgatttctatcattttcatacttggtattgccaaaatacccctttggttggttaaatcaagatgagctggtcgttagattctaatatattgacgtgtaattttttttcgcgttcgtgaaagctggttgttagattggcgcacgttaaggcccaaagtgatcgaagcggccgatgaatccgatccataaggaaaaagtacacagaaggtccctcaacttgtcatcgggataaaaaaacgtcctcgaaccgcaaaactagatatgcggagtcccttaactatacaatgccggtcacccgaggtcatttgatggttttgaccccggttttgatctacgtggcggctaagtcagtgtggtacccacataggccccacatgtcaggtgtccacgtcaccctctctctttcccctctctttctctgtttctctccttcctctcactctttgctctcgcactcgcagggcatggggatgccggcgctagggcgcccatggcagcgcgcgcggccggaggatggtgcggccggtgacgggggctcctagggcggcgcgagcttcccccaggtgacgcacaggctcagggagggagcaccgagaaccaatccccactacaagaatcctgttaatccatgatgaaaaatatccgtcacggatcactagaaaaccatcactaaacagcatctgtgatggtttaagaaatcatcacggattgagagtcatggattgacatgcgtgacggtttgtcgaaaaccatcacagagtactagaatcagtgttttaaaccgtcacaatattgcccaaggcctagttagtccaccccaagcccatttctgtgacgaaaataaccgtcacggatgaattgccacatcatcatagatgcttacatggttgcttacatggatgatgacgtggacactacctcagcccatttgttaacaggccagaatcaaagatgggccaattttggcccaatttcagccattttcgcagcaattttccagccatttttgcaagcccatttcagcatattgcagcccaaattcgtcactaatttttagcccactcttcagcccactactgcagcacatatagcccatatacacagcccattgttaaacattcagcccacacacacagcccacaaggaattaatgtagcagcacattaaataaaaaaaatcttatgtttccatccaacaacatatcacatgaattttcatccagcatcacattacacaagtcttcatccaacaacagttaccatacaaaagtgcacacaaccttatagtttaccatggcacaagccaataacacagactcaagaaatgcatacaagtccagcagcttgattcatgcagcatgcagcagcagcaaaatgcaagtagcagcaacaaaatatataccaccatgtatgacttaacctggtcgaaattgacttcacacaagttagcagcagcaaaatgcatgtagttataggcaaaagatatgcaccatgcatgtcttaacttggtcgaatttgactgagcaaaagattaagttttgcttccatctcagattgactcctcttcatctcctctcggtctttaatccttgcctgctcagattcttgcactttgtttgacaaatcagccacctgtgcacgaagctcagcattggcccttttctccgcttctagttctgtctcagtgctctgctcactgaatctaggctgggcattattgaagcccacattctgcaagaaccgattcttcttggtgttctcagcaagcacgtcagcaacaacttgagccgctgacttaagttcttcaccttctgttgttgtagatagcttgttttccatctgagtctagcaagaaagtagcaaacatggttgatgttgagagaattaaaaataagcactacaaagatcaaagtctgaaaattatcttacaatagcctcctgtacaactggggtgtagcattttttttttcttgctgtagtggaactccttgaataaatcaaatgcattaggttcttcatcattgtatttgtcatcctgagaacaacatatatgcattaggtccagcatgaattaagatgttacaaaaatctggacagctactgttcaactgaaaatctaaaagaacatgttcaactaatttctagcctcattcgttgcacacagtcactatgttttccacttagacaaacaactgcaacagaggtctttcactgcatacacatagacataaaaacaataacttttaatctattaacacactcaacttagatatagatggaaacctaactcgtcacctgtcacacaatcatgtattggcataatgtagggcggcggtgctgcagatctacaggatggcgttgtagggcggcggtggtgcctgatgtcgttggtcggctggtgtgcagcggtgatgcgcgatggcgcggcaagcaaggaggcggcgttgctgaactacgcggcagtggtgggcagcggcaacgccgctcctgccaaatttcgccgtgggcggcggcggcggtgtctcagattggtcgcggctggatgtcgaacattacggttggtctgtttggttgttgcctaacattggcataactcaatttgttataggtgtggcatggcaaacaaattgtggcctgttggccacaagtgtggcaatgtttggctagaaaatgagtatatgacatgtaggcccatgaaacaagaaagtatggcttgccataactgaaacaagcaaccaaacactaagctaacaatctgtggcatgcctaacatgtggtgtggcaatgtgtggcatcaaaccaaacaacccctgaggggttgaggtaaccttactcctccgtacatacacagaccaaaattagtacagaatcctacaataacacatcaaaccaactatcgcagtggtaggacggggtgccttctactggcaggtcatgggttcgattctcgttgggcgcattttgtacttctattttaccaattcgagttcttttttcctttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgttgccatctctttgtgatcaaagattcgccggtttcgctccttccaaatttcccaaactactagcaggataagggaccgaaggcccttctttggaatgccgggtgtattagctaggctctcccaccactgatggactgaccgggcttcctcccattgggccggttccaactgctgatatcccgcccatgtagcaacgaggcgccagattctcttcgtgtatctacacatggcgacgaggtgcaaggctgtctcggtgtcacaacgacatagggggcaatgtccgttattccgccagccccttgtcgcgagtcggtccgacgtccagactctattttgaatgatgagccaggcatgaaatttacatttccctggcgcccaaactttccagattagggagttgaagtttgtgtttggcgcccccaaacattgggcatgataagccgagaaagctgtatagtggccgctgcttgtgaatttccaaacaatctgatccggctcctcgctgtctaagtgcacattccgtaccgcctcccacaggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccattaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttctccaagcttaggacaccaaggtccccctggctggtcggcaagcatgtctttgcctagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaattctccctgatattttgtcgaagaccggttgcaagtccgtttttcgcagtcttcccagaacaagcgggaggcccaagtattttagtgggaaatttgctcgcctcgccggaacgccttggaggacctcttccaggtctatattgccgcatcttatggccgcaacctgggatttctgaaggttggtgacgagtcctgtggctgtgccaaaacgatgtaggatgttcgcggaagtcgcaacatcgttctaggtgggattaatgaagatcacagcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgggaagcccttgcgctgcagcaaggccagtaggtaatcccatcacacggagtcgaaggcttttgttatatccaacttgaagagcaacattgcccgtcttaggcggtggtatcttctgatcatgtttcttacgaagaggtagttgtcatgaatacttctcccctttatgaaagcgctttgattgaccgagatcaactcatgcatgtggggccttaaccgcagctctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacctcctcctcagtgaagggttcccccagcgtggctagatcaatcggtgtgatgtccaacgtctcccagtttagctcttttggcctcggccccggcctccctatgaagcttgcgaagtgatcatggatcgtcaattccttttcaccgtgcgtcaccgcccaaccactgtcctttttcaatctttggattgtattccttctccttcgcgcattaaccctgaggtggaagaacttcgtgttcgcatctccttcacggatgtgagttaccctggaggcttgctttttccttgccctttctatagaagcgagtcctaggactttccgcttgagagccgccctcagtcgcgtttccgggggggagagttctctgtgctcttgtgccacgtcgagtctttggatgacattgagtgccatatggaattgcaatttagcctctgagcagatgccttttgtccaatctctaaggccgaccgccgtacgttgcagcttttgattcaggcggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggcaatggtcggatggccctgtaggaagggcatggagaacatggtgggggaaagcaagatctcattcctcattgcaaaagcaacggtcaagcttgacaagggttgcctttcgacgctcattactccaagtgaacttcctgttttgcagggggatctcatgcaactcacatcgatcaatgactacgcgaaaacgtctcatgcgtgcgaggttgaggttgctattgtttttgtccctagcacagtagatcatgttgaagtctccaaggatgagccatccttccccagggctgggccttaatctcctaatgtgccggaggaacgaatctttgaggtggtgccttgttggcccgtagacaccagtgaggaggaacgtaactcctgagcgaatatctgttatttgcgcggagatcgagaagcggccgattcgaaactcttggacatcaaaatctccactactccaaaggagaaggattcctcctctcgtgcctctcgccggcttgaaggcaaatttatcaagcttgtagcctcctaagaaacgagcaaggccgtcatctatgctttggagtttggtctcttggaagcaggccaaggtgcactttgtgtcaagcatgagctcatggactgcgttgcagcgcgcaggtgagtttaggcctctcacattccaggagatgatatctagactttgtgccatttaaaaacgaagagttctctatatctggaccggcccttagcctcttttaaaaaaggccacttcggggcgcatggcccattaacgtttggcggcccaattcgcaagtctgtgttgaaaaggcagcctttgggcaggcgcggcctgatacgcacgcggcccacgagctggcgcatggccggtcttgtagtgcgcgcgtggcccaggtgacgcatgggcagtcttgccgcgggggggggggggggacgcgcggcccaagcacgagtgtgtgcggcccaaaagccggcccgtgaagaggcgggggcgcgtccgagcgcctgcagggtgttcgaccgcgggcgacggccatggagtggcggccgggtccgaagtgggaagcaagtctaacaacagtctgtcggagcgggtgcaaacacaacagcacgcaagtggaagaggaggaagacgaagttcttgccaacattggctacaaaagcacaagtcttttaatgaagttgggcaggttgcacgcaggccgccggcaatccaaccaggagaagcagctcgcaggccgccggcgatgtaatcgcaaatcgaagaaggacgatacatggagcgaagtggactccgaaaccaactccagccgaggtgaatacgcattaggcggcgacggtgtcctcagcatcctccaccgcgtcggctataccttcgccaactagagatatcagcgccgcatccattgtctcctgttcttcgtcgtcgatgccgaagatggtggtgagggcggcgatgacgtgcgccggcaatgggccatcgaacatggcgacgtactcggcgatgacctgctcaattgaagcgccttcttcgccgttgaggcccagccttttgaagagaacgcgttggcagcgctccatcgtcggccgtgctggttgcttggcaatgcgctcactgcgtcgggtgggctggctgtgctgccttgtgcggatcttgaggcgtcgtcccatgtggagcggtcgcgcacacggcgatcttggtggcgacctcggcggcgaggcgatgatcggttgcggcggcgaggcgaacagagcatcgaggacgcccgtcgagatcggtgacgccgaggctgctgcttgggcaagctgggtggcaaccggggaaggtggcggcggcgccacaat

SEQ ID NO: 34969 - DNA, 36558 bp, Oryza sativa
  unsure (1)..(36558): unsure at all n locations
ccccctgcatcatcagtcatttccaagttgacgcccccccttgtggcaacgggagagctcaacaccgggcgttgggctaatgccggcgaggtgacccgcgggggcggcgagtcaatctgcgggaatggctctcccacaggggggtcggtcgccgcagccgccagctcaatccgcaggagcgcctcctctacttgttggcaagtagtcgtcgaggtaggcggcggcagcgccgacttgatgcgcgcgaaggcgtgttcgaccgggatcggctcccaggccgcgttctggaaccaggcttcaatcctcggtttggctgggcgacccgagagggctggcgtggcagccttgtctgcgatgatggagagccgctgcagttggctcaccggcgacaacgcgttcgtctggggttcctgatacaagaagctggagttgtgcagtgcgtggagcaaacgaaattcacctacctctgcctggttcgcggatttgtgtagaaggggaatgttcatcagtttgctcgagtcgtagaccggatcagccgtgcgccgcgtgccgccgccgctacggttggcgcctcccctgtcccggcgacgcggggagcgcgtgcgctcacggcggtagtcgttgtcgcttccccgcctatcatcccggccacggtcgagatcccggcctcggtcatcacgatcatcatcgcggtcattgcggcgccagggtctcgggtggtcattgccagacccccgacgacgaccacgcccgccgcgcccgccctgatcgcgggcatggcggccatcgcgatcagcacggccgtcgcggtcgtcgcgctcgccatcccaatcatcctcgtcatcgtggtcgccttcatcatgaaggcgtcctccccgtgctgcgcgtccacggcgggatcagtccgcgcggccatcgatggcgtcgcggtcagaccggcgttctggccggcgagcctcccggtgcgctcgtggaccgatcgtggcggcggcgggtggtgcgggaagtcttcaaagactcgccctgggacctgttcaccgtcgagcactcccaggctccaaggcggtaggcggcgcttggccggctggaagctgccttgcccctccaaatcaatggtcgccgccgtgtagtcatgaatctcctccaagtggaagagcaccggatggcgcacccccctctgccagtgctccagtgggttctccaccgcaaataggggcgccaggttcgggtccttcgcccgctttgtaaagccaagccacatcctcttcgggatggtgctaggattcgccgtccacgcccataggtcgatggagcgcgtgttaccagactccactgggtggacgacgtctgtctcgatctgttccagggcgcaagtgcgaccaatgatgcgctcagcaatgtccgcggcccaggcatgcatggggacgccgtcaagacacaaccgaactcggaacatcaaggcgacaccaagcgcgctctcgaggctgcgccacttgatgaagtggatctcaatgccgtgccgcttgacgtatcccttcgccagcgcttcctcacaatgttgacggtgctggaacttgatgaggaaagcttgtgggtgatggagagacacggccacctcgccacggcggagcttgaactcgtcgaggaaggcctgctcgacgtcgcgcggctcggtggtcggcggagcgtgggccgcccaggagaccactgcggtctcactccattcacgcagctcctcgtcaatggcgtacgaggtggggatgaagcaagtgtcctcctcagggcgcgtcgccgggtcgccgagctgcgacatcttagccaggggcggtcgcggaggcggcgtcgggggccgggtgacgggatcctgcttggcgggtgatggcagtggagcaggggaggcgcggttgcgtggcgaatgcgctggcgagcgggcgcgacgaggggcgggggggtgcgtgtcaggaaggcggcgcgtgttggtacgacggcgaggtggagtgcgttggcgaggcggaggcggggagtgtgaggtagaacgaactcgacgtggtggaggggacgagagccgagcacggtcagcgcgagacgcgccgcggagtcgaggcgtgcggttcgcagcgtcacggtggcgacagtcgcgcgcccgatggccggagcgacggcagaggaagcagcggactggatctctacactgggctgcacggtggccgcgggagaggcaaatgaaacatttcccactgatctgcgcccaaaagtcgcggtgggagaggcagcctcgcctagtccggacgacgtcgtttcgccttgaaggtggccggtgcgccttgcttgaatgctctccgcttgaatgctctgcacgtctccaccaatgccaactccagctgctaggccacgctgtgggcaacatcctgggccaactcaactcgagtgaatggcattaatgggccacgccaacagggatgctgggccaataatatagataaataaaaatatataagtgcagaattggacatctaaaacaagtgtttcaaatggtaagacatatttcatatcttcctgctcaatgtgggttcaaatccaacatgctgcggattttttccccatgcgcaccatatttttttagtttgccatattatgcatcatatacatgtaacaaattaacaaaattattttgttcaaatttaacaaatcatcatatacatgtaacaaataacaaaaatattttgattttttccccatacgcaccatattttttttagtttgccatattatgcatcatacacatgtaacaaattaacaaaattattttgttcaaatttaacaaatcatcatatacatgtaacaaatcaacaaaaatattttgttcaaatttaacaaatcgtcttttgggtttgattcttcttgcaatcatattttttgtttttctttgcgctacaatttttttatttttctaggctaactagagtatgatgaatgtaaaatcatacattgtgacggttctgataaaaccgtcacgagttcgcgggctatgaatatccacagggctcatctgtgacgaaaaacaaaatatcgtcacggattacgtttgtcagtgacgatccataaatccgtcaccgagaatccatcacggattaacaagtttcttgtagtgcccgcagcagcctccaccggctcgtggtccagcacgacgacgtgctcgccgcggacctccccgctcagtgccgctgcacctctttgtcatgggctgctacctcggcggtgccgacgcgtgcgccgagctcgttgagagcggcaagctgtcggtgatggtgaagaggttgggggaggagcggctgatgcaggagctcgctagtagggtccgggtgctcatgaacccgacatggacgacgccgcggaggtggccgggagggagaagcggagcacgccgtcgatgcggcggcggagaaggaggagcacgctggccaccgcgccgcggcgggatccggcggggacgagggagacgacgacactgacgagaaggagaggatcccgtcgggagtagcgagcgcggggcacgctgacgccgacgaccaccatgccaaccgctagggggctaccgcctccacaggctccgcctccgccaccgctgcctactggccgccacgcgctcgactgcccgccgccaccgccgcgcatttgctccactccgcttcgctggccgtcgcgcttgcacgccgcctccgcgaccgccgtccttctctcccgcctcgcccctgccaggttacagagaagtgagagagaggagtctaacgtggataaccctgacatgtggggcccacgtgggtcctacggtgactcagccgctacgtagaccaaaactggggtcaaaaccaccgaaagacctcgggtgaccggttttgtatgcttaaggaaccccgcatatctggttttgcggttgaaggacgtttttttatcccgatgacaagttgagggaccttcggtgtactttttccgatccataaccataatcataagagcaggtataatagcaggctataaaccagctataaacacatttcaaaaagataaaagaggagagagaagggcagcgctccgggttacagatttgtagctagctgtagcacggactctaaagtacatatgtgtatgacaaatgggagcagatattaattatgtagtatatgtttatagacaactattgtataaattagctatcaagttgactatagatgatttggagccagcaattgactatactattaagcttgctctaagcagaaggcctaccttcctttgcggcttcgggacgatacgatggttacgcgcagaccggcatgacgccccgtttgagaggacggcaatcggcacggtggaaaacgaggctgaaatccagacaaacctaagctcctgaacgcaccaaagccaagcgttctgaacgcaccaaagctcctgttcaaccgagtaaccaaaccatacatcaatcagaagataccacggtaccaacaacaaaacaaaggggaataaccagcaaccgtgtcgtggcgagctcacaaatcgtgtcacatcatgcaacttgcaaaacaaagtagaaattcagaaataactggcagaaagactagaggatttcttagaggaaggtcgccacaaatacctctgacatgcaagcatgaagcagtggcgcacccagttcagatgtctactccataatgggcgaaaagccgagtaaacaagagaaaatttagataacaatcagcgatcagacgaagttaatgacatttgcttacgacggtgcagccagcaggcgcctacttgtccgagacgcatccaaaaacaaggctaaagaacaacgacggccggtacgtgtcgcgcgcgcggatgatcagaaagaatcgacgactatcaaacccaggagaggacgagcagcaacacggtggagaccatcacgaagaccctcaatggccccagcgccacgccgctcccggacacggcgaacgcgagcgcggcgaccgcgaggagcacgctggggaggcggcgcgcgcgccgcctagcggtggcgacggcccggaccacgacgagcagcgtgacgacctggacgagctgcaggcgcgcctccagggcgcccacgacggcctcctcgagctggtccatcagctcggccgcctcggcgtcgacgcccgccggcgccaggcgcctggctcgcgcgagcaggggcaccagcatggcgaggcgggcggcgttgtcgcgcatcctggcgtgggcgacgtcgagggcgaactgcacggtgtcgacgtcgcggaggagcgggaggaggttgcggagcaccaacgggaccatgggatgcgcgttcgccattggggctgggtgggagggggcgatccggcgatgcagctgtgggttttgcggtttggagctaagaccaaaagggggttttggtcttggggtttttggcattttgcagtggaaagggagaaagaagatgaggcgagtccgcgagtggtgcagggatgtcagattgtcagagtactttgtgtgccaggcttaacttgcgtggaacgttagcttaaatcagcaagtgcttcgtttaagagctgagaatcataattaggtctactcctactagatgctgataccgtttagtgatgacaaactggagttgtgttcttatttgacgagccgagtttagatacaaagtttctcttcgaacttcaggtgtgtagttaacgttaaaattgaaagtttggttaaaattaaaacgatgtgacggaaaagttgaaagtttgtctgtgtagaaaaattttgatgtgatggaaaagttagaagtttgaagaaatattttgcaactaaacacggccttctaacttttttatcacatcaaaactttcctacacacacaaactttcaacttttccgtcacatcgtttcaatttcaactaaactttcaattttagcgtgaactaaacataccctagaatgtttactgatgccaatctagctatccaataaaggctgtgtttatttcacactaaaattagaagtttggatcaaattgagacgatgtgacggaaaagttagaagtttgtgtgtgtaggaaagttttgatgtgatgaaaaagttaaaagtttgaagaaaaagtttggaactgaacaaggcctaaacacggcgaaagacaagtaattctttcaaaatttgttctcctttccctcgagtccaccggaggtccggactagtatactaaagagttcattcatccattgcaatggccaatggcaatatggcatgcaaacggttttagttgtgtagtatggtaatttacttttttttatatggactagttatacaatgttattaggtggcttatggactatttttatattatatcgtggatgtcttaaaggataactaatttagaatggagggagtaaagttgatcaatgatccctatgcatgaaaaaacaaagcggaaaaagagcagtacactactccagtcagcacaagcattccagcgagcaaacgtagggtgtgcttggtttgctaccatgttaaaatattggtactatcaaaacctagacaagttttggtagtgccaagatttcggtaactttttatgtgctattagtagcaaaccaaacactattaaaatactgttcaaaatgccaaacaatttgataaggcatattttagcttcaaaccaaaatggccgtactatcactccgatcaatgcatttgtagcacaactgtgcagaacacttgcagcagggtgcaggcgttcagctcaccacgtttcacggacaccatcactccgatcaatatactccatcagtgccgggaggtcagctggacaggttatgaagggctgttttggatttgcccatattttggtagcttgaatatttggagccaactaatttggttatgcccatattaaatttggtagtaatccggaatattcttcactatagtatcacaattcggctctagttggaagtaaaccaaacatgagtacatgacattataaacttatggtagtgccaaaatcgcctctattttttgtactatcaaagaattggtaaagtactgaaccaaataaacacgagcaaacttagcgatacaccacaggttcaagacgacatagacctcgtttgctcccagatgccactcgccccatcgaagctctggcaagtggcaacaggggatgatctggaatgcgtcggtatccaaacagccagaacagctgcaggatcgtgactctcacgtagcttgaacatccaaacgcatcacttttgggggcccccgcgtcgctcccagggcaggggcgacacgggaggcgactcagccgctgccgcagcaccacccctcgctgccctccttccgcctcgccaccgcccgagcgggctgccggaaaccgtgcggccgcaaggacggcggcggcggggccttctcccccaaggtcgcggcgttagccttagccctgacctatcttcggggcggcgacagcggcgctgggcgacggcgaggcggcggaggcgctgggcgacggcgagcgcaaacgacatggcgaggcggcgctgctggatccggcgtctgctgcgcggatctggcgcgagggttgccccgagccggcggcggcgcgcgcgggggcggcggggtggccagatccggcccccttctgtccggatccggagcaggaggccgagccctgaccccaggcggcaaggcggcgggtgcggctgtgcagagccggcgagggcgaggctgtggcgcggccgtacggagcgaaggcggcatggcttggccgtgcggagacggtggtgcagctgtgcggaagcggaggcgcaggcgctgaggtggaggcgcgggaacgagccggctggtgcggcgctgccaaagaagaagcgtcggctggctagccggccggccggcagcggcggaggcagcgcgtgtacaaggtgcgactggcgagagcagaggccagtgaggctcggccggtggcagcgnagacgnccgtggtgcgtgaaggtgcggtcgcggtgctggtccagcgcgacgagnctgcccggcgtgaagncagtgtctggtgcggcgggaggagaggccagtggcccggtgaggcgcgaccggtggcaacgcgcagagactggccaacggggggcgccggtgcagtggtgcctacgctccggcggaggttttggatggcggtggagcaatggtacatgtgtggtagatcgacaggtggtggacggcgggtgaaaacctagcccggccttggccggacaggtaacgatgacgttcgagtgtcattcccctcctgagggcgttgtcgtgccgtcttgcccctcaaggatggttgccgagcgaaagctcggtctcggctctctttgagaccttgacggatggcggtggcggtgttccgtcgcttctctcgttggagatgtcgtctaggcatccccttgccgaaaccccccgagcaattggtgcaagcacactctagattctcaccctcttgtggcggcgtcctaatttctacaagttggccacgtcggagggcctaggggggagaggtgttccatcttctctcacaccctctctccctgaatcctgaagtcttggatagagttggctttgtgttgattgtatgggtcgggttttgggtgatctcggcagtgttctgttgttggcctagcggcggtcggtcacgcttagcggcggctggtccggtgctagccttctcctggatctgtgtgttggcactgtcggtgtgtgggtggtggtataattttcttttttcctggttacgaccttccaaggttgaaatcttgtaattttttttcactctatcaatataacttcgcaccgtctagtgcgagtcgttcaaaaaaaaaaacttatccagaacagacagaaaaaaccattttacccacgagcttgactctcttaaccaaaatccacccgcaacagattgtagcagaaacatggcgtggcaaaggtttaaacagaacacacaacacattgctgcaatcagattctagaaaattcgtgaatggattaatcatgccatccaagaaggcaagaatttataatagatccagcaaatgaattggcagggggagatcgaaacaagatcggcttggatatctctgaacagaacaaggttttcgcatcagaaatcaccttgtctcaactgtcaaaatcagaaggggagggtgaaacaacaagacgagcaaaaaagcaaacgaaaaagctaatctcccgatccatctacgctgctcaccaccggaaagccaaggaacaacacgaacgcggcgccgtcgcgcgcgcgcgcgacgtcgaaagatcaggcccacccggtagcactcgaagaagccgcacatcgccagagcgaggatcctcgcgaggctcctggacacgggcacgccgcgcctcgactcggcgtacgccaccacggccgcggatccgggcgtaaccgagaggagcacggcggggatgaggcgcgcggcgcgcgtgacgaaaacgtaggcccggatcatgaggagcgtgcagaccacctggtccagctgatggcggcgctcccggaggagaagcgaagaggccctgatatcgtcgtggatcctctcgagggtgacccgggcggcgtgccgctgctccacgccgtccacgatcatgggcggcgacgccgtgacctcgcgcaccaggcggcggacgttcctgagccgagcccgcgccttggcgaggtgggcggcgttgtcgtcgaggtcggcgcgcgcggcgtcgagcaggatcttgacgtcgtcgacgttgttgatgaggtaaacgccgaggctgtcgagcagctcgtcggccaagttgttcacctccattgctgtgcgtgggttcttgcgcttttggcgtggttcagtgttcttctcatcttctggccttttctgttctgggggatgctttttggactaaaacatgggtggtctgtgggccagacttgtcatggtgtacaatagcttcgtggtagactgggatgttagattagctcacactgctaatccgcaatcaacactagtccataggagagaaaactgacatgattatggctctggtgaatttcaaatttcagatatcaaacatttttttcttgcggaatggatcaggaaaaattctcacatttcactcccacacatcgacagcgcgagcgaaagtagcgacacaccagtacaccggtagcaaaaattaacgtgacataatcccagatgtcactcgctcgcccaaccgaagctgtaacagtgggggatgatctggaatgcgtcagtaactcagtatccaaacagccagaacagcggcggcagtatcgtgatcctcgcgtaggtcaccgcgcgtcatctcgtcgactcgtcctcgtcgtcaaccccttcgagctcggggcggccgaacacctccgactccacgtcattctcaatcgcaacagctttgcagcttcacatccctttgcagctttgcagagataaccatccaaatcaaccagaaacaggttgaagcagaaacacagcgtggcaaaatgcttaaacagcatatacaatgcatcgctgcaaccaaattctaaaagaaaaacatgactggattatgaatgtcctagaacttataatagatcgaccaaatgaattagcacgggaaaaagatggaaacaagatcggcttggatatctctgaacagaacaggttttcccgtcagaaatcaacttgtctcaaatgtcaaaatcagaagtagacggtgaaacggcaagatgagcaaaagaaaaagaaaaagctaatctcgactcatctacatacgatgctcaccaccgaaaaagccaaagaacagcacgaacacggccccatcctcgcgcgcggcgcggtcgatcagaccaggcccacccggtagcactcgaagaagccgcacatcaccacggcgaagatcctcgcgaggctcctgaacgccggcacgccgcgcctcgactcggcgtacacgagcgcggcggcggatccggccgtaaccgaggcgagcacggcggggaggtggcgcgcggcgcgaacgatgaagacggaggcccggagtaactggagcatcaagatgagcaggcgcagctgccggccgcgctccaggaggagaagcgaggacgcgccgaaatcgtcgaggacctcctcgagggcggcgcgcacggcttgctgctgctccacggccatgggcgcggtcgcgacctcgccaaccaggcgccggacatggctgagacgagcctgcgcctcggcgatgtgggcggcgttctcgtcgaggtcggcgcgcgcggcgtcgagcaggatcttgatgtcgtcgacgttgttgaagaggtgaaggccgacgctgtcgagcacctcgtcgaccaggtcgttgtcctccattggtgtgcgtgggttcttgcagttaggcgtgtccgcgtgtggtccgtgttttgcggactgtgggtggggggatgcgtttggactaaagcctgtgagcctgagtttacagagtatcaggtttttgtacgtacaaagctagcttagcttggcttgggtagtttggccagttgggtaggagattgggaggttagattagctcacacttctaatccgcaatcaacactagtccatactagtccattaggagaaagaactgccatgattatggctctcgtgaattccaaattttgtactataaaacatttttggttccggaatgggtcagggaaaattttgacattcccttcccacacataaacggatatgatcatatgaagtacccttcaatccctcgtcgtgcagcggaaagccaattgaacgattgcgagcgtacgttcacgccgccaaccacaaccgcaccgctcgacgcggcgcgcaggacggggaggagccagatgcggcttttgtctatcgtgacacgggccggacgaggacgagccacgccgcgagacggaccaccagcctccgctcgataacatcctgcaggagcacgagcgccgcgccggccggcagcggcgtcgacgacgtcacccgagtgcgcgggtggcgtccaccaaaatatcccccgccgttcggagctcggcaatcgcgcgagcgaggagacgtcggcgaggaggtgataaagattgaggaacgcgtgcagctccatttcgtcttcttcgtcaaccactccgagttcgaggtggccaaggtcctctgctgcctccgcgtctgatcaaccccagaattcctgaacgggatcgctcatctcctggaacactcacgcacgcgaaaaatgaacagagaaattttgctctgcaaacttcgcagccattttttctgcttcctttctcctctatcgattcgcgaaactgaacaggaaatagccctggtggcctccaaaacacgcgccatgaaacgtcggaacggcatcgcgcaccatcccaaggcttcaagatcatgcctcatcactaaactcttgcactgtgccgacacaactggtcatgcgctgactcaacgaggaagataaccagcgtcatcgtcgtcaacgacggataaacagcacgagcttcacttggtgaagagagtttcccctatcttaattcttaagcatccaaaatccaccagcaacagattgaagcagaaacgtagcggggtaaaaggcttaaacagcacacacaacgcattgctgcgatcaaattctggatcgtgcaaatgaatcactacaagtggactatagcacacgatcgagcaagatggaaacaagatcggtttggatatctctgaacagatgttccccattatcccatcagaaatcaccatttctcaaatgtcaaaaatcagaagcgcgggcgaaacaacaagatgagcgaccaaatcaaacgacgaaactacactaagacggatagtgcagcgcgagcttgacttgatgaggacagcttccccagtctgaattcttaagcatccaaaatccaccagcaacagccaaccgattgaagcagaaacatagcgtggtaaaggcttaaacagcacacacaacgcattgctgcgataaaattctagatcgtgcaaaatttcaaatgctacaataggactatagcacgatcgggcaagaatgcaagatggaaacatgttctgtttggatatctctgaacagattttttttccccatcagaaatcaccatgtctcaaatgtcaaaaatcagaagcagagggtgaaacaacaagatgagcgatcaaatcaaacgacgaaactacacagaagtgatgaaacaaaactaacaaatcatcaagaagcccgtgctaatctcccgatccatctacgctgctcaccaatgaaaagctactagcaaacaacacgaatggcatgtcgcgcgcggtcgatcagaggcgcacccgatagccctagaggaagaagcacatcaaccgggtgaagatcatcccgaaggtctcgaacgtgggcaccgtgccgcgccttcactcgacgtacacgaccacggcggcggttccggccacgaacacgagggccgcggcggggaggaggcgccgcaaggcgcgcttgatgatggcgtaggtccggatgaagagcagcaggttgacgacctggtccagctgcctgcggcgctccaggaggaaatcgacgcgcgccctgagatcgtggtaggcctctacgagaaagacgcgctgcgcctcccgctccacctcgtccatgggctcggtcatgagctcgcccgcccgctgaaggacgtagccgagctgaatctccacctcggcgatctcgtcgtcgttgtgggcgaagtcggagcgcgcggcgtcgagcacgatcctggcggcgtcggggttgtcgacgaggtgatcgtaaatggcgaccacctcgtcgaacagggggttctccgccattgctgtggtgcgcgtggcagcgtgggcgcgtggcgtggcgaggctgcgtgttcggggaatcgggggtggttttgtaggccagagttggggctccgtgacgggtggctttgtgggccaaaggtgtcagtgacacaggtaatcaggtaatcaggtaatcatttgtccagtacaatagaagttagatgtgttcacactgctaatccgcaatcagccaatcgccactagtcctgaggagagaagtgacgtgatcaaggctctcctatgcatttcaagttccatatcaaacaatatgggttccggaattgatcactaattaagtactacttcttcgtttaagagctgtgaatcctaattaaggcctacattacaaatgccaacatggtgatatcgttggtgacgaagccaatgaataaaaaaagaagaagaagaagaagaaagagagaaaaaaaggacaacggaggcaaaatttggagctgtttttcacttgagaaagcttgactgatgccagtctgtctagctatccagtaaagataactgattccttcaaattttgttctccttttcttttgccgcatactggtctactggacaaatgatcggagcttgtcccgtacactccggtcagtacttcgtgcaggaaataacatgtttatactttgcttctgtaaagtaaatcagcaacaaatcatactagtgcacatctatgctgttttatgtacgagatcaaccgtttgtaatcccaagacaccactcgtccaaccgaagttgtaagttgtaacaaaggggattgatctggaaagcgtcagcaactcatgatcactaattaagtactactacttcgtgatccccgcgttgtccactcgtggagctcggccatggcgtttgcgaggacggcctcggcgcggccgacgtcggcgaggaggtgatagagatctcctgaacgcctgcaactccacgtcatcgtcttcgttaaccactccgaactggattgctcagcctcagctcctggagtactccaccccgcacgcgaagaaccgagacatgaacagagaaattttgcgctgcaaacttcgcagcctttcctatattaaggaacggagggagtaccatctatttgccaaaccggacaggggaatggccgtagtggactcctaaacacgcgcaaaatccaccaacaacagattgaagcagaaacaaacgcattgctgcaatcaaattctagaaaattcatgaacgggttataacaatccaagaacttatgctagatcttgcaaatgaattagcaggagactgatggaaaacagtatcgaattggatatctctgaacaaaatttttcccatcagcaatcaccgtatctcaaatttctaaatcagaagcagagggcgaaacaacaagacggagcaagcaaagcaaacgaacctacacaaaagcaatgaaacaaaaccagcacatcatcaagacgcatgtgctaacctcctgatccatctacgcttctcaccaatgaaaagccagcgaacaacacgagcggcaagtcgcgtacgcgggcggtcgatcagaggcgcacccgatagcccaagaggaagaagcacatcaaccgggtgaagatccccccgaggttctcgaactcgggcaccgtgccccgcctccactcgacgtacacgaccacggcggcggctccggccacgaacttgagggccgcggcggggaggaagcgccgcaaggcgcgcttgatgatgccgtaagtccggatgaagacgagcagcttgacgattcggtgcagccgcctgcggtgctccatgaggacatcggcgtccgccctgagatcctggtagagttcctcgagggcgcgctgctcctcccgctccacctcggccatgggccagtccatgatcggctcgtccgccgcacgcaggtaaaaatcgagcagattctccaacgtggtgatgtggccgtcgagggccgcgaagccggagagcacggagtccagcatgatcttggcggcgtcgggatcgtctacgagttgttcgcaaatggcggccacctcggcgagcagggccagggtgctctccgccattgctgtcgtgtgggtggctcactggctccgtgatgggtggctttgtgggccagagttgtcagagaatcagattgttgtacagatcattggcttgcgtggcaagtttttacattagctcacaatactaatccgcaatcaccactagtccagaggagataactgacgtgatcaagaatttggttccagaatggatcagtggaaaattctcacagtatgccacttccacacatatactgcttatttacaatctctcgaaataactagggaacttagcaaacttcaattaaaaaactcaaacaaataatctgctttcctcgaatcagatatctttgaacaggtacgcatagcagaaaccaccttgtctgtccaaatcggaagcagaggaaggaaacaagaggaacgagtaaatgaacccacaaaattgcacctagcacggtcatcatcaagatgcaatatgcatgtgttgatttctcgatccatctacattgtacgctgctcaacaatcacagccgaaaagccaaagaacgcaacgaacaccctgttctgcattacaacagctctgccatttggacttgacttggagaagacagcttcgcctctcttaattctaaagcatccaaaatccaccagaaacagattgaagcagaaacatagcgtggtgaagaattaaacgacacatacaaacgcattgctgcaatcaaattctagaaaattcatcaaagggctataacaatccaacgatttatactagatcatgcaaatgaatcagcaggagaaagatggaagcaagatcggcttggatagctcagaacagaattttcccatcaggaatcaccatttctcaattgtcaaaaatcagaagcagaggacgaaacaacaagacgagcgaccaaagcaaaagacgaatctacacaaaagcgatgaaacaaaactagcacatcgttgagacgcctgtgctaatcacccgatccatctacgctcctcgcctcctcaccaatgaaaagctcgcaaacaacacgaatggcacgtcgcgcggtcgatcagaggcgaacccgatagcccaagaggaagaaggacgtcagccaggtgaagatcctcccgagggcctcgaacgcgggcaccgtgccgccgcgcctcaactcgacgtagacggccaaggcggcggttccggccacgaacgtgagggccacggcggggaggaagcgccgcaaggcgcgcctgatgatggcgtaggtccagatgaagacgagcatcttgacgacttggcgcagctgcctgcggttctccaggaggaaatcggcgtccaccttgatgccgcggtagtcctcctcgagttggacgcgctgcgcctcccgctccgcgtcggtcatgggctgggtcatgagctcgttcgtctggtgctggatatggcggagctgaatccccaccatggcgatctcgtggtcgttctccgcggcgttgaagtgcgcgtcgtccagcagggccctggcgtcgtcggggttgtcgacgaggtggaagtacatggcgaccacctcatcaagcagggggttctccgccattgctgtggtgtgggtggggttctaacttctaactgcgtggctccgtgtccggggaatcggactatcggcgggggggtgcttgcttttgtaggccagaattggggctccgtgatgggtggctttgtgggccagagttgtcagagaatcagattgttatccagagctttggcttgcgtggcaagtttacattctgctccattgctgtgcgttgggttatttgccctcgcagcctcgctcttgtgcgtggctgcgtgttttgggggtgtttttggactaaatatgggtttctttgctagagttgtcagttgtaacagagtcgggtactcgtgttactgtccaagcatggtttggttggttaagtccattagagctcaggctgctgatctgtgagaactggcatgaacaaagctttaacggaatttgagtctaatgtcgagcaatttggttccagaatggacaaggggaaattctcgcattccactttatgagcagaaagctaatcacaccaccaaagaaaaccctgttgcgtccaaattcctgagtactcgtggtcaatagcaaaggggttgcatatgcatctgaaatgggaggcgtgagtccataatccatatgaccataattactgcatacagcataataacaccttaagttgaaataacgagtgaaccacctaacaaacttcgacaaacaagactcgaagaaatcaacagcattcctcgaaagttcgaatccacacagcattgcaggaaatatacaattcagaatgtcacatgccggttaccagcttttgggtgaggagcggtagataacgtcaagaattgcatcttggagaaaatcattggagaaacaaaggaatgcatatacaacaaaacgcgaccaccattcttcaaaagttcttgatgagcataagctcagttccgcgaatacagcgcgtcagctgtctcaattgcatcatctgccggttacccagcactgttatattgcaacattacagccaggcaacaaatgttgcacagcaccagatttacgaactgtgctggtaaacttaggcctagatggctagctcaacgagagaccatcaacctttgcaacaacaaacaaaaaaaaaatcaacagcagaggtagttcagagaagtctgaacagaacgacgtaaaaagaaggaaacaccaaagaatcacataataggtgcatatcatatcctacttggctcacagctgataattcctaatcattatgactatttcaagtcaaaatagcatcagtaactgacagtcctcatcaacacagccaagtagccagaaaaagcacagatcatctccagaaatatgatgtccaacaaacttcatacttcacagaacataaacataaaaaagttacacagatattgcaacacaccaattacccactgtgtgatgtactgatgtattgcatgccaattagttcagttctacaaccagctaaagtgagttcttaactaatcagagacaaccatttcaggaactattgggatgctaccaaatagcaaagtggctacatcttgaagtcagactggcatttataatcgcgtatcaaaattcacaaaaaacgtccaaataagacatctacagatggattactactatgtggccaactgaccaccagtgtgcacatagtcatggcaacagaaatgattcaccattgagcatgaaacattgttataagccacagtcgtttattaaataaattatttgaccagctatcactaacaaatgaagtagaaaacagcattcataaaaaaaggttatgtcaaagaaactctgatgataatcaaaacctacaaatctgaaagtgaactatgtattctagctacagaaaagagtcagactaaagttttactgcaagaccgattcactgatgatcagaaatagtcaatcagacgccaggaaatggtaacaaatgacagtgagtactgatcaccaaaatgatcacatactaacagacaaatgagcccaatgagtataaaacaaccagatagtacaactaagaaacagatccgagttatctttagtttagtaatatcgataacctaacacatttatggatgtatggatcaccctaaactcttaacctaaatccaaaaacattcacttgctaaatccaagacagtaaatgtaccacatcacaagatgaaatatgtcgaaatataaactgccaatgcttcctcataggccaaagccaccatcagcaacatgacaaaaacatcaaatgtgatgcaaacagaaagcacggatataaccacataatcaaagtaagggcacaccatttatggcatcaaacggccccagactatttcatggtcattagcatcaatcaatcacatgtacatgcatccatcaaacatttctttccaaactaaagaatatagaagtgcacccaaagcctagaagcagaaaatgaatataatgaaacggtgaaaatttgtcccaccaccatgttttccacaagtgcgtatccacattccatataaccatctatagaggaagcatgcacatgccaaaaggcatatacaggacatatattgcacagcataaaagaagcaacactgaatctaatcaagttatagttcctcggtgactggaacggcaactagaacccgtaggtactattgaacagacttgagcagcagaaaacgcctcgagatcagacagcatagcacattaatcaactgtgacatatggcaacagattaattagctcatttcatccattcattaaaacgggatatctcaaaatcatcaatcaatataagggcacatccagatatgcaaactgcaaaccatcagtaagaagtaatgagaagctcagaatggagaaaaagcataaccgcacagcaaccattcggcgttcctcagttacgcatcacaaattgtttcagacatttagcgtcaccaccgaagaaggtagaatgataaaaggaaaaacaggaatggaacataacaagtgttcagatccctatgtttctgtaggctattaagcaactagctcatagaagtcatactattctcatccagcactctaccatcatcagttcatcaccacaaaaaaactcatcaaatcttccataggctgtcgcagcagagcaaaacttcctgtgcatcagatcaccagtttacctcttgaggcggaggaagatcaccacggcaacagctgccgcggcggcgccgacggccgcagctccagccatcaccggccacgcgacccgcgctccctgcagggtcccaggtgtcggagcagccaccctctcgtcctccgcagcggcagcggcagcggcagcggcggccctggccctggccctctccttcatggcaatcacctcctcctcgagcctcatcttcaccgcgcgttcggaccccaccttgccggcgagctgattggagtcgcgcttgtccgccttgaattcatctttctctgcttggaggagtttctgcagatcctcgagctcctcgcggagcgcaagcaccttcgcgtcggaagaagaggcgatgtactggaagacgaccgagttctgcttggccttatcggaggtgtccttcaggccgtcgatctccgtggcacgccccttcttctcacggtcggcagcggcgagcttctcctccaggtcgtgattggtggtgcggaggtcctcgatctcggcgttggcggcgacggcggcgtaggacttggcggggttcaccggggcggtgacggtgacctcatcctccgcaacgctgccgtccggcacggtcttctcggcggcgacggtggcgtaggacttggcggggttcacggccgcggtgacggagacctcgtcctcctcgacgttgccgttggggtaggtcttctcggcggcgacgtcggcgtaggacttggcgcggttctcggcggcggtgacggtgacctcgtcctccgcgacgctgccgttggggctggtcttctcagcgacgacggcggcgtaggacttggcggggttctcggcggcggtgacggtgacctcgtcctcctcgacgctgccgttgggcaaggtcttctcggcggcgacggcggcgtaggacttggtggggtgcccgtcggtggtggcggcaacgtcgtcgccggcgaagcatccgatgggcgcggtcttctggccgccggcggcggcggcggggtaggcgagggtttcgtcgcccttctccatggggaacggtgggttttggagtgtggattctctctgcctctctgcgatggggacgggtgggggaaattcgctgtgaaaaaggcgagactactttcgccttcccaatcgcgcagtgccctttttatgccgaagggggggcttgatggattggtggagaagaaaaatctcggacggcatttgggggaggggtttcgcttcgcctcactgaccagtggggcccacgaattggtgttgccccgtgaccccacctgtcagtttgggtggtaagtggtaaccgctctggcgagcatgcgtgccagccaccgcgacgccggtggggtcgcggtgtcagcttggatcgtggcactcgcgttgcgccattgcgtgctgaagaagatggtgcccccggtgcgtggggaaaaaatggttgctactagtgcgctgcaccgggcacgggacacgcgtcgtgtcacatctccgcgaacctcgcatcgtgcaacaaaacagtgtgaggcttgtgcgctcgcatcgtgtgacaaagtagcaatcgatatgctcccaagtcccgtgatcccgtcgtttagcaaggggcactgtgaccaggggcggatacaggaacaggtagaggtaacagaacaaactgaacaaactactcagggtgtttagttggggaaaagtaaaattttggatgtcacagcgaacgtttgaccggatatcggaaggggttttcggacacgaatgaaaaaactaattttagaactcacctgaaaaccacgagacgaatcttttaagactaattaagccgtcattagcacatgtgggttactgtagcacttatggctaatcacggactaattgggcttaaaagattcgtctcgtgattttccccataactgtgcaattagtttttctttttatctatatttaatgcttcatgcatgtgtccaaagattcgatgtgatgtttttgggaaaaaaatttggggaactaaacgggccctcattgcgtctcaaaatataacaacttttagttggatatgatatatcctaatactacgaatctggataggaggcatgtctaaattcatattattaggatatgtcccatgcatccaaaaattgctatattttgagacgaacactatattgtcatcttctaatggattatgacagttaattttaatggaggcttcacggttgtaacaccgatattgggggctcgagacccccaacgacctcacggtgaatccgtcattgagtgttactgcgtgaggcctatacggttgcatcttatcagtgtatcacaaagtatcaatcgatgctcgcatatgatcccatcgtttagcaaggaaaaatattggtaaaacttttgtatttactaacttctctctctgttttacgatgtaaatcattctatcattttccacatatatatctatctagattcattagcatcaatatgaatatgggaaatgctagaataacttacattgtgaaatggaggaagtatgttccataaaaattcatcttatgtatatttgtattaaacttactctgtccgtccaaaaaaattgtattaaacttactctctctgtccaaaaaaaggcaacctagtactaggacatcctaatacaacgaatctggacataaagtatgcataaatttattgtactagaatgtgtcacatcctagtagaaggttgagttttttttggacggagggagtatgtatgtacttatgctatgtgctatagaacaccaaaactctgtgttttttttattgtagcatactaaaaaacatgttacgtgtatgtatgataggataaaaaacctgataattaattgttaaacaccgatggtactgtattattttgttacatttgatgtaaatgaagagagaaacaatgtgaaaagtatgaatgtattcttggggatatctaatgcgcactattttttttcccgctccaactcaatatcaagtgatagaggggatgagtttggacgtcggcactctagcgaccaaatagcgacagtggcagctagtactgtcccatagcacgacgctcccacgggaggtggcagttgacgtcgtcccgtcatgccggttcgattgagttgcaacgatggtagggggaaggtaccaatgatgctagtgtcgtaaaaaagatccattactacaataagttttttttaaaggatctatttgcaaaaaaaagattttaaaagatagaatgttaaaaatctaatgaagatgagcgagaagaggatatagagtaagaagatagtgacggtttggtttagaacttttaggaaaatatacattttggagtaagtaatgtcatatattgtgtaactgtgaaatttaaattgcatgactttaaatattaaaacagtaatgatattttttgaaccataaagtcattagcaatagcatttatctaattaacctttttgtattgattattgaaaagggaaagctaggagagcaatcaagcgaaattgacacgtgtcacggcagtggacgaatattccatattgcccttcctttcacccccccccccccccccccccggggggcgtcccgtttctgccatcgagtcgaacaaacaaaccctagaactccaataccccatcgagccccggaatagtactccgcccgccttgcggaaacaaatcgaagaagaagaaggaagacgcagccgcgtgcccccccatccatggatctggagatcgtgggccggcacgcgctgctgttcgacgacgacccgacggcggaggtcgtcaactccggcggctccctcgtcccctgggccgccgtcggcgcggacgacctcctcctcgaccgccacgacgtccggcacctgctcgaccgcgtgcctcctcgcccccgccgctcctactccgcggccctcctctctgccccctctctggatggcgtctccgaggctgaactcgaccgcgagcgcttcctcgacctcaccgccgacgatttcggcggcgagggctctcaagatgcggtctcttcaggtatacgtctgttcccgctcctcttgacctgcctatgcactctttccctatcctctatcctgtattgcaactattctgcgtatccatcagctgccctttcacctttagttgcaattgggcgatgcgagctctaagaatccagtgtttatcatcttaagagtgctagcaagaaattagactctcaacaacaccgcctgatgtatcatgtagtagaggttagaaaccaaacagttttttctagtcccctttgctctcactgggatccacagagaataaaaatctgctgtagggatcaaacaagagtgaaggactgaaggtaccagacaatatgttgttgatctgtgtgcaagagttgcctctgcaattgtaaggacatacagcaaagataatttgttatgtcataatgttgtttggtttcagttgtgtgaattttcaccatctcggatttgtttcaagtcttactgaggcttcatttggatgggttcaaatgacatcattctgaacccaccaaatgaaaccctgctgaggttaagtccatgaaatgggagggaacttacatcgttctgacttttgagcccatccagatgaagctaagtacatggactgtagatattcgatcttcttggttagaatattattttagttcaatcttctgaaacatcgcccttgaatggatctcagttgtttaaaagttcttttgtttgaatgttagtagcaaaattaagcttctctctgttgaattcctgcagtagctattcttctagcaaccaaactaggaaatagttacattgttatggagctcgatatagtgagagtgagcaatacttgcacaagtagcacaactagcaatgctaattggacccaaacatttttttgttgtaccttttgtaagtttgcaggaaggatgcttgaatttagttgatgagcatctttaatcagttcaagtaagggacttctatttcttctaagatgcatatttgcatctacacgtcttcctctacattcaacactatattttatgttgcttgtggtaaacaatgttacatctgacatcttttctttatacaggaaatgggacagatacaggttgggctgattataattctgtccctttctcatatgggagtactgctggttcagatgatccaaataatttgagcacatattattgcccatcttttcccgtgcctgacagattgttgaataagctggtaagtacatggactatggagtctgtctgactgcttacattgaacttcttttaataaatcggaattttatttctttatgcatttttgtattaatattcttcagctgatccagccataattatccaaggtgcatatgttcttctaaggattaaatgcctatttcagatggttggagcagagatgaggttcctactagtgatgcacattgtttccttacatatatcatgatgtaaggaataggcaggtgggattagaatgatgtaaatgttacacacaacagaaaaaagtactggcatgggatagctgttcttatgatataccagctaaattcatttgagctttgatcataatcttgtacttccatgcactcagacccttactgagacaatgttttcgcccccatattttttttcatttgcagcctccttctgagaaggttcatcaaattattgcaagaactgctctatttgtcagtgagcatgggggccagtcagagattgtgttaagggtgaaacagggtagtaatccaacatttggtttcttgatgcctgaccatcatctccacagctacttccggtaccttgtagatcatcctcagttgttgaaagatggtctagatgctgattcaaacaagggctgcaaaactgccaatagtgagagtgggcatgatgcatcatcaggcggggctttgtcattgcttggggctgtctatgagtctggagatgaggatgaaggcatgcttccgcctagtccaaaaagcacggttcctggaaaagacgtggttgtgcatgagcaaggtcatgaaagctctgtatctgctatacattgcaacgaagaaacacgggatggtcagaaagcaacggcagcagctactgttgcagctaaagataaatctattttgactaagaagaacccaatgattactggcagcagccttcttgctgctcgcctagagaaggccaaagatgccatgatggcatcaagtacgtcagatgtttctgacacaaaagttgtgattctggaaccaccatctttcttgaagcgtacaatggagaaaatagttgaatttattatcaggaatgggaaagagtttgaaggaaaactcattgagcaagacagaacaacaggaaggtttccatttcttctgccatctaatccatatcacccgtattatctgaagcttctcgaggaaactcaagaggtaatgtgaaccacgcttgtttatactttcagattgcaatatttcctttattatccccctttctgtttgctgtttggtacactaagttttattaatcccttatgatatatgcattgtttcaatgtatatattcattatctttacaagtttacccagtgttttatgactgaacttctctcaaaatttcacgcgctcaatcctttcaattgattgttcatcaataatgttttggtgaaaccgcactaggcatcaactgctagatatgttcatataaaacctcttgtgatgatgggctgatagaaatccaaattttcttcattcgttggttcatttgattgttctttttggacaagcatgtgttgatctaccttatgtttcttttttttttttgctctttttaattcttcagcactttttttgtgctagtgcctgaaatgctaatggcttttctataccaagctttcctcctgtttgtttctttagtgcacatgatgtcttacacttgatctctgaacttcaggtaagttcatatgtggacatatttcattgctgatgcactacctacctttccccccttatttttttgttgataattccagtcactaataaaatatttggtttcattttctagcattggtaaacagcagattaatttaaagtttttcttgttgttttggagagtcttgtgttaccatttccatacttgatttacttcccagtatgtttgtttgtaaattcctagttgctttgttctactttttttctcagtactgattttattggctaattgaaatgcataccatctatgttgatgtacttgcattctgcgtattcttgctttttgagaataaatctcgaacttccagagcgtgtttggttgctattttttatttgcgtggagaatattattatatgtatatgcaatgtttctgaacttgtctgtttgaggtgttttgtaggcctccccataccaataaacaaatggaaaattgtaaatgcacttaactgtgatttaaattctgaatgattttgcagtccaagtcccgtggtggttcttcagagcccaaagacagaaaaagctcttcagagcacaaagaccgaagaagctcttcagagcagaaagacagaagaagcccttcagagcgcaaaggtagtaatcatggtaagggagaaagtaaaagcaagaaacggtcaagtactagcaaggatgccagttctcctgatagaagctctgctgagccgtcagagaagcagctctatgacaaacacaaacaagggaagggaaagttccacatgatcattagtggggccaagaaggaacctcctcggaatgtcactgcagatgaagctgctgctattgttatggcagctactcgtggatttggccctgccaatattcaaacaaacacactgaaggacactagtggaattggtcagacccgtggagataatggacatacttcaagctttggaagtttctcctctttacaggacccagatgtaccatccaaacctgtttaaatagtgaggcatgtacctcactcacaagtagtggtcagcctaaaaatgaaggcactggaataattgatgatgattggattgcaaacactatcgcaaaagctgctgctgttgcagcctctaaagaagctgattcttctgaagcatccatgacaaaagagcagaagctgaaggctgagaggcttagacgtgcaaagatgtttacctctattattaagagtggtggcagcaagatggctgatttgtcaacttcagctgatcaaactaatgaagctggaagggcctctcctggtgatttgaacttatctgagtctgatccacaaccatcagctaaggaacgtgaaggtagctctgtgccatttgaacgtgaaggctctaatctggccaagcaggagaaagactctgatgacgaacggaacagggcaaggaagtataggaaaaaacatcacccagaatctgacgaggagaactatgattcagaggagagctataaacactctaggaagaagcaccgttcagaggattcaagagctcatactagtgatgttcacaaacataagctcaagagacactccaaggatctggaacccaggcatcataggcaccgtgatagctcttcagaagatgagcatgagcacaggagctccaagtcaaggcatcgtcacagggatgactatcactatcacgaggatgatgagcataggagttcacatagacaccagagggaccaccgttccagttcaaaaaggaaaaaggacgatgaccgagataagagcaaacaaactatagttctcccagaagtctcccagaaccaggaaaagccccctggtgacactgctcaatcctcccaggcaacaactgaagtgccgagtgagttgagagcaaaaatcagagcaatgttgctagaaacactgtaaatctgtaataccctgtggggattatgctgtacaatgggataatgtagccaactctccttgttcagcaccgactcagggtatcaagaagtgtacttgttcggttatctctctcatttgaaatatgtgtactgtgtacaggatagcgactgcgttccgcaatggccatattggttcactactcggtaccaaggccatccaacatggggccttggatgagttggatcctattcgtatggtattgtgtattcgctgtttttcctcgcctccccgtttgcatgagccgagcgccgaacttgggctaatgggcaccgttcgatcgaagttcgaacaaatatatgcaaagcacaggtttcaaaaaaaacgaagagcaaacgtaaagcacgtaatatcacacagattaagtaaacaggcatgtactcctactctcctagtacactaaaattctcctaaaaacgcaattacgcctaattaattagcactatcaagcaaacatgccaatgtaatcgagttcgacggagcccaaccacagcttgcccttctgctccgccacctcgctgagcgtgacgcccttggcagccgtcaactcctccacctccacgccgtcggggttgagccgtacgccgaccaggtgcttggctgcgggcgccgcgcccagccgcatcctctcctggttgagcgccacccagtagcctccctaggtgtcgcgcctcacgttgtcggggtagcccgggaggtcggcgaagagctcgtactcgccggctttggtgccccgcagccagtaccggaacgcctggcacggcacggtgtgcgccacgacgaggtgcgtcctgtctcggctgacggcgacgccgttcgggtacggcaggtcggtcttcagcacggtgacccgccgcgtccgcgcgtcgtacttgagcagccgccctgtcgcgtcggcgttcatcgtgatctccccgttgaacctgcgggtgtacgtgctgctgctgtcggtgaagtaggcatcacccgtagcttggtcgacgtcaaggccattgaggaagtggaaggggacgccgtccgcctcggtcgcgaccacctgggcctcgccgccgtcgggcccgaccttcatcagccccttgtacgcgtcggcgatgtagagctcgccggtcttcctgaacaaccggatccccagcgggcgcccgcagatgctctccctctcctccggtggcacctcggacgacgagcagagagggattttccggtagttcgcattgtacgcgaacgtggtccagccggcggcgctgcctccccacttgagcacgcggccgtccgagacgccggtgtagaggccgtccttgccgtcgaaggcgaggctctcggcgccgctgacgccgtcgggaagcgggaggtggtagctccaccgcgtgtcggtggtcttgatctgctgggccgcgcacggcgagatcaccagcagcgacgcgacgctgagcagcagaagaaacgtcgccgtaaaatcgcgagccatgggtcgcctcatcgttgcacgtagccgagaaaacgttttcgatggagaactagccgctacctgcatgtttttataggttatggctcgtgacagcctcggcgtttcccggtgccaagttctactcgaggtcgtcagtaatcctgctcgaactagtactctatccgtctcgtattataagtttaattctttttaagttaaaattatttagatttaattaaattatagaaaaattaaaaacatctgtaataccattaatttagttaaatttaaattatattttaataatatatttgtttactaaaattattagtagtatattttttataaatttaattataaatttagaaaaatttagaaaatgttaaacgactcgtaatacgaaacgtattgagtattgcagatggacgggaagacgaaacccaaccgaaacggagccacgacacaggcttggattcggttttcttcacccccgcgggctccggctccgttccaagttcccaatgccaacctctccttccacgaacgccacgtcgcggtcgcgggcaacccacgcgcccagccgcccacgccccaaccagattggcatcgcggccgtccatcgccgcatcggcgcaggcgcggacccgaaacccaccacacggcaaaccaaaaaaaagaggcctcaccgcacggacgcggaaatgggtcgcgacccaacccacgcattccgcccccggctccgatctgctaagccccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaatatagtaacatcaaaggtcactcattgctttccagtgttttggacgcgtgagagtttgtctggaaaagagagtcaaaatgatgctattaccttttctttgtatggatgtagtgtctttatatatactatattgctactagcgttgcatgatgtgcttgtttggatctgctgcagtgggcgatcatatttagatacaagatagcatgctggagccaacagctatggaagtgccgattactagctcagtgaacactgcagtggtgcctgtgcctgtggtgcacaatccacgggcacggaaattgcggtctgcagtttggcaggacttcactaaggaacggcgtgctgatggaagctgtgttgctgtctgtaaccactgtaagaagcagctcacagctactagccggtcaggcaccacacacctacgcaaccacctcgcaatctgcaccaccacctccacgcgtcgtgctggtaagcgccggaagcttattgtgcgccgtattctccacaacaaaacctccactgatggacagtctggtgacggacatgcttcgggagaggaccatgacaacgatggcacgcattttgaccaagaactcagtcggcgagatcttgcccatatgattgtccagcatgggtaccggttttcaatagtggatgatgtgggcttccaaaagtttgtcaagaacctccagccacggtttaggatggtgtcatatgaaacagtgagggctgatagcatgacaatttatgaaagcgagaagctgaagctgcaggatgctctgctcaagatcccttgccgacttagtatctcagttgatatgtggcgatcgaatacacagatggacttcttgtgtttgacctgtcactatattgaccatgccaatgatgagtggaaagttaggaaaaaaattctgaactttgtgcatgtggaggcaccttttacagatgatcagattgctagtctcattctagagaagttgcgtgagtggggtattgacaggaagctagctgccattgtactggacaactgcgcctctggtgagattgttgctagagagcttctcgtagttctgcagcctaggagactcctcctattaaatgggaatttgttccaggtgcgctcttgtgcgcacattcttaacctcacagtccaagaaagcttagaacagacatctgatataattactagagtccgtgagatgattcagaatgtcaagttctcacaagaaaggttcgaaaagtttcaggatactgcaaaactgttgcagatggaccaaaaactgctagttcttgattctcctaataactggccgtctacatacttaatgtttgattctgcatgttactatcatgatgttctcatgcgccttgcagaacaggaagcacattatggtgcttttctcactgcgaaggagtgggccgatgtgaaagccctcactgaaatacttgatgcgctctatcataagatggagaagtttcctgtggaaaatccgactgcaaatctctattttaatgacatgtgtgaggtgcatgttcttttgaatacctggcgtaatagtccatctcctgttgttgcacaagtggctgaccgaatgctgacaaaatttgaggggtactgggatcttactagaccagtaatggcattcgcatctattctggatcctcgatataagatgaagtctgttgagtacttctgtagactcatttatgctgctgatcaatttagagcaaagacaacaatagatgacattcggcagagttttaccaatttgtgcagtgaatatgaacagtcaggaaattcattcaagaatccatctgctctcttctactctgcaaccagtaattcttgcatgagttcggtatacagcaatggtgatgattttaagaccttctcccgtatcacattatctgatgctcgaaggggacttgatcaatatatacaggagacgtcatcaggccaatcctttaagtctgacttagacatgtaccttgaggaaccggtctatcgccaaaaggaagggcatttagataattttgacatcctgggatggtggaagtcctttgcagcaaagtatcctgtcctttctcaaatggctcgtgatattttagctgtccctgtatctatcatcccattggacagtgatgctcggacattaaatgagtatctcagtaccatggacccttcaacagtgcagggattggtatgtgcgcaagattggttgcggaaagatacagaaggtaccactaggtcacaccttctacagtaagttatatttctgccgggcatgttaatctgaattatttgtttcacttgtgcttttgcagttgctagttcagacggtcatgcagatgacaaagcggcacgtggtgatgaacttatcgtgttaccaaaataggtaatatattggacgcagatcacttgtttcagtttgctttgatacttttatcttttcccagatgtgcattcatgtgacgttctcatgcggaaagtttgggaggagcttcaatatttatgcttacatattcaagtgtttgactttctctgtttgctcatgttttcaaaaccttgaatacattgaagatcaaatctatatctatactctggtgcaaagattatgttcaataatataatttatccaacagcagtgcttgggcttaccctgagcagaatatccctactttcaaatagtagtatgcgttggaagtttgagttacatttttctcgaacaccagttcaagttacatgacaccattgattgagaagatcatgtgcacagatgttgctaagcttacaaactgcctaattgaattgctcatgaattcttgtttgtacaatttcataaatgcataaggggaataaataaaaacattctctaaaaagaaatggctacgtgaagcaccatttgctagaactgaaacctgttgaccatagtatttgtactcttaggcttgtagcctgctaatttactcacggcttcagatctcgatattagctaatactccgtattacttaagtacttccttctatacgttttcatataaactttctttactctccatttgcaatcaacttagtgtgattttttttaaaacccgtacagctaaaaaaatgaagaaaaatagcacactgtatatttcttttcttcactagactactggagtacaacaatcggagtatccgatccacagtaattcaccaccgaaatggtagtgttttaggtgcaattttcttcgttggtgcaggttgcacaatggtattaactttagccaattgcggttgttatgcttgtggcctgatacttgacgaattggttaagttaaaaatatgttacttcttttattgtattgggcaccaggattattacatcttcatttttacttgtctgcagttgagacttctgattgatggctcctgagtcctgaggagaccaaggaggcgaggacgcaagtaactgcattatttatgttcaacagtccaatttccaggcttccagctacacccctgtaaatgtatcgttctagttctagatctgtttgtacaatgaagtcgtaggtacctccaagaaggtagtatcaatttaggcaattgactctgcattaatgacttaatgtgtattatgctgctaagctaagttatctccatcgtagctaagttatctccatcgtatttcttaagaatatgcagttatgcaggcaacactcctgaagtggataactttgaatccaacatttcaaatgtgacaaaatttattctactatcaaagaatctgaatctgacgagtgacgacttgtgtttatgtcttttttttttctttcttaaattagccagtataaagaacggtcaagtctcttgaggcttatcaagatgttgaaaatcgtctctctcaactcacagaactttaaagttggtcacgaaaacgcaaaagtatgatgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34970 - DNA, 681 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacct

SEQ ID NO: 34971 - DNA, 659 bp, Oryza sativa
tgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccgctgcagt

SEQ ID NO: 34972 - DNA, 600 bp, Oryza sativa
caattaaagaattttttattatttgtgagtaccctatagttcaacaaatccttttacttactcatcattcatcatatcacatatccaatggtctaaaatcattcaatccaacgcctcagattaccccacctttcccctcctctccttcccgcacctgaaatggtgaaatcacgccgcattcaccgacctgtgtctcgctcttccctcctctttctcccgcatctgccacgcatttcctactcgcgctctctcgccccctcaccgtcgtgcactcgtgcgccggatttttcacagaatcgacgcgctcctcctccgcagtccgcaccaccatcgtgccgcgcgcctctccctaccgcgaaaaaacgccgcgccagcgcccaccatcgtcactggccgcccatcgctctccaccgcgcccttattgcgcctgacgcgaaggaggagcccgaggaggaagaagaagaacaaggaggctgacgccgatgcctgcaggcaaagaagatgaccgagaccttcttgtatgagggaacaccgaagaagtcgttcacgcgcgggcgaccgggggcgaaccctaggccccgggccgcggcacccacccct

SEQ ID NO: 34973 - DNA, 17874 bp, Oryza sativa
aaaagtgtttggtaggtttcgagctccagttctgaaaattaaaaaaaaaaaaaaagaaaaaaactccccaatcgcaactgctggccgtcgccgtccccgtgtgtgggcaggccgcctcttgctgcgcgccgcccgcgccgaaagtccgcccgccggccgagcgccactcgcgctgtccccgatgtcgcccgacgactgccgccgtccgtccgccaaccgcatgccgtccccgatgccgcccgccgtcaacctcgccgccaaccgcgcgccgaccgcgcaccaacccaccgcacgccgcccaccacgtgctgctcgccgtgcgccggccgcggtcgaccccgccgcccgccgtgcgccagccgcggtcgacctcgccgccaaccgcgcgccggccgccgtcgagctcgtcggagtggagagtgagggtgacggcctgatgggagggagagagagggggtgagagatgagttaggggtagttgagtggcaattttgtgtaaatatgtaaaaaatttaaagggtagtgggtcttttggtttggagtggagttgtggagcagcaaaaacccagctccacccccgtagtacaaatttgtggagtagctctgccaactcaactcccaaaaatggaggatctggactgtttggcatagctcctgctccaggtaagttggagttaggagcttgagctgtgccaaacggggcctgagtaaaaccatttgttcaactatagggtagattcatcaactcactcttacacctacattactcattcatcaaatccaacggctcatatatctctaccccaattgaacgatcaagatcagctccgcctctcttccgcatgccgatcgctcgtcacggctccgtttcggcgtctcccctgccaaccccccgcgcacttacgccctcacccctccccaccacatcttcaacccccaactcacgcatcgcccccctcctctctcctggactccccatcgtgcgccgttaggtcgccgtcgccgcatgccgctcctctccccactcacgggaggaactctctccaaaccctaaccctaacctcctctctctccacgaatacgcgctgcacgctgttgcgcgctcccctccccactcgccggttcctccgcgtctcacctgatctccacctcgaaatccgccgccggagcagcgttaggtcgtcgccctcggtggctcatgtcgcactgtcgcccaccttcgcgccgccaccggtctcctccgcacggtttgttttttcttccgttgtccagtttcaatctcttctcccttctagttcattatttttctttggcctgattgattttttttaacaaactggccaatttgattttggctgtgatataccagcaaggtatgtttttgaacatgcacatgatgttttctattgaatgctgcagaaacagtccgccaccctgttcgtcaagcaattttgttatcgatggttggaatgtattacgccaatgtgttagtgccaactaatttttgggtttctgcctgaaatgctaacatactattcgatgcattcatgatagtctggggacaaaaggaaaaaaattatctcgtgctttaggggtcaaaataggacatgtgatatttggttgttcacaaacagctagcccagcattaatccactgatggtctgcttgctgaatttatttctaagtaattagcaatctttatttaagcctgaatgatttgtactaaaaatttccccttgtttttcatggtatcacaatagattggaacaggataatcttctgctcaagaaaacaccaatgttggagatgatcacaattgtcctccactgctcttgatcattcaagcaggcatgtactttcttttgcagatgggtacacattattgtgttatgcatttagctaattgattaaaatatcctgtgattttacaggcatgttcttttgaattaccctgtctttcctgtaattaatttatgcagtatgctaactgattagcacgatctcatgaatactacaattgcaggcacatatacatacatatacaaaaagatatgccatggtgtggatggaaatcgtggaggaattctgcatctgcactctattgacagagttctacttatataaacattgcaagggatgcatctttcggtaattcaccattgataggcattgtactaaactactaatactataatctgcaggtaatatatatccatctattttttcccttcaaatctactagacttcaacatacaattttctcaaccccagatatgtgggtatatgcagctgatttgcaatcaccaaccccagatattttaacccttatagcttaactttgaagtccatatgttaggcgcagagtggtaaagtggtttatgtctattttgatcgagcagtttggcgagcggagacgtggaattatacaatggtagttcaggagaattaacataggcataggtactattttttactgatagatgtattttgaaatcttcatggattatggagcggaacagctaaactttgctctgctgtaacttagacccaattgtgcagtgttcatggtatgtccgacgttgcttactttgatatgcttatgctcttagtggaatcactaataaacatcgccggatatgtgtccttttagatatgcttgtgtgtttgcttcctggagatttggttgggttggaacaaaatgttatttatttgctttagaatgcagtgccctatgtattacgaaattatacttcctttaattgagtctaatggcttagaatccctataatattgtttaattgtgtggagaacatgaccaaaaatatataaaatggacatataatatactgctgcttccctgtatttcttgggagattctttttcaagatcatcactgatcagatgctacgagtctaggaatctttaaagtttgattttctttttggcatgtatggatgtatattttggtttaatcttgccataatttatttatttattactactaggtcaggagataaaattctccttcaaagctcattatacaatacaatgttacaataaggataacataaccttatccaaacttgtgattagtcaatgcttaattaattacatcattttgagtcatcgtgggtgaaacatggtacatttgtgttaaacatattattgatagcacttccctttgatgcacatgtaggcagctcttaccctgaattcatataattggattagctgaactcagtgcctccaatgatgattgaataggaagggaactaactagggtagtattgttttgtgcttgagatcctggttgcggaactgagatgtactattgacttgagtcatatttagttttttgctatataatgttgatttttttactcatttttgcagaacgaaggatggcgcttgaccgtggatgaggagcggatgtcctgctcaatgagaactactgtggatgcagtttttctttcagttttggtgacttcagtgctgctattttatgagattttccattgtttgtgatcagtaagcaagcatgtactaatcagttggtggcactgagcatggctctttctttttagatcagactagcaaaactgcccgtgtgctgcaacgggtgaaaaattccaatgacaatatatgtttttcataaataaccatgtgaataataatgtttgtgttgattgttgtagctaagacatatcataaggaaaaatagaacatcttccattctttgcccaaaagaattggattattcatgtgacagcatacatataggccatgtttagattccaacttttttttttaaacttccaacttttccgtcacatcgaacttttctacacacacaagtttccaacttttccgtcacatcattctaatttcaaccaaacttccaattttatcggtggatctaaacacagccataatctaaaatactctttcaatcctattcttgcaataaaaaatatgattaatcaaaatcctacactgccttgcatggtaaagtctaaaaaaaatagagccaccgtgcactcttctctaaatatcaatttaaaacatattttccttttaatattatttccatataatatgttataaagaatagtagctatagtagtatgataatttataggagaatagatgagaaaacaaaagccgtgaaggagatggaaaaaatcgatggatcctatcagacataaacgtccatcaatttgatcttgtgctcataaaaaaaaggcccaaacaagacttgtcttagttccagatgttagaacattcaaccaacgctttgaaaaaaccaaaccgacatggtagattatggacgatacaaatgtcacgaatctttttcatggaatcagatgtattttttctaaattcggacttttttttgcattgcacagtgccgaaccagtttttttcttttaataaacagtggtgtttttctcgcgttgagtcacatggttttttcaaagctgttcttttataaatagtgatgtttttcacgcgtaatcatacggatttctcacgaaaaggtggttttttcctcgcattgagtcggatggttttattatcttttttataaaggtgttttactcatttttataagggcttttttttctcgcgcggtttatataaacttcgacatctttaggtggattttaatatatgataatttgaatgaataaaaaaagtaattcgaaaggagaaaattgaattcgcttttacatttccaaatctactttgacggtttttatggaatcaggcattttttttaacgttgcacaggaactttttttttccattaacctttttttggaggaccggcttatacatactatttttaagaatctaatagaaatatttttttcctttttttaggaagatggaaacccttttttcacacttttttttaatcggacagaaaaaattcgcgcttgcttttttttggcacggacgccgggatattttttttaatcggacggaaatatttttgagggcagctagcccacgggatactttggaaaagtgaagtcacgggacaatttttacgtatgatcaattagcgtacaacatgttatacctaaggtactaggtatcacaagtatcaggtaccaggtgtcgaaggtatcaggtaccaggtatcacatgtaccaagtgccaggtatcacaggtaccaggtgccaggtatcaggtatcacgtgtcacaggtattaggtaccagatgtcacaggtatcaggtaccaggtatcacatgtaccaagtgccagatatcacaggtaccaggtgccaggtattaggtatcatgtgtcacaggtatcaggtaccaggtatcacagatatcaggtagcagctgtcacaggtaccaggtaccatgcaactggtaccatactggtatcagcatagcggcggaaaagcgaacaccagtcaaaaagagaaaaaaaataaaatctatgttacataatatcattgtgtcaattaatttacacgacatactaaatctcaatgtgtctcactcaagaaaagaaacaaagcaagaaaaggagaaaacgaaaaattaaaaatgaccgtggtatatagaagatgtaagtcaagcctacagaggtgcatgcccaaattgattcacatggcctaagtgcccaaccaatatacctagagttcttgtgctgcaggaagaacacatacaagtggatgtgttgtggagtatagacctgccacgtagtaggaaattgtgtcacatgcgtgtacaattattttgatggaaataacgtagaccttttaaggcatcccgttcccgttatctagattttctgatattttttcacactcttttcgcctttttttagcccttgttttttgggtacagaaatctttctttcctttttaatggaaaatggaaatcctttcttgcatttcctctttcaatcggacagaaaaagtttttcgcactttttttttggcgcacatatgacggaaatttctctaattttttaagtagtataatagatagataatagatagatatagatatagataaggatagagatttttttaataggacagaaaaaaattcgcgcttgctttttttttggcacggacgacaggatattttttttaatcggacggaaatattttttcacacttttttcaccctttttttagcccttgttttttccgtacagaaatatttctttatttttttaacggaaaacggaaatccttttttgcacttcctttttcaatcggacagaaaaagtttttcacacttttttcggcgcacggacgacggaaatttctctaattttttaagtagtacagatatggtgtttcctgcatgatccttagctgccaatcccctgttgcggtggctatagatcactgcaacgatcccatttcccaccttcaacagcgacgccgatctagagctccgtcaaccctggccggtcatttccagttatgaactttctcatgccatggctaatcatcaacctatcattgtttgcaatttgctggttgtaaagagatggaagatcatttgtgctggaatatcattttttggctatgaagattcatcatacaccatcaggtgctatgctgactactatttgtgatagaagaagacattgatgtggggggaaacagagaagtcctgaatcaaggaggtaggaggtggagcaaatctattttggagctaggcatgtcttttttttttaatcagatggccaagtcacctaggatgagaggagctcatactatgcgagtttaatgttgactgctcaaatttatctattaccacttttaggattaaaacattagtattgtgaaggaaaacaagaaatgatatttatttcatgccattcttttatatccgtttacaaccttacatgaagctaaaaaaaaacatggtttatattatcaattacactatagcgtttagcacggtgaattgtttggtttgtattatcaattacaccgtagcgtttagcacgggtatattactagttcctgctaaaatgcctctgcacactactacataacgcatcttgtcatgccttattaatccttaactaacatgctatcagtagctttgaatttgctattgtgctattctattttttttcttttttaaaacaatcctgaaacattggttttcacctctgagaaagtccctttcggaagtatataatatttgcttatgttgtcttttatgtaagatgatggctctcctagttgatttgtattagcctgaatatgagtaggctaataattagctatagatattattattttaatatatagttccaacggtatggctttgtgaattcctgcctatgtagctactgtccaggtctcggcggaacccagagcctagtcggtttgtgttggcaacgggtaatactgcccgtgtgcacatatcttaactaattaaaagattggtatttttccaatcgtcacctcaattttcgttcatcccttcgtccgcaagatgcgatagccacgactccgcttcttccgtttattatccgattgtatttaggtagggcaatcggagtgggaaatccgccgcacggccttgcggggaagaagaaaggaattggggaagagggaataaatcagattgaaatttcccccaaaatttccaaaattagtaaccctaattcgattgtatgaccgaatgcatgaaaacccaaatcaaattcaaatcttatcttatcttaatctaatttttcgtccgtcccccagaaaagatcacagttgaaatttcatcacacaaatagacggagaaaggaaaaactgaagcatatatacacaaatatatcccaaaattgccatgcaactagatcgaaggagaaggtgccacagaaccgcagccggctcccttcccgttggatccggcggaggggagggtgccgccgccgctgggacgccggtgggccgccgtcggctcccctccctcctcccgctggatccggcggagggaagggcaccgcccctgtccgccgcctcccctcccgccggaagggagggcgctgccgcccgctacggtcgagccctcccacggccccatggcgagggagagaaggcgagaggcggagagacgccgccgcccgtcgccgctcgcagaaggagcgccgccgacgccgaggagtagcttgccggccgctgctccctagcccgtcgtagaccgctgctcgccaggcagccttggcatggcgtcgcatgtagagggagagggagagaggaggcgccatggtggggtcgtaggtagagggagagcatggctgagccgctggctcggaggaagggcaccgccggctctagggagcggggcatttaactatttgccacttttagatgtggcaattaactatttgctacacctatctcaatgacatgtgggtccacatgtgtctatgatatatgggtccaatggcaaatagttaattgacacatctaaaagtggtatatagttcaatatctcctagggagcggcgcctccgtggggagagaaagggacggagacggagggctgaggagagaagaagaaaaagagaagataagagaaaaggatgagcggtggaggagagaaaaatgaggagattagaatgggtggaagaatcaaggcgcaccgtgcacgacgctctctctcggtctctcctctctctctccccgagcggttattgctaactaagctgtcaacagattttagtggcctgcatcatgcgatttttttggtcgtcacatattctttgagatgtgtgcttggatcggcccaagtgtggcaaggtgacgtgggctctgtaggggcagagtcaattgggctccgcaagactgttcaattttgatttttgtgcgtcccttataaatttaccatttttaaacgttattaaaaaatggcactaaaaaatataaaaataccactagaattatcattcgagtgacatccttgtaaaaattaaaaaaccgatagcaaatttacaaatgcctcttaagaaaaccatttataacttagtactttatttataaaagcggtatatcttatcttaactacttaaaaaaataataatttttcgttcgccacctaattttttcgttcgtaaatccatttttcgaccgtacgcacatttgtgttagcgttcgtccttcgttcctttctcgcaatccgatttgagcgatgcaaccagccaaggtgctactaaaacgaagggaaaaacaaggatggattcgatctggacccagaatcggaccagtaaccacaataaaatcagcttgaatggaaccatgagattgcaatacaataaaatcgatcaatcacctggtactttgcatcggcactgggcactggccacctgctcgtcgccacgccttctccacgatgcctccggcccctatgtcttcgtcgtcgagacgcgccacacacgacatcacgagcagcgtcctcaccatcagagtgcctgcctcagtccccgccgccacgtcgcacgcgtcgtccgctctggggatctggctccagatacccagagcgaaataccccttttacaaaacataattaattattttacctgcactaattaattattttaattagtgtgggttgtcgttgaggcacgccacgcacgacatcacgagcagcacccttgccatcagagcgcctgcctcagtcgccgccgccgccacgtcgcacgtgtcgtccgctctgggtatctggctcccgtctccccgataagctggtctcccacctccttctcttacaccgtggcatcagctaactccgcatggaagctttgccgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggatgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacggttgatgtgctccgccggctacctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttctaaactcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtctacgacttcaccgccggcccgcctccgtcgccgccgagtggtgcctccgcctacacggctggcctattatgccgccgctgttgggcgtctacgacttcaccgccggcttgccaccgtcacggccgactggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgagccgattcctagcacccgggggctcgttggatggaccgagtaacgcaaggtgctaagtattattcggaataaatcaaaagcatagagataagataaatttattttctgctcttaataattgcaaaagtacctgagtagtaaattctaatccgtgaaactttgttccattaatgacgaactcatgtcactcatatgcatgtttgggaagtgcctaggccgactcccgatgcttggggactatgactagtcgggcagagtgtttaaacgtaaggagtcatctgctcgaggaaatcacaattgacaagagaagaaatacatatttataaacattttaaaatgcttgattttttctcgagtattatatttatatcagatactactcatcctatatgtttgttctgcaggatccagatccagatatgcataaaagagattcatggctttaagcttatctcttacgctccaggaatggatcagtcagaacatcatcaccggctcgcctcgaccgcggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacatcttcactgaccggcttgccttcgccgccgccgactggtgtttccgcctgcacggctggcctttatgccgccgttgttgggcgtctacgtcttcaccgaccggtttgccttcgccgctgccgactggtgtttccgcctgcacggctggcctttatgccgccgttgttgggcgtctacgtcttcaccgaccggccgcctcgtccgccgccgactggtacttccgcctgcacggctgacttattatgccaccgttgttgggcgtctacgtcttcaccgaccggccgcctcgaccgccgccgactggtgtcaccgcctgcacggctggcctgttataacgccagctgatgctatcttcttcacggctggctacatcgctgtcactactaataggcatcagtatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaacacaactttgtcatcatggtggagcgacttcatctttattatcttcggtaccagcaaactctattgctgctacttcgcaagttttgctacttcaccaaccacgacgtctttgtgagcttcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttggacaacaacatcaactctcctccaagtgaagcatctacaacagctataacattaatttgctggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtagtcgtcaactacacaactttatcgctgagcgccttcatattcattgctggctgacttgactgccgccgactggtttcttcgcctccgtggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatctttaatttggatttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatactttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagatcatggcaaagatgattgaagcactcggctttggaataatctagttcgggagaagattatctttttgactgtgaaggtctcaggggctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacctacctaaaaaataaatatttccgttcgtcatacaaattttcatccgttgccaattgggcaaagacaatcgcattgttcatccatccattttctcccaagctacaaattatccaaactaaacaccatatatattccgcaaatatagagcagattatttatctaaaaacaaataattttttagcagattagttatctaaaccaaacaacactttttgggtcactgtacacatcccgcaatcacccggtgcaacgcacggacacttttgctagtctaacctaacataacctacttacaaaatcttaatcttaactgtaattttctgctcgtcacttgtccatttcgtccgtgtgtaatttcgttcgtctgtccgcgagatcgagagaccacgcgtcgctcccgtcccgcacgcacgtacagaagaacaaatccaatccatatgagccaagaaatatgaacggaaatagagaaactgaatcacaaaatcacaaatacaacaacaatgaatcaaatatccaaaaaactaaatccgaagaactaaatcaccggtgtcactgctcatcggaggccaagcacgcccatgccctgaggctgtggcggcttggcaggcgcaccgccacgtgccgcgaggagggtgctgccacagagccacttctagagaagaggatgatgccaccgagaatagggcgtcgcccgccagggaaggagctccgctagggaaggcgccgtgcgagggcgccatgagtcgtggcagcgggggagggggagcaggagcagtggcgctgccggcaggggtgggacagtgtgaccggaaaagttgccggtgggaaggagctccgctggccgtggggagggcgccgcggctgaagtgcccgctgcaaaggttagtgcgccgctcgccggggaaggcgtcatgcgagggcaccgtgggcccttgcgaaaggggagagggagtgggagcggcggcgcttctagtgtgggtgga

SEQ ID NO: 34974 - DNA, 5820 bp, Oryza sativa
  unsure (1)..(5820): unsure at all n locations
gttggacttcaccggtggtggcaggagcatctccatgaatgtatagaggaattcagcagtggtggcgttgatttctgggagtgaaggaagagaaacggtgtcgatttgtggttgggggggggggtgggtggtgtccttttttttttcttttttcgtgctaggaacatggatatttgggggaagttccgatgcatctggaaggtaggtggagggagggatataatgtcatgtgtggcttacaggtgggccaaggctatgaatgtaaatttttcttatgttagagctattttgcatttttatttaggaaaagtatgttttagcaaaatttatagactggtttaaaaaatacaaagggctaaaattttaaatcatcatatcccatccaaaacaattgtgcattgtagagtagtatccattcctcgtgcctttaggcagcattcttcaccgtctcggagctcatgattacagtgtaaggcattctattgtcaaagattgggttgattagatttgatgtctcgacaagatcatgtatatcccacgcgacgcttagctcatgtcaagttttgatttaaaactatatgccgatttgagacacgtcgtaggacttgattcatcgttttttccatgtttaattctaattgtgttctactcggccctctactcccctcttcctctctctacctaaggtttggaaatgccgcaatatccctccaccattgagcaaccacctcctcttttcttttacgctattgccttactcgaccattttgcccaccttgctagctccatatcttgaatcaactagctcgccttttctttacttctcgatcgcagtcaatgtggcaaaatgacgatgggcaagtgaaaacatgtagataatggatgttacatccaatacgagagaaaattcttccagaaaatcttagtgtgttaaagcatgtagataagaaaaaaaatctattttcgaacaacctatgtgaagaaaatattttcttaaagggcttagatcattgttggtatttcttacgatcacagataagatccgcaagcgcacggatataccgatgtagcacttcccctacagagtattcgaagggtattgaatccaagggaacgtgtgtggtcagatcttcctccgggttatccaaagacactaaacagtgtctacggaaagcttaattttaatcctaacgcaatacttcgggcactggccacccgctcttcctagatgtcgctctactacgtacccggacagggaggacttaagtgctcttgagtgctgtcaccacctctacacctacctcaaacgtactgtgggatgcgcagcaaccactgtagattaattacccagacaccgcgtctacgcaattaataactactctagtgccgatcaaacactaaagcaaccactataaataaataaactatagtgatcaatgatcccgtatgctatttaggaactaaccaagaaataattctcacgagataaatctaaattactcaggaagaatattatattgaattcagagtaataaacagaataaaataaatgagagaagattatcgacaactccagaattcttccgacttcttctactctactctcttcctattctagtatgcaatatagtacaatagagcctcttataattcagctcaagcttggaagtgtgtgtcgaagtgagtaaagtgaagtctttatatagaggtaggtatgacggttagcgaaggggaaatgtccgaactgccccgcaaccgccatcaaggagtgatctcgaatgtccatgccaaaacctgagatcaacggtgatcaccagggttctgccgaacttgggccatgccccccaggcctggcctttggcccatgtcctcccctgatcctcctctatccattcctcggtattttgggctgattctctggtattttgatgaagttcacaacccatccttgtgttgatacaagattctcctcactttagtctagatttcctcccaacttcggggtttatcacctgcatacaaatatacaccaacacttgtggaatatgtgagattaagcacctatcactatgttggatgttttattatctggacttttatgcagatgttggcggtatagaatcaaaatttaacagccgccaacaaaaccccccacacttagttctttgctcatccctgagtaaaggttagtgtagaatgaatttcttcaagatatgaatcaggcatataaaatcatttacaaccatacatgtacctgtgaactttatcaatggctatcttaccatcttgagcaattgataaatggaacgatctcgattcgattccctcttgcttctgtgccagactcatgggatttttatgaattttcgcaaactagctcttttcctcgtattgactttctctcttatctctcaaggatgtatattttctttttggatcctcaccaaggcaaaatgtaccagaatttatccctattctaaggctgatatgtggagctcggtagggacaaattgtgacatacctgcatcatatatattacaaagccaaaaatacggactcaagaagatcatcagtcatactcctagatcaagggtatttatttgtggtagaaaatggaaaagtacatttttttgtggaatggtggaataaagaaatgattctcccttttttcctatactttctcctcctttttgttttcttggcatgaatatggaaggggcatggctatatttcttttcatcatgctcaatgttttgagagcacgctttatttcctctcttttttttttcttttccatagccacgcctttccctccttttctcattttctttttgccaagacccccccttttttttctaggagaagaaagcataatctaatgtaggagtttatttgaatggaatttttgtggaaagccaacttccagtgtagaagcttagcttaattatgtatgtggaaacggaagtggaaatgaccccttgattatgagagtatgtaagatatctagcacgagtcacacaaatttgacaaagctcaatataatgtcaagcagtcatacagataataaggtttatcaaagatatatttgcatatgtccttggtaggtataaaatgaagtcaattggaggaacgagctttttaaaacaattttatttttgaaaacagattcccaagagtcataacaaaagttgcaaaaattcctttcaactttaatcatctcacataaagcaattacttagatgtataagggttcctaaacatggatggttgttcacaagcacaagttcagctgagaataatgaatatacaagaccaaccatatgaagattttcattagttggaaattttatttttttaattatgcttgaaccaattgttttctgaattttcagctctagtactataccatggtggagatatatagataaaagacgtgctcacctacttacctgtaaaaattgagagggattggggccagttttggttcggccgaaccactctggtgcccattccctctgcaattttctgcagagttgtggtggttcggccgaaccactctggtgcccattccctttgcaattttctgcagagttcaatgtcttccaggtgttcagagattcagcaattttcagagtatgcgcacgtcagaagctgggatatcttccccacacttattcaaaacctgaactttattaaatatgaaacaaaaaccaaacttggcatgcattggggttaacaccaatgagccacattatttatagcaagtgcttacatgattggaaaaataaaaaccaagcacctactactactttattcgtgggggagggtacatctaattagcataatacttattctccttccccatctctatgaatgcacgcttgattttagcgcacaaaccacgactaagggtatcaaaattatttctaagttcagcgagttctacccctagctccgcgttgcgatccctaagctctatgttctccttgcggagtttctttacttgcgcggcgagcttatagaccgagggctcctgtgattttacttcatcttcttggaattagccgtccgcccttataattggagggggcgtcaaatgacgcttcaccttcataggtggagggctacgggattccgctgccccctccttctccgatgtcgtcaaaggccggagcaaacccttgccatacccaccgccgggagttaacactccttgaatgcgaaaccgatcctccttcggagtggatggagtagcggtggtgtagtgtacttgtggagcacctcatctcctgcttttgtgaacatggtgcccacatatcgctcggcgggaggcggagcggccttctcatcatcttggaaaaggcgtcacgcctttaaaagaccgagctcgcccgttgtcgtccgtcacacaggcgaatcccctcggattttggtcttcgtaacatggtgaggggagagggatcgcactgccgaacggagccaatgggggttcggccgaacccctggttctgccgaaccagggagctcgccaacgggctccagattcgcaggggagcccggcactgtcgcaaggggctgcgcccacagtgcattcaccctttccatggtgtagtgttccaccgggatcaattgattcgccggtgtcggctctccgtcaaggttgtatgtggagttggaggaagagccgatgaatgggatcaaagatttgccagctattggtgaattggaggtgatggagcaagggaattaagataagatggagaggaagcttgcaaaagtgggggagaaaaggaagaatatgtattctggaatgatacgactgatctaccttcgaatgcgcatcacaacggattaaagacgagagggggagactgaagttcaaaatcgaggctgattgggcgccgccctggttcggctgaaccctagtggttccggttggccaccaattcttttcctagtgtttacacggattttggctcgtgtcctaaatataatttgttaaattataaactgatgtattatctcaaatatagtgcgtacaaaatatatataataagaattttatcgagagacagatggtgaagtaatttaattaaatagcggccacgaaataaatggccatgaaataaaatgtaattcacttatattggacaaaaataatttttggcttaaaataggaatgcatatgcgcgttccacatatgtagcgtgaacaaatattttccatgcgcttttcgtcggaccggcgaacgctaatacttagctttctcgttgtatccgcatacgaaatttggcctgaaacatatggccattaagtgggattttctcactgacccgaaatagtcacgccccgaatattttcagaaaaggcatgcccaccatataaaatagcatacaaaaattaaaatgtaagccaaaatagatgtttatctggctagtgaaaaatcgtgccccaaatagtcgcgacttaaaataaaaatgcatgccacgtgcacgccgctataatggcgtggatatatatacacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34975 - DNA, 3950 bp, Oryza sativa
gaacttaacaaaaccagaggcatatttcaaggtcgcgtgcataccatccaccatgctcttcaggtgcttgggtttcgccacacaaacattatggtgcttacatgctgttaactttcctttcgatccgatggcatgaaaaattcagcaccagtaatcggtggtaaacagcagtcacaccggcacaagacaggcaagatgaaactcaaaacaatcgccatcctcaatattaattaatttgttcatttccattctgcttgcattacaccataatatggaacaaaatgaacagaaaagtcattggtcagacactcagacctatagtacaattgttgcactcaagaaaacgcctaaaactgctaaccaattaaataagaagaataaaatataacgaactgaaattctacccgggagcgctgatgccttcatgccgctggttttcagacttcatgatgttaagggagcagaaggaaacatagagtagccttgtctgatctataaactgagtgctttggtactttttaattagggctgaaaacgatgcctataaatgtgagttgtgacccaagatatgagatatatagaaaaatattaatacctgaagacgccaactattggaagacccttttgcattgcaatgtcacgtctcattagtaagacagctcgagcaccatcacttacttggctagcgtttcctatgggttaaaacaaacactaatcttgagaggtgaatacaactaatcaacagttgtgcctaacaaactttcattacacattaccagcagtaggggtgccatctttagagaatgcatgtttgagttttgactggactgccaatgaagtgcctggtctagatatattgactcaggactaaagtgtcttcaaatattctcagtaatacgcccagccttcaaattcagtagttttatttatggtgtaacatatatgctaggagtaaaatttttcatggttaaatgcatggtaattgtaatgttaagttggagtggcaatgttgagatcagccaaatggggaaaatgaacatcagtacccttcattggccatttgacattgagaagaatatgtgcaaaatatctggtcatatcaatcacacaaggaaaacagaaataccatatactgctacagtggtcagtcattatatttgtgttagatgtatttttcactaaataactaaatattgcatcttagagatactgcttttgctattgatccgaccactattttgttaatttcattgcattttaggcatggtatctcaattagcagaaaaagaaagatgttataacgcatcaatgagatcttctagagatgatatgatttttaattttgtactgatcatcatcaacatataaaatatattccccatcagttaaaattttccagactgctctattgatagaaccgcttagcaatttttaaatggtacgatacatagcttgcgtacgtagttcatgcacaggtaagtccaggcaatatcaatcaaatgcgcacaggaccaaatcaaggaaatactaagccaaacatcatggtaaaggagccaagaataccttgagctagcaaggtccgagcttcccttcgtgcatccctggcggtggacagtaagccgaggtggacaggtgaaaaaacagccaggagtcccacaggtcaggtgacctctgaaggagacaagggatatgttgattgtttctattattcatatgacaaatgttgaaaaaattcactcaaaggtaatattctaaatttggaggtaccgatgcaagaaaaaccactacttatgtggcataaaataaatttgtagaagctagaaggttaatttcagagcgaacaagatccgttcttgtaaacttgtactgatgcagtgatataaactctacgtccaatcaataatttaagtaacatgatggagaccatgtagatatcactcaaaatacaagacaagtatttcacaatagacaatcatatgcagacattcacgcacgacccaatcatccttttctaactttgcacaacgatagaagaaatgaaaggttttaagccatgataaataatcaaagctgtagaagcttccgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcataagggtactataagtataagtatatacattcatatgggtactataagatgtaatttaaggcatatatgtacattttcataatatatttaagaactccaaggcaagcattccatcaagcaggtcacaagcagtggcgacgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgagtttgaatgcatttgtgcataccgggtcagcaagccagtgcatccggggcacgaagcccaccatggcagagagcgcactctgccacacggcgaaggcggcgtcggtggtgagcccctggatgggcctgaacctgttgttgaggctgtcctccgcgttgatcgcgaaccgcacccgcgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgtggcgtcgcccgcgtctcccgtcggccgtctcccccgccaaacgccgccgtcctcacgccacctgccgccgtcgcccgctccgtcagctcaccggtcagttccggtgatgacgggccggatccagccacggaagggccagatccggcggcggcggatccgcagccacgcgccgcgaggccttcgcggcgcgctgtgccgcctccttgcgccggagacgagccgccgtcgggggttttggccccgccgccgccatcccagcgtccgcgtggtttccggcgccggcgagccggtaaaagaaggggtgggtgccgccgcccgggggctagggttcgcccccggtcgcccgcgcgtggacgacttcttcggtgttccctcatacaagaaggtctcggtcatcttctttgcctgcaggcatcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacgatggtggtgcggactgcggaggaggagcgcgtcgattctgtgaaaaatccggcgcacgagtgcacgacggtgagggggcgagagagcgcgaggaggaaatgcgtgggagatgcgggagaaagaggagggaagagcgagacacaggacggtggatgcggcgtgatttcaccatttcaggtgcggggaggagaggagggggagaggtggggtaatctgaggcgttggattggatgattttagaccattggatatgtgatatgatgaatgatgagtgagtaaaaggatttgttgaactaatagg

SEQ ID NO: 34976 - DNA, 20612 bp, Oryza sativa
ttatccaacggtcagactcatcgacgcgctcagcccctctatccccaaacgcgcgattctcctcattctcgcgattctcccaaaaaaaaaattccatcctcaccctcctcccgtctccaggtcgccgcccgcgccgatctgctctgtaccgatctctcccactggcattgccttcctcaccgatcttttccgctccgccaccgttcctcgccgccggaagccctcaccaccatcgcactccgtcgccttcgcgattcccaaccctaaccgccgtctccccgcaggtcgccgtcaatcgccgtcgccccgcaggtcaccatcgcaccgccgccacccggtcaccgtcgcgcctccttcggtctctttacatcgcgccgcagacggatttccccgccgacggggcgccgcccatgccatccggtctagcgcgacctccgccaaggagttcggtatgtccctctcaccactgatctgtacgtactctgtactaactaatgcagggaagagttttcatattattcgttttttttatttcagtttttactattagttgtcagtcaaattctgctttgtgcagactaataattttttccttgaaaatgtaatttgaaaatgagatggtatgatgtcatgatgatgggatttacaataaattgagcttcatgtttcatgggtttttatttatttgtatatttgcaatggagaagagaacatcgttgttaaattattttacaagcagttcgagtatatatatgaaaagagtattcactacaataactatatcataataatgttacttttatttgcagatgtgtgcccatattatttactcaatcatatgtagtcatttgtttactgaaatctaaatcaggtactagactttatacattggatgagctgcagttcaatggtatcgtcactgctgcttttctgactcctgtggatctgaatttgggtgtcagacgcccacccaaacggcatctgaatttgggtgtcggacgcccaaacagccagaccctaacaacagctgctagaaaggtctttgtttctcctcaactctcatcgtgtatatatgtttccctacctgattccatgttaaaaatgttactaagtctgaaccattaattttggtatgaatcgtgtgaattttgaagagaatagcatgtgcactgttaattctgttggacagaataaaacctagacttggttggtactataatctatccaacatattcagttattatgctctgtattgtagtgtagccaatttattcaattattcttctttgtactgtagtctagccaatttattcagttgtactatttccagaataggggtatctagggtatcaaattatttgattattctatgagctacatgctagaaccattatgttaagtggtatctctacatcgcgccgcagactgattccatcaccggccggtcgccgcccaatggttcacaaactctcaaaacatgctctcagatacgttgtacttattgtccttcaatatataaactcacaatggttgagtgctcaatatatcttatctaatttgggaacatactatttgattatcattcatataaagctggtagtatccccaggtatactaattgactttgttgtggatgggtgaataactgcagatcatcagcagatgtatcaacatggggaatctcgcctaatttctaccctggcacctcaagctgcatatcaatggcctttgataactatcaaggataagaatgtagtttagttttttgtgttcaggtatgaccaccctcgaaaaaaaaggtatcacaaatggttatgagatagtagagatttatgctcccatgagactaaatctctcataaggatgccgatttactgtaagtgaaaacaagctaaagtgcatggagagtatctatggaagtaatatgagcactgagtaggcgtctgcatcaaatcttacatttatttctatctacagttaaagaatgctaattaatctgtaatttgtcaacctcctaagctatatctcgtattattccttcctgtcattttactctgccaattacatttgcttttaccaattttttaaatcttccaacatgcacaatataggccctggtattttgctttttttacaggattcctgtaagataacatgattgcaatataccttgatcccgagagatgatttttgcaatgtttacccaactttatttgctgacactattaatatccttctggtaatggttaggtttcctgttattcattcgatgttataaaatttgtaacaaaagtgcataccaaaaggttattgttgctaatatatcctcaagaattagtgtgttacagacatctgtagatcattttttcttcgtggtctttgacgagcagatcatagtactcattatcggttatcaatggtttggcaattgcatatcaaacaagtatcctgtttacgattaaacatatggttgccactgaaatttcttcctaacattttagagggaacctgatcatgctatctcatcagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaataacatcaatataaacaagcctttcaacgtattttttctcataaaaaactaatctaaaataaaatatgctatttttttaatatacttaaatttattgtactagtaaacgtcatatttcatcatagatcgttcttttatgggacggagggaataggagccgcctaaccaccaaccgacgttccaccacatgttggaatgcatatgacagttgatcacaccgccaaagttgtacgtacggcggtagacaacgttgcgtgggggtcggccactcggctggacctattcgcgccgtcgatcgatcgtgtacgtacggcgccccactactcaccgcgcatagtactgtacacgtacgacgtatactactcctacctaagaccggtcgaactaatcggcaaaatacgacggcggcgccgcacgcacacgcgcgagcctttgacaacgcgggacgggacaccacgtacacgttcgtcgatcaatcgatcacccacacgccaccacacgtccacgtacgttgttgagttgtgatccaaatttatttgcacttaataaaagccagctccacgttaaaatctcgttttttttgtgattgatctactgttatttatcgtttgtttgcctatcgttttctaacctatgtaacatgtacttacaccacgtacgtataactgccgagccaacacgcccgggaagaacgctcgcgcgcgccggggagacgacgagagaattggagaccgggtgtgtgtgacagcgagacgccttgcccccgcgggcgtacccgtacgtatacggagtacgttcgtacgcgcgaccgcgaccagcgatgcgccgcgactcgcgggaccgatcgagcggaccactacccgtacgttctgcgcctgcgtgcgtccgcggctcaagcggctggctgtgctgcgtggatcgctgtagcgatcgatcgatcgcccaggtgtggtggtgggaacgcacgcgctcgagttcggcaagatgtggtagtatcagcgaccacggaattttcgttttcgctattcccaagtgggttcttccggtcgggtgggcgggcgggtgacgcgctacatcacccacagcaagtataatagtactactttgtactgagtacaagtatatcgtaaatttatggtctgtccactttgatatcatttttaaccatactattttttttaaagtaaagttatcaaaattttactcattcatcattcatcatgtcacacatccaacgatccaaaatccatctgatgacttaaatccgacggctccccgcctccctcccgatccgatccagatcgcggatcgcttcccctcccccgggcaaaatcaccgcgcactccctcctctttctatcgctcctgccgcctcgcctttcgcccccctccatctcgccaacgccaccggcttcggcttcgccacccccttcggccggcggccgccgcccctcctcccctgcgccgccgcatccgcaccgcccaaccccgccggccaccgaggacgcggaaaccgcacctcactcccggtctcccacgcctccctctcctcttttagtcagaacgcggacgccctcctctctcgcagccgtcgttggagcgagcaccgccactccaatcgccggcaatccccttcgccgtgcgcacccgtcgttggagcgagagccgtcgtcggttcctcctccaccgtcgccgccaccggatcaccgacgccgaccgcccgcatcgtagcctccgtgccaatccccccatctcgcgagcagagcaggggaggggaggggaggggtgccgacgtgccgtggtcctgctgcatcccggtgagcatccacatcatctttctgattcatctctctctctctctcccacccacttttgtctcaaatttacctgcattaaccctagcttctcttctagatctggatggagctcttctcttattttgtttgtttgtctccccaaaagtccaagttcgatccgcccctgctagggataaataagattcaattcaacacgaaacacacgcaaaattaatctgaagcacaagccccttcactcccttcacacgcaaaatcacatctggttcttgtagtttagaatgaacataatgctacagtatgccttgctgctcatgaactgattgacaaaatgtctctcaaggttatatctgaaattctgagcatgttaatttgtgtctcccagtaaggttctgtcatcttctgtcatccattagtgcccaatcaaagaacttgcatataataacatatattctattcttttaaaaaagcagaagctattatctgaagttcagctctcagtttcacagtaaatttacataattaacagtgcatgtaatttgtgggtactcttatataggaaaggaagatcagcacaatactgacgggtttctcttcaagatgatcccgtggttctcagttttctgctttctacactgtctacatcttatatgtgttcattgaagctacagattgatggacatagctgtcaaacctgaacctaccaggcctcctggtcatgtttctcctcagctctcatcacatttatatgttttcttacccaattccatacaaaaaattttaccaaggcagacccgttaattttggtatggatcatgtgaattttgaagagaatacgtacaccgttaatttattcatgcattctgctttatactatagtctacccaatttattcaattattctgctttgtactgtggtctagccattttattcatttttttcgcgttgccctccgctgtcgtccaggaccgtcgcccacggcgctggcgacgattcaccgccgacgtcatcgtccaacaccgtgacttggcccttcgtcctccatgtccaccgcgccctcgccgccattcataagaacaacattgcagcacccaatctgtggcaccccatcgacacatacgaccgcgtcgccctggctcatcgtggctaaccccaccgacgaggtaactagatttaccttttgcttttgttcgattgtttgacggccgagcaacagggatcgcgaccagtcggcaagctgactgttttggttaactgataagtgataactgaggaatttaaagctgtgtgtgcttgtcatgtgctttcgggtagctgttcttaaccactgccaaaagtttcggaaggtgatagaaccaaacaggtagttctttagctgcctgtgcagtgtgcagtgtgtctctggaccaaaggttgtaaatgttgcataaatgtttttttttaaaaaaaaatccagttgaggtactcttgggtccaaagccataaatgcataaataaggtccaaaggcactaatttccattgctagctttcttgtcacttagtttcattacatttgacatatacccagatgatttttgttcttgtttgtgtacaggttcagagttttttatgtaataattactctctttccatatatgcagtacatttttattacacgataacatcagtgttaatgttctatatggcattactatcattatttttcaacttatgtcatgcatatcattccatatcttttacttctcttttattatgaaaatgacatctttctgattcgttgagggcatgcggggtagtatatctgttattttaatatattcagtgttttcatcaatatattgaccaaatattcggtttatatcagtaaagggccatgttcttttcacaagatctgtttctgaatatacagactgtgttgcaacatttatagaattcaagttgtccgtagtcctgctttgcatgagtaaatgccaatcttatgtgtctgaactcttttcttctgtgtctgaactctcaagtgatgatctatgtttcccaaaaaatcttatgtctagcaaacttagtttctgtttccaaatgaaaaatcaagtagtgaataatgtacctgtattaaatgcactggtctcttatttagtaatgtatctagatacatatgctgaatttttatatatagaagcatatgttgcttttacacatgaaggtgtatatgctatcaggtttctataatatggttcataagtgaacagcatcaaatgtctacgttactttagtttgaatgtacacgctgatataaaatttagagagcattcttggaatgtacatactgttaagaaaatttagatgaattaaatccttatgccttatatgttttttctcacacagttgtaagtttgtttggagaaggggacattcacaaactgcttgaaagaggtgttttggtatctcaatatatggtggaatatttactactgcttttagtaactcctagataatctttttttacatacatgcataactaaatttgcatatatcttcatgtgcaattgcgctctctgatattacaatggtaggatttgtctttgaattggtatagtgacgtatttctgattcattaagggcaaactggggagtagaactgttatgtgcgagatattcagtttatatttctaaacttgggtgcactttgaatcaggacgaataggctcagttgaatctgtttttaggatgatgcttactggattgccaattttgaagttccattcagatcaaatattaatgatttatagattcaggtttgtctgaaaacgatataaaacaatatgctttgctgaacttaatactgggagatcactagggtggggtagacggccttcatggcgtctaggttctattgtggtccaacacatactctttttaccgatcctaatagatttggcataggtttatctacatctgactatgactactgtatattcctcaaaaatcctattagtatatgttttctgttctgactcgtctggttgtctcttatattaaaggtaaggaaattgaaggagttgtagctatccaaatacatcagcttctcaaaatagaagagctaaatatactagtaatatgcccgtgctaacgctacgtgtatgtttagtaatagaaatcatgacacatagtaaagaaaagataaagattaggaaaggagatgaaaattagattgaatacaaaaatttagggacggaatattcagtttttgttagcaataaataaataaattatgggccgtacgtgtggcttcagattgggccgctccaaaacccagactctggacggctccgtcacaagttacgccggccgcgccggcgccgccgccgccgccctgcagctccgctcccccggtctttgcgcgtctgcccgacgctccgctggcccttccctcgcttgctcgacgccattgccttccggccactgcctcgtgccttggcctggtgcggctggtcggcgcccttcgccgtccgccaccttcgtgcctgcggctccaacgccttcttcttgcgtgcggacgcctggagggcaggtaataacaaagctcttccttctcccagctcctctccaactccagtggtcctggtgctggtgctgtggcggtggctctcccacatgtgccccatttgatcttcttctcctctttttttttttttttgtcattgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaagtggaaccattcatgtttttatcttctttttttttccattgtgttctggttgttgtaaggttttcaaagaattgaatcaaaatggatgggacatggtatagtgagaaaagttgacacccttcaatggcttcgatttgtcttattagttgtagtattgaacttcgaattttttccacatactcctcatagatttaggaggcgttgatatgatataaagaacaatttagtttgcattcctggttgatttgaaatcattccactgttgcttctcatggttgatttgaactgcagtgtttgtgaatacaaaaggtacaaacagttgctcctttgttattattcttcctttctcattctctcgtgcgttctgacaatttggtaaacctatagtcatgtctatgtgtgcatctgttgcagctcaaactattttcatgttatacccccttatcacacataaatagtcaaaattttcctactagggctagtatttccgctgttgtcctgagattgacatttgaagtgaaatgatgaaatggacattcacagtcacatgctcaggtggataatttgtaagcatcgcaatgctttagtgctacatagaacaagctttgggcatgaatattgtcactgggagttgacaattgatcttgcatgatgttaggttgttaaaaccccaataatccagataagaaggattttacaggatggtaggatactacaaactacctttgattctgcaaccctgatggatagcatgcctattcccctttgtgatctttgacttattcttcctttacattacattggtttgcatgagattgatgtaatatgtatgatggcttttgctaattcagttatttttggtcatacagtgatgcaatggctgtttctttgaggattcattatgcataatggtattctactgcagctatgcttttgaacttgcctaaggcggtaaaaccaattggagaatggttcctttcaggtgcaagggcagcatgcattggtgtagatgtttatcctagtcactttgcatccctattgaaggaatgcaagtctgcaaatacagttcatcaaattcaccaacagataattgcttctggtcttctttctttgcccacaccattattgtcagtctcactaccagcattgccatcgaacccatttatatctccaagatctctgggtactggtgtcgtagcttcttatcttgcttgtggtgctaccgactatgctctcttggtgttggaacgtgttacaccgtcaccagctgtgtggtggaatctacttatccgagaacacatcaaacaaggccgccttgacagtgcaattaatgtctcttgccgcatgctgcgtgctggaactaggccggaccattttactctaccacatgtattaaaagcatgtggagagctaccttcataccgttgtggtagtgcattccatggattgatatgctgcaatggctttgagtccaatgtcttcatatgcaatgcgttggtggcaatgtattcccgttgtggttctttggaggaagccagcatgatctttgatgaaataactcagaggggtattgatgatgttatctcatggaactctattgtttcagcccatgttaaaagtagtaatgcttggactgcattggatctgttttcaaagatgacattgattgtccatgagaagcctacaaatgaaaggtcagacatcattagcattgtcaacatactccctgcatgtggttctctaaaggcagtacctcaaactaaagaagtccatggtaatgctattcgtaatggcacatttccagatgtttttgttggtaatgccctgattgatgcttacgctaagtgtggtttgatggaaaacgcggtaaaggttttcaacatgatggaattcaaagatgtggtttcttggaacgcaatggtggctgggtactcccaaagtggcaactttgaggcagcctttgagcttttcaagaacatgcgcaaggaaaatatcccattagatgtggtaacatggactgctgtaattgcaggctattctcaaaggggatgcaaccatgaagcactcaatttatttcgtcaaatgatattttcttggtccttgccaaaatgtgtcacaatcatctctgtgttgtcttgctgcgcttttttgggagcattttctcagggtacggaaattcatgcctactctctaaagaactgtcttctaaccttggataatgattttggtggtgaggatgaggatcttatggtgtacaacgcgctaatagatatgtactcaaagtgcagaagctttcaaagctgcacgctccatatttgatgatatacctctagaagaacgcaatgttgtcacctggactgtcatgatcggggggcatgcacaatatggggactcaaatgatgccctcaagcttttcgtggagatgatttcagaaccatatggagtagccccaaatgcttatacaatttcgtgcattttgatggcctgtgcacatttggcagccatacgtataggtaagcagattcatgcttatgtgcttcgtcatcaccgatatgaatcatctgcatactttgtggcgaactgcctcattgatatgtactcgaagtgtggggatgttgatacagctaggcatgtattcgatagcatgtctcaaaagagtgctatttcttggacatcaatgatgacagggtatggaatgcacggtcgtggtagtgaggccctggacatatttgacaagatgcggaaagcaggctttgttcctgacgatataaccttcctggttgttctttatgcttgtagtcattgtggaatggttgatcaaggtctatcgtactttgacagcatgagtgcagattatggtttgacacctcgggcagagcactatgcctgtgctattgacttgctggcccgctctgggcgattagataaggcatggagaacagttaaggatatgccaatggagcccaccgcagtagtttgggttgcattactgagtgcctgtagagtacattcaaatgttgaacttgctgaacatgctctgaacaaactggtcgagatgaatgctgaaaatgatggatcttacacgcttatctccaacatatatgccactgcagggcggtggaaggatgtagcgaggatcaggcacttgatgaagaaatcaggaattaagaagaggccaggatgcagctgggtccagggtcaaaagggcacagcatctttctttgtcggagatcgatcacacccactatccccacaaatttatgctcttctggagagtctaattgatcgcatcaaagctatgggatatgttcctgagacaaacttcgcattacatgatgttgatgaggaagagaaaaataatcttcttgttgagcacagtgagaaacttgctcttgcatatggtctcctcacaacttcccctggttgcccaataaggatcacaaagaacctgcgtgtatgtggtgattgccatagcgcattcacctacatttccaagattgtggaccatgagatcgtagtgcgcgaccccagtcgttttcatcatttcaagaatggttcatgctcatgtggtggctattggtgagggtttcttttgtgaaagcatcagaggtagaagcataaactaagtagttaacaatgtattactatatattttcccacagtaaggaatactgatgtaatctagattctttatactctagccatgaaaacttatcattttgggcatcaacatggtctcctaaatataactttgataacaatttctatcacaatatatttgcaagacaatactttgatcactaatctctagcccttctatcaggccttaccctacttacacttgcattaaccggagttatttttttggaactgttaattttatactctggccttaacctatttattaaactcatcatgtaagagtgtgagacttataccaccatattattacctccattcttttttacttatattttggatatcgtcagtcttccatgcacatgtttgatcattaatttttcaaactatgtatttataaaacttaataaaagtataactatatgaaatagtttttcatagcaaatctactaatatatattttcatattcaaatcctaatatgttttccatatattaatcgtttaacattttgaggtttgaccgcatgcattttatgatgtcatccttttaaggatggcgatagtatatataactcatgggccctatgggttctacacctacatacacgaaacccctttaggccttgttcgtttaatccctcttatgggtggatttgaaggggatttattcccttccaatccctctctcttggggattaaacgaacaacgccttagaaatatggctgctcagtgctggctggccattgtattctccaaaaccagttactcagtttgctaactacctttgtgtattagtttctgattaggtatggaaagagctggcttatctatcgtttggaattacaaatatatcatatatggaatagcaaatatgttatatatggaataaaaatatgtcatatatgctgcaaacatttcaagcacttctttgtatttcatggagaattggagacagatatttatattattctgctttttctggagtaatattgtagctttcagatctgttgcagtacaggtttggtatttgtaactcttttggtcctaatcgaattttgcatgtcaatctaattgtgggtgcttcttgtaccatctgacatatgtagctagctctttcaaagatcagtagctgtccttgttggtgcctcctgacaaatgcatgcactgcaagcataagaagcctttgcaggtatggaaactaatcaataatctttatcaggatgggaaattatttcactgcattactatatgccaaatttggacccttttgcgatataattttcttagaatttgctagacaaataagaaacgattgttgtctaatattgaggtgaagaaagtcacctgcgtactgttcaattcagattcacctgcttctgttctgcagcactttagaaattgtgttactgattccttacagatatacgtaagttcttagtaaacttcattgattgtgaataaaagcaattgcaaattttcaccaatttgatcttatcagcttgggaattgcaattataaatagttctgtgttttgtattcatcaacttgtttagttactgcacatgcttcctgatatgccagaagtgaagagatccatgcaacactactgtttgacgtgtaaatagcaacatgaacatcatgccatcatggatattccaattttttgaccaaaatttagatgtgtatctatactttattataacagcaccagcatcagtttggctatacatggagcgttgatacaagtagtcctagctagcgcttgatttgatcaaacacctcatatttgaagttggatccttaccttcaaatctccccaaaacaaataatttgtgctttaaaggcatcaatttaaaattttctgatatatgattgctagatgatacaggacatcatggccattcgtgatttgatcagaagtccatcaatttaatgcgtttaacaaagtctttttaatgactttgctcccagaaaattctgcctactctctagccatctccctgggcgaacccagtcccattactatcctcgcatggattccgttttctttgtccccttgccagcgctagactgattgttaaatttattcttgattagagtgcttctcctttcagcaactgtcagtatctgaaaactcatattttctatgcacatgattttgaagtttttaaaaaaatatttgactagatgcctcacaaatgtgatgtttgttgaatccacaaaatgctttggacataacataagactatagtttcagtgatgttcagtggcgaatccagggtgtaaattgaggaggtgctagtgtaaaaaatataatactccctccgtccctaaatatttgacgccgttgacttttttaaacatgtttgaccgttcatcttattaaaaacttttgtgaaacatataaaactatatgtatacataaaagtatatttaacaatgaatcaaatgataggaaaagaattaataattacttaaaatttttaataagacgaacggtcaaatatatttaaaaaagtcaacggcatcaaatatttagggatggagggagtatgattaaaacaaataaaggtatatcaactaaagtattttccaatgaaaaccaaatgtgcatatgataaaaaaaacatgtttgcatagcaaatcttactgaccatagcaaatcttactgaccatagcaaatccctaaagtattttactgagtactgaccatagcaaatcttgtttgcatggatgaatcacattcacaatccaatggccttgtcctcttgattgactatgtctaagctcttcccctttttagtgtttttctatttggattccatgaagggctattctactgcacatgtcacacttgatgccaggtatgttcaaatgtagaagagattaattctagcaatttcgttctacagttgattgcagattgtaaagttcagtgaaccaccctttgacatcagaaacctctcactagtgtgtctatctaatccgttgatgctttctttagttagacaaactatgtgtgttctgagttagaatataatatcctggatcttctgtgttctgtgcatgtctctttggatatatatgcttggagtcatgctgtaatgatcttcaattttgtccaagattaccactatccatgagaacatctgctattgctttatttggattttttggtgatcgatgagattttactatatcctatactgttcagatagcctgaaattctgaaatcgttttcttcaggagctatgttattcctgtttagtttttatattatgagaaatatgtggatcatttataccctgggttgaactgcacttaacttctcctgaagaccatgtgttgcctctatatttccatcatatcttgtgccattgtttgttctgagggctgtagttaaactcattttttttttcctgttggactgctgtgttttcccctgatttttccatggttatgtgtttataattttactcctttgacttgacatctatttgtagcacaaacggataaggaatcagagttgtacattttattttctagcagttatccatgggatggcagctgggaggcatctgaccctggctggtaagacatacaagtgcccctctgcagctgtaaaattcagtcctgaatcttttcacttaatttatatctgtagtgttagcagaacaatatgatcattagccattgagatgatgtagcaggcagtcatatgagatttttttggacctcaatgttagcatggcccatttcctgattaattggactggttgatctgcaaaggttggtcttgttagctgaagtgacaccatatgcagcttattaccttgataaaaatgggagcaatgctctcatgcgtttttgagggaaaaaaagaggaagcagtgtcaacggaaactgatccttactgcagaggtgcatcaatactgaaatgagtcttgtgctacagttaattgtagtaaatcactacagcagtagcaatggtgtttccagtgtagtgcagacaacttctgttactgtagaatttcaactggaaagtacacctctgatctgatgttcagaattgatcctaaaacatgacccaaaattgatgccgactcaagtgaacttgtcaagagtctgcgtgacaagttgcttctgtatttaaagttggtgatgataatgccaaaattctggtgcatgaaggttctctaacccgttgttggatgggttttaagaaaaacaagttgtcaaccgatttttattgtaaatcattctaggaaacatactccaaactactatgaattttcctggttatttatttaatccgtgtgccactttacgtagaaaatcatgtgtttgtgtaaaccttaaattgacatgttggcaaatgtcaatatagaattgtttttcagaatttcgaggtgttgaagacatttcagtgaggaaggttacaatataacatcgagtataaggtggttacaacgcatagttggatgatttcagaggcgtgtacaacatgcataaggtgtttttcatatttcgttttacttatatattttggacgtacatgaaattgttttagaatcagtggcgttctacaatcaatgtctttaccgcaagaaagattcaagttttccagtgtttgtagtaaaagtttctttatagggatttttatggtcaataggaggtatcgagaggttattagagctaatacttcctccatctacttttaatagtcatattttatcttggcacacagaacaaggataagtaattttacttatcatccatttaaacatactactagtcattcctcgtaaacaaacgattcattaatatttatatttctcaatgcccatgtagccaatcatatgtggaagaatagagagacatacattgaatccgagaaagtcattaagaggatatgttgttggattgaaatatgcctatcaaaaataaattttttagatttaaaaaaaatgactatggagggagtataaaggtacgtaaaatctatttggagaggcatcttgattttaccttaactagcgacgcctaaacacggagaaacgtggagaagtccagctactacatagtactacatgcatgcatttttttaatatacatgtacgtcctttttctcttcaaacaaaattttctctcaaattacttatccgatctacaatctgattacatcattgtgttcgttacaattcaatcttcacaacaagatcttacatgattatattaagatgaaaaaaatatttatatttgtaaattacttttattttatatgtaaggtgtttttatcatatatatatatatatatatatatatatatatatatatatatatatatatatatatatatatataaggtacttttagagttgattaaactacttcttagatatataaaagtaaatttaatagagtctaaaagtaatttacatatattataaaagtaacataaaacaaaacggaagtaattttgtcacgacaatagaagtaaattcgtcgtacggataaaaatatgactttatataaaaattaaatttaatcagcacggatcaacacacataagtttaacaatttttaaaagtaacttcaatgttaattggaagtaacttttgcatggttcaaaagtaactctctataaatctgtttaatcatcgattgtttttttccctttcatttttgttttcatgtagaatgagaaaagaagatactgttgtattttttaagttgaaaggagatactagatggagtacaaagtagctaccactagctgtgtagtcacatccaattaaaaagacattctgtcagggttacggataaggtatgccctctatccttggatatacgatgggtaccgatatagtatacccgtgcgtgtacgaatagtttccgtatacattaaggaaatctgtcccgtgataggaacagaatctacggatggagagtcctactcggacgagactgggtctttaccatatcatgaggggtccgatatctccgagttctacttggagatcgactgactcgcggtataaaagggaccccctggcaggatctaaggcatcaaatctcaccgctaatacacccaccacagcctacgaagccggagcttacaggagccaagtcaccgggagatctagtcgggccaactcgactacggtctcgtcgatatcaccgagttcttctattccctttgtaatctatggtttccaccatataatcccataccaactggattagggctattacctgctaaggggcctgaactagtataatccttgtcttttgtctgcttgatgtcatactacgtagatcctcgtaccaacagaccccaataccctctatatccggtctacgggtatcccccgtcgacacattcattaaagttactttctttttgttacaagttacttctataatatatgtaaattacttttaggcttcatttaatttacttttacatgtataagaagtaatttagtgaaatctaaaagtaatttagatatattataaaagtaatttatatttttttatcagaatataatcatgtgagatcttgttataaatattaattgttacaaacataacggtgcaatcgaatcgtaaattggatgagtagtttaagagaaaattgtatttgaagtatatgtggataatgtctcttataaatggagtggtagctggtttagacaaactagctaccactagttgtgtagtcacgtccataaagataatatattttttttagtataatttttttacctcctggtacctttgataccaacgatcctatgcatacgctgtagttttgtttggacgcatagttagctgttctagactatttgttacatgatactatatagttttcggggatacgaaggaaaacgtgtggcctatggcctcacattcatcttagtttattatgctcttttacggtgtttgcgagatacgtaaaggtattgagaggtggtgcgatgtggatcgttgatcaagagaaaggcaagggcaagatgtgaaataaaattattattaccaatggcagtagggtaagtaactagtaaaacaccgataattttgtttgatgtgaatatcttttttgattgaaccggtacggtattaaaaaagaataggtacttatcttccttatgcttggttaca

SEQ ID NO: 34977 - DNA, 41162 bp, Oryza sativa
atcactcgcccctgcccctactactttacctccccttcttctcttactactacaccatacaaatttaaataaaaattcaaatttgaaattggtatgtaaactttttacttataaactttggatctataaactaatatttgaattcaaattcaaattcaaattcaaatttgaaacgggtatgtaaacttttgacctataaactttgggtctataaactaatatttgaatttaaattcaaatttgaatcgggtatgtaaacttttgacttataaactttgggtctataaactttaggtgtacaaactttagatgtacagaaatactatatatagaaaatatttgaattcaaattcaaatttgaaggatataattcaaattcaaatttgaacggatataattcaaattcaaatttgaatcgggtatgtaaacttttgacttataaactttgggtctataaactttaggtgtataaactttagatgcataaaaatactatatatagaaaatatttgaattcaaattcaaatttgaatcccgatataattcaaattcaaatttgaatcgggtatgtaaactttttgacttataaactttaggtctataaactttagatgtatatatagaaatactatatataaaaaaaatatttaaattcaaattcaaatttgaatcggatatataaacttttgacttataaacttttggtctctaaattttagatgtgtaaacttgaggtgtataaactttagatgtgtaaacttgagatgtataaactttagatgcataaatttactaaaataggaaagtaatacggtgccaaaaaaggaaaccaggtggagagagggagggagggggaagggggatcgatggcaacccttgtcgccgggcgatcgatcacccattagcacttccgaacaatacatgctatccaagcatgcatgtgatttccattttacccgatacattacaaaataactgtaaggaaataagctatttaattgcttaagacattttagttaaatttcatcggggagatgacgcaaacacgtggaaacaatataaatatatcgtattgaggatgaattacacatgaacctactaaccactgatctttttaccaaggttagatgttctttgtgataaaatgtaaatatcaaaataacctggcaaacattcggtcatattttaaccaatcgtgctcctagaacaaaatgaaaatctagaaaatatcacgtaaatataaatctaaaacaaacacgtaaataatgtaacagaggattactgcatgaccatatttgcaggaaaaaatgtaaatctaaaaaacatatcatgtaaattaccgggcacacagttagtgaggtattgtatgcacctatgtacctagaactaatatcgaaaacaattatgccattctctatctcctacgaaaattatcattttacttttaccacctactccctccgtcaaaaaaaaaactcaacttctagagtttgaattttgtcccataaaaaaaccaacttctaccatcctataccatcctaccatcctacctactctttacagataaaactccctttaataccttttacctacctattaatactcttactacttttttcaatgattaagggcattttagtcatttctatcctccactaattctatcttgggatgctatgattggatttttcgtgggacggaggtagtaagtaactatatcaaccatttaagtggtacctttcattgtgcagcgatagacttttaccctttttaaaatgcaaacaccgtaaaagatctccagattatttgttaggataaaacctaggaaaccagtatttgcaaaaagtaccagtcacccaagcctgaccagtaattagcgatctactccctccgtttcatatcataaaactgattgagagaaattgattaggtagaaacagaaaaactccctcgtattttacgcgcatattttctgaactactaaatgatgtttattttataaaaaaaatctatagaaaaattgctttaaaatatcatattaatctattttttaaaatttaaaataattaatactcaattaattattcgctaatgctcaccttgttttgcgtatcttctcaattctctcttttcccctcatataaaaaagactttagttgcttgattttttttctagttttaagtttgatcaaataataaaagaatatagcaacatttaaaaaaaacatattcaatgttacatttaaccgaactatttttttttaataaactgtcaaacctaaataaatttggctagaaaagattcaaaataacttataatatgaaacagagggagtagaatttactggacataaatccaaatcgaatattagaatttgaataacggttttcccagaaaaaaaaagaatttgaataatggttacggatcagggactagttgaaaaaaaaatgtttgacattcttgtaataatttatacattgaaataaacatcatacacgaatccatgataaatgaaaacgacacaacttgtgggaggtggagatatcctatcaatgggcattatacatgtgagggcatgtaaacggtactaagtgtaaatcaaaaaataaaatttgaatttaaaccattccaacagtttaccgataaatgctagtgttcctaaccttgatctggatcattgaaaaaaaaagtttccaaaaaacaaataataacattgtgaggaatagcatttaacttcagctagtgggtatttagctggtacagggaacggaatcagactgggaaaaacatcccttacttcgagcatcgcccttccataaattaaacaaaaattagcattcctgataaattattctcaatttatatgaaaaaaaaagagttccttggacaaaatagcaaggataaaataatgttatacttttacaccataaaaaactaaccgattttgagaaaagaaaaatcatgaggggaaaattatagttgtaaaggaaaaacgtgcagaatcttgtactcttctgtgtatactgtgagtggaaacaactcttcaactataccattcaatatccatgctgcattttgctgcctcaaaaaaaaacttgcattttgctctggagacgccatccactctaactcgaatcatcttttattttggcttcaagattctttacaacattagtaagagatcttacatcccgagatttagccagtttaccatcattgtcatgctgcagaacaaaaccagattatttcagtaaatcatattgttgcagtccatgtatgtcttctttttcacaatagtttgacagcaatgtttccaaatcaagaaaataaggcagccattttaattgaaaaacatatgttacacattgtaaattaacaagatcaggagcctaaccttttccagcagtagagcatggtccttgagcccctcatctgtaaaacctttcttatgaatagccttgaggagtttatggaggtgtgcctgaagaaactcagaacagtgctgctcaagattacgctcaggaaaggaggaatcacagccaaaagggcatttcatgggcctcatggggcacacagtcacgcagtgcctatccatatcatgcctcagaagccgcttctcacagttctgctcacatgtaaggattttaaacaggcaagctgaatcatggtcttgcatgcagcgaacagaaactttcgctcggcatccatcattggggcaggtaacaggtctgaagctacactgggccttatgatcagcgagacgttcttcattttcatatttctcagggcagtggtacttggttttcaggtctacattcttgaggaggacctcagcaataacttctctcctttccagcggccagaagcgggtcatctccatttcttggacaaagtcatcaatcttatcttcgcggctgtcgctcatcaaccacccagagacatggccgataatgttcctcttcgtgctactaaaatcatccatgaagatggacacgatctcaaaagggtcctccggcatctcgttctcttgatcctgacttgcttctgattcgataagcgaatcggatatgaatgtctcgcttctctgcgtgacatagtccaccatttccttcctcatgtcaacggcgacaaccgacggcttcctgaagagatcgcctgtcgtgcagtcaatgcataccgcagccaagccggggagcaagaactgcgcgagtttgtgcattgcctctgaatcacaatagggacactgcagaagcaatccttcagccctcaccggcccaggatcagcaactgggagctccatttcgcaaagcgatcaacaacacctgcataggtcgaatacagatcaagcaacattcatatgctgaagtcaagatcaagattggaaattggggccgactcaaggtgaaagacaaatacctgtatcacccaacatttcggaattaaattgtaatttactagagatatcagaaaattgctatgtccaaatcgaattcgtcctagaatctactatatatcttcgatgaaatatataatttactaggacaatgacaataatgtttaaagaattcagagtttcaggcaccaagaaaacacattgtaactaattaatcccccattacagtatgaccaatcccccattacacgcgccgcacacgccggagcgagagcgagagagacttgaaaaaaaagaattaattgatattttaaaacaattctgtatcttaatcagaaaggattttttccccccaagaaccgcgcgcgatacagtacaggtaggaaacaacaacggagtggggatcgagcaacgcgaggaggaggaaaggatctaggctggatcgctcacctaggggggtcggcggcggagggagaggagtcggtcgatctctcgctttggtggaagggcgacgaggagagggaggaagaggaagaggagaggagaggagaggaggagagggtggccgaaggaggcaaggggtgaccgagtcaccacctgaggagaggaacgcacgcgccaaagaaaagagaaacccccttcttattgaggaatttatttatttatttattgctaacaaaaactgaatattccgtccctaaatttttgtattcaatctaattttcatctcctttcctaatctttatcttttctttacctatcttctattatatactaaaagtccattaacctttctaaaatcgctctcaagctgacatgtggcatcctaaaagcgctctcaagctggcacgtggtgggaggagaggagatgaggacccacaaaaaaacgaaatcctctcccacaacgtccgcatgtacgcatgcatgtggatgctttccttccatgcttagcggcaggattaccaagtaatcagggttttacattaataaggttttttttctgttatttggatcggtatgtaggagtccatgttgggctttagtccgttcagctggctaggcctttgtaccacctatatatgccatgttccttgtattaggagattggttttttgttttcctctgtgttatgccgccgccaccgcctaggtcaggaaggagatggcgattccatacgttttggcaccatcgttgctgcgttggttaatttggtcctaggcatgttctgatttctgacaaagtcttcttgctctgatcggctatcattcttgctgcatgggtggagtttatgtacaggttccgttagtttattcattataaactgaatcatctgtctgtttaaatttgatgctactggagctattcagttcagtctatctggagtaaacgatcatatgtgtgcgatcctatatactttgctggatgagatctctatcttaatattgatgctgctcttgattcaactggagattagggtgtgtatatatatatatatatatatatatatatatgtatattctcgctgcattagaaaggacacatttatcccataccaagttgtacactcaacatagttatgtttacatcccaattttaagagatcaaaagcatttcaagaacaattgatagaacatagacctccaatattcccaaaaaaacagaaaggatgactggaattcagacaaaatttgggctaaatttaaacaaattttgttgaatccaaagcccaatataaattgaagaaatcatttgaatttttttggcttaaagttcaataactattcttaagaacacgaatttctcaaagtttagaactccaaaacaaagatttgatatgtattaaaaataacatatagtttagatgacagttcataggaaccaacttcatttttgcgacataatactttccaataattaaagatttcatgtttgtaagtaattttagtttagaatttatgtgttgcgaggataattagcattcaaaatattcacaaacaaaatattgacaaaaaaaacatgttgccaatagaatctggaacaatcacgcatatacaaacattatattcacatgtgtagaataatatttcaagcacattaaattagatgcccgcgcatatgcgcgggcttcctttctagttataaaaattagagatgattatgtactcacaccctcttcttccatcctcttcgtccatcattcaagtcaccattggatcgggcgatacaaaataaactgagtgatttattggtacatcatctgactcccctgcttgccctcgtcgtagctttcgcttttgcaccgttaggcgttgcacacatccaattcaagagtgtgttcgtcttcgcgtccgcctgtggttctcacatgttcacgtccgtggtccgcctacgaatcgttcgtatgtgtcgccttggaaaaggaggggaacttcaatttctcagcaaactttatagatggaagaggtgcccggctgccaacacaagtgggctggttgaggcggcagcatcctcactgatggttgttcccataggcggagacagagaggcaaacggtggcgtgtaagcgtagtctgcggtggctgtgcgcgagagatcgggagctacagggtgaaccaaataagaccaaatccaagcagtagaaaggaggaagaggctagatccaacaaaaccaacctcatctagctgcaccaagctcattgaccaagacctcattgaatggatggtggtggattttgccggacaacaactcatgatgtcgttaacccggagcaccgcgcccatcttccccctcttttgtttctggccttcaactagggaaaacgatgaacagttgtcgatggggaatacccacagaccgtattctgaaggtattagggcatgttgattcgaggatccacacaataccacatcaaacacatattcccaacttctctccctcattttccgcgcgcacacttttcaaactgctaaacggtgtgttgtttgcaaaaaaaaaaaaattctatacgaaagtttcttaaaaaaatcatattaatccttttttaaaaaaaagcaaatacttaattaatcacctgctaatcgctgctccgttttccgtgcctcccgaacgcaaccataggttatactaattcaagcccctcgtaaggtaatagccctaacccagtttatagaggattacgaagaaaaccacatagtacaattgtcacgtacagaaattcatgaaccataattctaatgtgcattaaaacccttgtctagaaccggccaaggtacacacaacaaagttgatatacaaattcacatcttacaaacatattgaagtcttacatatgcaatgaaactaaaagcgagctaaactttgtgatcacaaatcacaataactctgattttaggaaatcacttgaaaatgataaacataacactctcaaaaccatatcaccactgacttagttaagcttttcaataacacgcaaaatgagataaatcattagcacatgaataattaagtattaattattaaaaagttctaaaataattaagtgcacactactttcatcaccatccttttagttgaacaaatgaccatgtgtttgtggtctccctatagttcaacaaatccttttactcattcatcattcatcatatcacatatccaatggtctaaaatcatccaatccaacgcctcagattaccccacctctccccctcctctcctttccgcacctgaaatggcgaaatcacgccgcatccaccgtcctgtgtctcgctcttccctcctctttctcccgcatctcccacgcatttcctcctcgcgctctctcgcccccgcaccgtcgtgcactcgtgcgccggatttttcacagaatcgacgcgctcctcctccgcagtccgcaccaccatcgtgccgcgcgcctctccctaccgcgaaaaaacgccgcgctggtgcccaccatcgtcaccgccgcccatcgctctccaccgcgcccccattgcgcctgacgcgaaggaggagcccgaggaggaagaagaagaacaatgaggctgacgccgacgcctgcaggcaaagaagacgaccgagaccttcttgtataagggaacaccgaagaagtcgtccacgcgcgggcgaccgggggcgaaccctagtggtctccctatagttgaacaaatggttttattcgttcatcattcatcatatcacacatccaacgatggaaaacgatcagatgagcggcatccgacggctccccactgcctcatcctgatcgcgtctctcccccacgccactcccggatcagcctccacagatcgcgcctttacgccccctcctctcccatccgaggaaccgccgcgagcccgcgatcccgtttccccgccctctgtcggcagcacccccctcccccccggggcgccgcccgctgcgcctccgcccaccaacgacgatttaatccgcgccaccctcccgccaatcgcaccgatccgccaccgatcggcgccgccggaacacccacaacttcgctgccaccgatctccgcctggccgcccgcctttgcgtcaccagttcaccattggccggagtcgccgggctcgtcgtcgccaagccggtcatgccgctgcctcctccaccaacgtgctgtcacctcctacgcatcaagcgccggcgccgccaaccaaatcccatccgccaccgataggaggtacagaaaccctcctcctcacccctccctataaccattcagtgcgatgttaccaacagatgtgatgcaatggttggcatgatctgcatttttatcactgaaattgatgtttgatcaattcagtttcactctatatgtttctctgattatttcctgaataagctgaagtagtacctgtgagaaaataaattattgtccgtgtgtgtgataaaaaaaagttattatctgcgcgtgtgagaaagagatagcaggcctgatcttttgtcaagctaggaaaaatgctaactgtctcaccattagtgcagagtgtttgatctgcaactaattcttgaagtacggtgattctcagaccttcgagctaaactactgaagaaccgaactctaattgtgagtacctgtttaatttttgtctgaagatacaaatttgttcgaaagtgactgaaagagacataaaattcaaaataaaaatgaatctaatctttttgatatattttcctctgttgcactatagcatccatcagtgccattgagttcagtttcatgttaaaattaattagtatatagtgttgttggttcagctgaattgccaaaatataggatgccatcagtattttattttttaagctctcccgctgatttggtttcatttcatttaggtcgatactgtgctaaatttattccaaatcaaaattagatcttccccatcaccaccactctccatcagtctcatcctgctctctgctctctccaaggtgagtattggaaaccttgtcccgtggttatttcagaaatggagaatttcgttcagctgatgaattatcccttgatcatggccattataaatgaaataaatgcttaattgcactatctacatgatataacttctataattggattttgcttttctgaatttccattatgacacaaaaggtatgccagtataaaggctgtctgtttcagtggaagaaacagagaatgattaggatgggtgcaatggttatgtttgctttttgctaaacgtctgaggtttgcaacaatagcaattcttggctcatacttttttccctcacaatattccaaactgttaatattgcatgacggattcatttgttttgagttctaattagtgaactgtacttgaatagtttatactactgagaaattaaggtacgggcatgaatgataagtagttgtgagttgtgaattgaagaggtgaagtggagaccatcagatttattttggtcctttatatttttaatattgtcatgcatctgtgatcagtttccggggtttagattcattatgttctatatcatggttaattattctatgggtcttccgaaacatggcacattgccacacatcctatgttgtgttctatatgttatcaatgagcactgtggatatactattttggaaactgctttgtgattttcacttctatatatgtgtgatatctatactgattcgtttagttgtctcctacatacaagggacaaggtggacggggagctgaagctgtgtcaccttctctccagttgcatcggcggataaaattgtgagggcaagaaaaatatttgtactcttttcaaattagtaaattaatgcttgcaggaataattttgaaaatttaggagtactacttgtaaataaatggaatagcaaaaaaatggtagataacccttttaaatgatagaagagtattaccacgcaggtcgtcactacgacacaattagcaatataagatcattttcggcctcttctaatttgcagaagagatgacatttagcccattcacacctttgcatttgtgaccaaataattaagaggcctgaagcataggaagatttcaatagttgcattgcgtaaaactctcctgaaactaaaagtgatgtgttgctgatctcgctttatatgccgtgcagatcctactgaatccattgatttccaagagttctgcaataagaggtaaaaagaaaagttattatcagaggcatgagtataataaataaagctcctcaacaaaactggaatgaacaatctgtgctatttatctcgtaaatttctgaacttgctatgagtagtagctgtggatgccattcatttttacatctctctttgaatatgctgtgtattttcgtggaaacataatattatagacttttgtactcctcaacttcacttcgttagtgattcatggtaaaatcttggtatcattagagctgcttatggttacagcatcaagttatgattttctccgttgtcaaattgattgcacagtgattttgactacaaccatagctgatgcaattaatgggtataacaacgtagtataatctctgaggaaaagtaatgcagtttgttgtcagtatatgcactactgaatttgggattatgcagcacgtcaacagcaggtattcttattggtcgatttaatttgttatagcaaggcaaggagtcgcggacctgaccatgaccattttttaagtacatttgcacaaaattgagaagcacatgtacccattgatgtataaataagaggttcgtagctcaatccatatgaatatactttcttgaagaagtttcataagtataacgatttttcttccaccaaggagatttataatgtaaatctaatttgcatcttctgctagagagcttcctccagtagatgagatttacagaatgtccagcacagcgagcctgtcatgggtcgacgagctgcttcagtgcttctatccttcagcatgcagcaagttagatgtcgatccttggtgagcattgaccatgcttcttttttcttgttttggttagattaattcaaattgttggtactcatatatatagcattttgttctggtggacgtgtgcaggcaagctatttgttgtagtccttgcaagataaatttattactgtgtgttttctattcctgttattgaacatggtggaatcaatggtaatttcagactcagtactatgctggtgctcagcaatcaaaatcattgccacgattaagtgcgtatgttattttctgctggagattaatatgttttaaactaggaatgtttaatatgtctaccatgattaatatgtctgccttccaaataatttactctacgagctccaaacaaataactttgcatgataaaattgctatagtcatcatttcttatattttgtttactcaagtatggaattgcttccatatcatacttatgaaatgtttatctcatgaataacttgaaagaatcttatggcatgacagtttctaagctatttattgtattttgttatttgtccagctgagtcgaaaagcatgatcaaggaacatctacagaatcaattgtattatgcagtttaaacataatattttgtcctgtgatatagaggaacatttttctcctctaagggctctatgtatttggtcttctattttgactaattggagatccttttgcatttcctttagggcacaataaaatcacatgacataagcaccagagagatgatgacctttttggcacgggggtaccaaccaaaaagtgttgggttgattgtcgaagctgtccagtgtctctataccataggtgagaaagaaatatggatttgcccttttgcatggtttcgaaagatggaaaatttgggatgttatttttagccatgtggctatgtaattaataatgtaataactcgtgatatcattcttttctttaatattaatcatatctcattttatttttgattgttgaaacatatatattctttttattgtttactttacattattaaatgatttcgttgtgttagcacgggcaaatgattcagtttcatgcatagacggtagacctattaatttctaattttctattttgcttaatacaagttatttttaaatcagctccaaattcatagtatagtgtacaataatatgtaatattttaacttgtacttcataccatgatgtactcacgtaaataaagacactcttcctgtcgatatgaatgcagtccggtcatcaagaagttccaaatgtaagggcagtacgcagtcgtcattgcgtttcaatttatttagatctgtcaaccgcttaaccataataatttctttggataattattattttgtcatatgtaaaattatgaaaataaatgatgtgagttggcgtggaactggatgtcaatttaatttagttaattctggtcaagatttattatgcccatgcaatatcatatttttgaactttgtgtggaatatatttgatgtacgacataaattgaactaaagcttaatgacatagatcatataatttttttttgctaaaatgaaatttcaagttactaaagacaatagaattgcaccgtagcgtttagcacgggcatattactagtaaaaaaaagacaccgtttatcggttcgacaaatatccgtgaagaaaacgagcgatgaaaaagaacaccgaagccaccgatcgaaatagccattttcattagccgctccgcgtacacatacataatagagaaaagtacagtacagggcaaccaggagataatcgatacagttcgttcgtactggcagccaatttgaccacaacctgctcaagaatgcttcctctcccatttcccttctcgacgctccctgcgttctactacaacctgccttgaggttgaagttgaagttgaggacaactacttgctgccccgagaaagagtatgcctcgtgcaagcttccaaagccgccgctgattctggatctccgacgctgctggcgtcaccacttccctcagcattctcctcataataatttcctcctgtgctagtacgctcgtcactcgtagtacgctctcgaggttgctgcagtattgtgggaaggttgcctgaaaatgatcttgtcgcagacccaccggcctccacccctcctcctccacctcggctccttccttcctgctgtcccctaccgttatccctttcacggtatctctccctagaccggctgcaaaaacacccatcacatcacacacatggcaagggtaacaaacatgtcaagtgaagtttcatcagaagcagtatggtgagacaatgagggaggcaaccgcctaccagcataacacacctgttagtattggctgaaaactcccgccttgatgaccgccccaactcaacttgatccaattctcgttgaagctctctctacaaaagcaatcagtatatgacatggcaagaaatatcaaattcatgcaaaatgttgagtatcgtcaaaacctacgatacttcaccctaaattactagccacaaaggatgtggcgaaacatcaaataaacatgcgctatcaatatgaagtgaacccacccaccacaacataggaacacatatacatataggggttagttcagattgataccatttcaaaccataccaattttttttaaagctgcaaaatatgtgcatccatttagttttttttaccaagctctagtaaatacataagaaatcctacaaaaacttggcaatattgccaaattgccaaagtattggcatcgccaaaatttggtaaagtttatttttgctacaatctgaacaggcccatagtcatatactaagcacagagtgcaaagagaaatacaaagattcttgttcatctaaaaatatgtgcataagagtaaactattctggcacctgagtttgtttttctctttccatatcgaggttaaattgcagttccctagacttaacgcgctcaagatccagttgtcgctgtctttcgatttcacgttccatctcatgagccctttccctatacagataacacaacaaagaaatagggataggaacatttatattgtttctgacatgctaaatgacaaaggcaacaactctaaacctgtcaagttcttgcaaaagctccatttcccttgaactagtctcctccaagtatttttcacgagtatgtcggataagcagcttcttttgtctgcgtgctataatttcctccctgagtttggacctttccctattgaagaagaacacaaactataagtctataaataagactagcactaaatttgaaattcttctagaattcaaattggtgaaaaaaaggacatttcacaaagataataaagaattttacaaggaactagagctaaggcagtattatatagaagcttatcgagcaattccaaaaaaaaaatccagaaagcaaacatgtattagtagaactttagttcaccttagcagacaatccgtgcctcctggagaaaatcacaggtgttatttttttttagctttttagtggtctacaacatgtatagttattttttttaaaaaaaaatccaaatgaagtataatataggaaagtaatgtactttctattttcatgaaagtatactctatgggacaaattgagcctatttactcattagtaggctggtttcttctcttatcagtatttttagacgttgaacaattgaaccaatatccaaccacttgagactcatcatacccaaaaggaacgatcaaaagccaggcatgagcgcatgacatgctgactgggcaggaccatatattattgcccataggccatagccccctaaagggcttggcagggctggtctattaccatgacagaaaaatagttcagttgaaacaaatcaggagttcaggacttacaaggaccgtatatcttcctgaatttgctggagctgcttattaacctcattaccatccttatagtctggaaatagaataatatcataacacatcaaaagtacatcgttaatgaaaggatgccttaaaagtcgttagtcttacatgatgacatgtccggaatcatggtgtcctggggatgtacaataaagctgtgacgtgctttctcatttttaacaatctccaattcgatctctgcttcttcaagttccttaatgttatgattaaccaagtgtcagtataaggtgttcaaaacaaaggcccaaaaggaaagcccttgttgcatttctaacctgatattcctgatcagatcttgttgagaagaactcaaagtatgattcaacagaactcaaagaggacagcacctataaaagagagaatcatgaatcgagatagaccagcactgacaagatcaggaaatataatttacagcatcttctggtatagagataataaccttttgaacaaagaaactataatacaagcacactgcagtggaccagttgtgcctattgattgcatgacgaataaaaaatccacaacaataatagttgtcatcaagaattattcatttgggcaaagtaattgcactgatcctgtcattatcaaattctaaaaatagatgctcatttggctcaattaggagaactagttagctaatttgcaagtattgcaatttatgttgtacagtttaactgtgcaagcacagtcagcagtcagcactgacaacctagtttgagtttttgaactataagcagtgatgtttgaaggcagaggatcaagccagaaagaagaaagatagccaacaatagagtgccctaaagaatatgacctgaagaatcgattcacggatgcccttaaaatcagtttcgactggtttcgcagtagattccgtgagaagttcttttacgacctaagggaacaggtatgcaatcagtaatcagtattagagacattgttaggattctctcgcaatctctcgatcagctcactcaagaacaagaattatcgatacgatcaacgagatcgcatcgcctccgccgccaacgccgccattcgattgatctccaaagatacctttctgttcttacaagttttgtttatattcaacacactctctctcactggttgctgggtcccagccaggctgtcgacagagccatagccagctattacttacaagcccattcaggcccactcagacgaacattagacttcttaattctagtagctcgcttcagcggcctagtaattgtgttctcctgtgcttcgtcagacaacggcaactccctggaagcagtattgctgctgacaaaccccaccccttgaagactgacttgcccccaaggcagtgcagaagggaaacgctgcttgagctcttcttcatcttcccaggtggcttccactgcaggcaaattagaccagcaaacaagaatttgacggacaactttgttacctttcttctgtatccttgtatccaagatctgaacaggatactgaatatgatctgtaatgttgggcaattgagactgaatggagtgcttaaagttctgagttcctttcaattgcgagacatgaaaaaccgggtgaaccatgctatctgctggtaactgcaatttataagccaccgatcccactttggacaagatttgataaggaccaaaataacggaaggagagcttgtgattggctctttttgccaccgaagattgcacataaggctgcagtttaagaaaaacccaatcccccacctgaaaagagcgaaaactgcgctttttgtcagcttgtgttttcataacttgctgtgctctgttcaaatgctgtcgaagcagttgagtcatcaaatgcctttcagacagccaagaatccaagtcagaaatgacgcaggcatcagctcgaataccaaagtgagaaggaggataaccatacaagacttcaaaaggagtcttattcaatgccgaatggtaagaagagttgtaccaaaattcagcaaggtgtaaccaaagagaccacttagctggggtggcatgaacaaaacaacgcagaaatatctccaagcattggttaactcgctcagtttgtccatcggattgcgggtgataagctgaagataaatgcaatttagtgccagacctcaggaataactgctcccataatgcactagtaaaaatcttatcacggtcagaaatgatgatctgtggtaatccatgaagcttataaacattcagcatgaatactttagcaacatccaaggctgagaaaggatgagataagggcataaagtgtgcatacttagagaacttatcaacaacaaccagaatgcaatcttggtggtatgatttaggcagaccttcaatgaaatccattgatattatctgccaggcaccgtcaggcacaggaagaggttgtaataacccaggatatttggacctgtcaggcttggcttgaaggcaaacagcacaagaagctaattgcttttgaacagtgagcttcatatgtggccaagagaaaagagacttgatccttttgtaagttactggaaatccagaatgacctcctaaagggctatcatgaagggcagaaatgatctgttgttggatgttggaattgttaccgacccacaccttgcctttatgtttaataagtcctttagacagagagtagtgaggataagaagaggggttaacagccaacccagtaagtaaagaaagagccaatgggtcctgatcataaccatgaaggatatcttgcaaccagactggagaacaagttgagattcctaaaaattcagaggtttcctcaggaacatgtcgagacaatgcatcagcagcagcattatgtttacccttcctgtaaacaatctgaaattgtaatcccgaaagcttggtaaatgctttctgctgccaaggggtgtggagccgctgttcagtgaggtgcatcaagctatgatggtctgtaatgatcaagaattcttgaaactgcaaatatggccgccaatgatcaactgccatcatgattgctaaacattctttctcataagtggaaagaccttgagttctaggaccaagagccttactaacaaaagcaacagggtgctgattttgagataaaacagcccctatgccaatgtcactagcatctgtttcaatggtgaaaccttgctggaagttagggagagccaatactggagttgaagtaagggcatgttttaaagcttgaaaagcttggttcacttcagctgaccaaacaaaaggggcatccttcttgagcaactgtgtcaagggtttgctgagagtaccaaaatctttaacaaatttcctataatatccggccaaccccaaaaaacccctgagtttcttgagtgtagtaggtactgcccaatcaacaatgctttgtatcttagaaggatcagttgagactccttgaccactgataatatgccccaaataagaaatctgagtttgagcaaagtcacacttactcagtttaaccttccactgatgagtgtctaacaactgcagaacttgtttgaggtggtctagatgagaattcatatcagggctatatatcaaaatatcatcaaaaaagaccagggcacatttccttaacaagggtctcaaggtatcattcatagcaccttgaaacgtagcaggggctccagtgagaccgaatgacatgactttatactcatagtgaccactgtgtgtttgaaaggcagttttaaattcttcaccctcagccattctaatttggtgatatccagctcgtaaatccaatttagaaaaaatcttagctccagctaattcatccagtaactcatcaattattggcattgggtaggttcccttcttagtaatggcattcaactgtctgtaatcgatacatactctccaagagccatccttctttttaaccaatagggcaggagaagagaagggactggaactatgttgtataatgccattctgcaacatttctttaacttgtctttcgatttcatccttttgagctggggtatgacgatatggacgaatgaacactgccttggatccaggaagtaaggaatcttgtgatcacacaacctcttaggtggtaattcagtaggttcctgaaagacagactgaaactcatccagtagtggctgcacatgtgcaggaattgtagtaatatgggatgtatggttgctgtctaagtggatcaagaacaaggcactgcctgatttcagtaacccagtcaattgatcaggggtgataggaagacagctagaaatatgggactgaataccttgcaatctgacagtagatccctgaaactgaaattctaaccacttttgaacccagtccactttcatgggactaaattgttctaaccagtccatacccaagatgacatcataggtgcccaaagacagcaatctgaaattgctcttgaaatgaatgccttgagttaaccaatcacagttattcacatacagagaacaattgagatgcccaccatcagccaccttaactcttgcaggagaagccatagatttaactccagttagcttcaatccaagctgatgatcaacaaaagagtgggtactgtcagaatccaccaacataagcacctcaataccctgtaaccagcccctcaatctaatagaatgattagattcagtaccattgatagcctgaattgaaatagccatcaaactatcatcagactgaactataaactcttctgaactgatgtcagggccctgcaaaacagccaatagttcttgaactacatgtaattgaatggaagaagcacacttatgttctcgaccccatttctccccgcaagtgaaacataatcccttcgacctccgataagccttcagtgtagccaatctatccatttcacggttttgggatctaccattgtcagaaattcgtctttcttcagcaaaggaaggagagccccctttaacagttggaggggtaggtaatggcaatgcaactctcacagagtgcttggcagaaccagagccttcacctttcttgatgtcaatgcccttatcaccttcaagcgcctcctcctgcaaaaatgcaagagtgcaagcagcatccaggtcgccaggacgttgaagaagaattgcagaccggatttcatgttttaagccttccacaaacttggtgacaaagtaaacaggtttgaaagtggggtcataagccattaactggtgcatgatggaatcgaatttttccacataatcagctactgtgccagtttgacaaattttaaaccattgtctgataagagcctgttgtctatctttgttaaacctagtgcacaccctatcacatagctcctcccaggtcaccccctctaattgtgatctaacagcttgcaaccaaaaagctgcattcccagtgaaattaagagtggcaaccttaacccagttaattggatggattccatagagatcaaaataagattcacagttaactttccacatgattgggttatctccatcaaattttgggcaagtcataggagctaccccaccagtcaacccaacagatgttccagattggaaagaattcatggcagaagcatcaactcgacaatggaatggagaaaaattttgtgacgcaagcgtaccattgcccgggggtggctttggggtattgaataccccatcagcctcctcccgtgtagaatttgcagcgccttggccatttaagccggtagagtcaattgctcgaacacctgccgctccggatggcgacgaagaggaaggagtcgccgaatttgttggaggtggagcagagagtttcgctacttgggtttgtagcatatccacagtggactgaaggacatccaccttcttctccaccgcagggatccacgattctaccgcctccttgaagaccctcatctccaaactctgcttcttctcaccctcctctcgcttgcgctctgtctcctccattttcttcaacagaaggtcaagcttagcctcattctccatgattttggccgtctgcttcgtcacaaatcgtggtttctccagggtttcagatcaagtgatcaactcttcccgaattccaccaactcaagcaaggcaaggctgggtagccttttcgcggattcactcaagagcgatccaatccttgcccaagaattttacagcggaatcaaggatttccgaggatcacgaagctctgataccaagttgttaggattctctcgcaatctctcgatcagctcactcaagaacaagaattatcgatacgatcaacgagatcgcatcgcctccgccgccaacgccgccgttcgattgatctccaaagatacctttctgttcttacaagttttgtttatattcaacacactctctctcactggttgctgggtcccagccaggctgtcgacagagccatagccagctattacttacaagcccattcaggcccactcagacgaacattagacttcttaattctagtagctcgcttcagcggcctagtaattgtgttctcctgtgcttagtcagacaacggcaactccctggaagcagtattgctgctgacagacatgtacaaaattctactgaagctacttccctttgtcgtgctatggtatcaactcaaccacagaactgatttttaagatattaaaataacttttaggtatgagagagagagagagagagctctacacttttagcatcagattcacttcttagttgacacagtgctcgccagagatctttctccatatcaccaaagcatcctagtaagacataaaaaagttagatgcatggttaattggtagttattgatcttgaaaggatgtacaacataatttacatgtgtttatgcaaaaaagaaagtgcagattgttaaggagcataaatttaccaggtattgatgtttgcatattttccagttttctccaaacacattcaggtattaaagcaatatcttcaggagcagaatagagacacgcccttgaaagcaacagcaaagacattcgtgtcaaatacccctgttctattgcataagaaaattgttccgcaccattaaggatgctgttactggatccaagaaaggactgtagatgatttctatcaacaaatggaatgtattcagtaagcaaagccaatgcatgcttccttaataacatagaagaatcatagaaagccaatgctgctactcggtcccaggtatgagtaaccaaaagggatgttactgttgaaccagatgagagtgaattttgcttataagtagtatattcataatcaactttagttgtactcataataatcctcccaagttgctgcaatgcaacagagcgctgttctggttcagcatgactcaacaatgtgcagaaaagatcaatcaatgaattctcactgttcttaaggccttcaattccataagaaaccaatattgataaccatttctctgtctgaagcctccaagatatcctgggtgcatgagagcagaggtgtttcattgcacaagacatgacattaagaacattatcccaagcaagaatatttggaagcttaatcatataatcgagcataactgatgccacctgccagcactgcttcttctgatttactaaaatggcttctgcgagaccttggagagcactctctcagtgtttttaggaaagatcagtggatatttcagtaccaacctcttgtttgatgctactatagatcatacctccttcggcaatagactttaggcattttgcatacagcaaacattttgcaatcgataaagataacctagaggccaactgaaggtgccatttccaactgccctcaatagatggtgcaaggtttgacactaacctctccagggcaccacaaaattctttaatacaaacagtatgtggggaatcaactcccttagaattttcaccattctcatgatattctgtggacctcctctgtacctgtgctacactggcctgtgctttcttgttatccatggtgtcatctggacttgcggagttagcaaactctgtagactggtttctctcagaaaggacatgcataccaaataattcaatattctgaactagtatagtttcacaaccatcaataaatgcctgaaagccttgtagataactacacaacaatgatgatggatcagaactgccgaagtctacccatactaataatgagcctaatatctcaatcctcctcttaaaggacagatcaggaaatagcgaacccagaatgaatatgagaaagggcacctggttcttattgccaggtgtatcctctgattgtttaccaaactgtattgtttcaaataactcttcaaaacaaagtaactcaaaatcactgcattcagtaatatcacctgatacatttccattatcagtactcttccttaagaagtgtgagatcattggcttcattaggcacagcacagaatcaaggaaagctacatcagtgtaagaagctctacaaagtgacacaagaatgtgcaccatccgtggcatttcaggaacaataacttccaagtgctcagcgacaattgactcaagtaggtagaaaacaacagcctttgccttagctgcaatgtttccttttaaactattaactccgtttgcaaatgcaagatgctccctaatatttccaagataaggccacaggcacatttctgaaaaccaacaaagaacatcatgcactgcactttttgggagacattttaattgtaacccaacagcttccaaaatgctttggccaaatgcatcaaactttttgctcatactcggaaagaagaaatgcagttcaggaagtaaaatctgaaacaatctcatgcttggttggtctgacagcaaaggttccttcttaagaagcacatagttattgcaaccagattgttcaattttagcagacttggccttctgagtagtaacaccacccatcaaagaaagttcatcggtgaaaattgacagcaaagatgtaagctgtgagaagtcagaggcaagaaatagctgctcatttaaatattccttggcataacgggacactgccatccatccaaaaaatcgaggtagtggactaaaagacctggaaaaatctgatatcttatgtatccatgctgatggaggaaccagacttttaaaacggaaaccatctcttttaatgctgacaagttctctagtattatcactgccagacgaagcaagaaccagcttctggagcagtgcccaacgtcttcgtagataatgtagttttattctatccaatttattattccttgcattaacggaattgtaaagacatacaagttttccattgagatcttcggcggatttcaatatgatatcgatcacattctctggtggacaaaatagatcagttgctgagtgcaacaagaacaacaagctctggaggagaatttcgttaggagagtgtcctttcttttcaaattgtttcatgataaagtgacaaagcatagcctggttctttctgaccaaagttacagcatcagcaaggtgtctagcctctggtgaaatttctatatattgcttgccatcttcaacatcatctggaaaaggtttcccatcaggtatctttccctggtattcaaaatcatatcttgcagcttgcatgagtaaatccaggaccgctttatctcgtttattctccaaattataaattttcatgagatcaatatctttagcacgcagatgtttcgcctcagagaaacaatttccttggatcaattctgcatgaatacgttcaatttcatccaaagactccgaattagaatggaaatccaagagaaagagtggattaacatagcattcagcagctaacagaaaagcatctattccagcattatgcccctcaactgtaggttcttgttgtgtgcatagattcagtgctaagcgctgaaattctagagctcttaattcacagtcctgatagttcaccagctgcagataatcagcatgtgcatcatagtaatcagtagcaaaaatattatctaactgaaaaaggccagctggtaattttccattactttttgtgtcctctgggaagttctggtccaaatctgtacttattttctcatgctttttttcttccaaagtctttgtcaactcagattgctctaattcttctggagcaaataaagaattgcactgttcaagaatatctgccctgggagttgtttcagatgtatcacgcccatcagcatcttcagcactgcaggagtgcggtggacagtttggaactatcagagatatttgatcaatctcaggcattgaacttttgcagagatctatgtcaggagggagtggcatatgcggatccaaggtagagagaataacactgcaaatcaaatctagatttagcatgtttttaccagcatacaaagtaggtctgagctagagaaatgctttaatgtttaagccgtcaatcatatgtgcatgctaaagtcacacggtttaccaggttctatgatacatcccaagtcctctttggttcaaacttgggtgcatatctttcttattagctaaaggcaaaactagttcctccaaggtattctttttttctgcaatgatgaagttcaattgcatgcttccaatggagaattttgtgaccagaggaagtcacaattaaataatgacagtactattctggttctcatcaaccatgacaagttcagatcaatcttaatggcaaatttatgataagcatgtaaacatatagagttcaccaaccttgtggcaacagcaccacgacgccattcaagttctaaagaagggagaacagcaggcctcttcactgctgtacggataatatttaacgaaatattgcaagcgcttgcttgcttctccaaatgcacaacagacacatcaccaaatgccattgcatctgtcataacacttacagaaggatcaataaaaggatctagcatctccagaatgaaaagtaacttatgtttgacgtcctgagagtaggtaaatttacataatacaagttaaggagtctgtaaaacaaaccaatcaccaaggaaaagctcactttcaggaggaaaaatgaatgtactttatattctgtgagaacatcatccatatggccagatatggccaatgcaatatacttcagtgctgcacgagaacgagtaagagattgaccaactccctgaaaaacattaaaagaaacaaaaccatttgatcccacataaatttgggtaaatcatgacttgaagtaacaaagcaaatcatctatattaacttaggatggcaaaaaggaaaggcgcatagtcatggtaaaatactccttttgtagtgagaaaacatgaccaatattgtcataccaccttcacacatcgtatatctaaatgccttcaagagtcaacccaaaataaaaaataaataaattgaagaattgatttctttatttattagttattggtacaaaagtgtcaatcctatagaagtatggtaagatacagaagagtaaattatgtatgctctaataacttggcagatgggtagaatctggtgcaagaatttgaaaatgagcctccaggtgaaaaagactggtcaggtagcgtgtttttatcatagagcatgccacgcatgattttttccacatcagcagataacattggttgatacctaggaggcccatgtcaacgctagcacgtgtcaacttcggatttgcaaaaatattatccggactttttcgatgttttcacatcgctcacgtttctacctgggatatgttatgctcaagatgcagggtcagcatactcgacggacatggtccattgccatgcactctgccatgatgatacagacacttctgcatgtgccatctatcatctatgctgctgtccactccaggatacacagaagatatgcacaattgtgcatacgacaagaaggtgactatccactaaaaaatcttactagaaacacacaacaggaatagaattgctgagcttagggaagagcactgcaggtagttgattgatcacttgattgatattccaatagtagagtatggtggtgcatccagacctgacttcgctgtgtacttttgtccaagaggatccagattacataccacacatatcttcagcgacatgcaaaataaaactcaagccagccaagtgttcttataatgcgtgggcaacttactcaatatagaaatatgccagattacatgcatcaaaggttaacataaattatgccatgctaaggtttttttttaacttgtacatacctggataatacccaggagatcctccagaagttcaatggcaaggtctacctgtttaaagagtatacaaggttgtgaaaaagatatggattgtagaaataagtgtggggaaaaatcataaaaagaaacctttgctgtgatcatgggtacccatggtgataatggtcccctgcataagtcaagcaaaacacaggctgcttttgcctaacaatgaaaataagagacatcactaattttcagaagaaatgggatatttttgtaggagagagttatgtaacaaacatgtgatgacaggtaggatgaaagataaccagcacaggctctgagaagaggatgaagaactgatgatgacattgacattgtagcaatctgcagaaacagttaacttgaggaatattaagtgatgtccgtgatgcatgacaaagctaataaaatagtgccaattcaggtacctgagagagagctttatgaacatttggatgattccattggctaagacaaccatcaatctgttcagtagaaccagggctaagtggaggacgaagtgctacaggaacacgagagagaaaaagcatactatcagtgacaccagtcaacaaagccatctgtgttgtacgcttatgcaactgcaggaattccccttctctaactcaacgaatgggtgaagttaggcagttaattacaatcatcccaaagccttaggcccatgccaacggagaggccaaaggataaatcccagaaaattcacaaaaacaaaggtgtcattatgttacaccagttggcaaaggcctgtcatcacttggtatatataggataagatatgaatgagcatgggggaatatgtacattatttggtaacaaatgttctatctattcacattttttttggccatttggatcaaaaagtaaaaaatataaagcacaagtgtatatatgttccacttaatacctggaagcagagcttgaacaagtggtaagacagaccacatgtctgaacctttctcagcaagcttgcaacataacagaggctacaattgaaaccaaaaaggttataaaggtgttctagaaaaaaaaaaacagaaagtaaatgcagaggaactgaaaatatatacaaagatacaacttcagagttcagacagaacctgtgatgaagctgcatatagtatatgaagaatgccttcttcaacagcagcaatatccaaaatgttcagaatagaggcatcaaagcgattctccgataagctaaattcatctccaaacaaactagagtagtctgtacaaagtacttggtcagaagcatcatctaacaatggatcgggctccagaagttcttgcaggacctttgatgcctaatttcaaaataaatacatgtcatgaaaaccctctgaggggaagagtttgtaatcaataagaaaggaaaaggacatcaaagaacctactttcaggcaaacaattccaagggctctgtctctgtgtgctttccttaagagcagtacggctgtttcagatcgaaatgccagaaaacaagcaggctgaacagaagatggactccgtgatctcctaggttgtgcctggagggaatcaaagaattcagaaactgaaaggagcaattaagataaatgcccatatgaaaaacgcataaatcctaaatactccctcggtttcatattatatgtcacttcggttttgtcaagtcaaacctcttcaagtttgaccaagtttataggtaagtgtactaacatctaaagcaccaaattagtttcattaaattcaccattaaatatatttttgtagtatatttattttgtggaaatgttgctatattttcttataagcttggtcacaaaagaggtttgatttaggacaaacccaaaatgatttataatatgaaatggaggaagtaggtgataactactccctctgtcccaagatacataaccaaaagttgttatattttgggatggaggtagtaataatttactactccctccattccataatataaggcgcaactactttttcgagatgtttcataatataaggaatgaatgcatgctattaactagcacttctttcccactaaattattattttttaaatcctccatactcaagatctttaattctgttgggtgcatgcatgatatttactagataaataccccgccgtctttctgtgggaaattaagttgtataatatgtacaaataagccacaatatattttataaccaaaacaaaatgacctcctaaaaatggttccaatatagtgcaaggtgaacatattttatgtaattgatacttatgaattttgagcctaaaaattgagattgcatggttttatgagagaagaaagaagagactatgtgtaccatagatctatcatccaaaggctagaaataattgtgatgtggcttcatgagagaagagagaaatagcattaactacacttagtggggatgaactataagtatataggattaggatgatccaaactatgatgtgataatatcttggtttttgggttaagggtggttgagccttatattttggaatgtagggaataatttataatattgaccaaccatcccaaattgtcttattggtttacatgatggtttttatggaatacagaaagctccagtaaaatataagaaaatgtggatgatttacatgatactacttttggtttcaaaaaagaaacaacttgtgtttcttagttttcattaagtcaaatcttacatagatattgcagcctacagagtaatagtcatgaaggactttttgtctattggatccaaccataaaacctatctaattttattatgtcactgtgggatgcatcctgccattagcttctgttcctatagttcaaggtaaggtctaaaggagccaggtgtctatacccttagttagcactatgaattcccgtagtctctcgagaaaacaatgtgctgaagattaaggttaggtcttacagacacttcacacaaatgaaaattgtgtgttactaaagcagcaagtgcaacagcaccatttaatcaaagctttcactctttcagcatatatcagctataacatttcacattatcatagtgcaatgcagaaactagaaaggcggtagaagtacattggaaagaaaaaaactacatgcctcaaagtttgaagaaaccgttggagtagaagccaaactacttttcagagcatctgaatcagcagagctaattaatgatttagtaaaatccctgtaaaataagaaggtgtttcagatagcagtgcttgcatgtaggtgtgcgcacacatgtctgtacagcaacctgcacaaacacataatctgtccgaaaaataatctaggacagcacagagcttagtataaaaaaaataattgatatgcagttgaatgttgaacaaggaactggcacctttcatttgtaagttggaggattggataaaatggcccagcaagcagagccaaaaagtgtacactgctgtctggagtgtctgtgacactagcgaggtcagcctgcactcagatagacagcggcgattaaagggaaacaacaaaggcacaacataccatacatggacatggggagatgcatgctagtcggaaagcttacctcaatctggggcagaaatggtggtagcctgcttgcaatgtctttgagtaactaatatcaaaaaaattgcatgattagaagaaacttatatgttgccaagacacagacagaagttagaagaagaagaagaaacaaacctggaggtggatattttgagaggattgtttgtgtgcagtgatatgtggcaataggtagttgactagaggctggaggtcaggttccagtccaggtatagggattccaatgagctgaagaagaagagtgacttattactcggaatatatccggaggaagagtaaagttatactagtagttactcctacctggatgaagaagatggcgatagggttgccgcgcatacaagagatgcggacgtagcggcaaggggtgtggttggcaggatagagtatgtcgcgcttgggagcctcgcagcgcgggcgaaccttgacgaaggtatctggcttgttgtagcgcaggccggcagtgatctcccactcgaggacggacttgttgtagatgcggatgtgggagaggaggcacggctcctgcagcagcaaattcagcaattcattcagggctagagaaggagactcctagttagagagggggaagaaacaacaagtcgtctatgtacgcacgcctgagctcgagcacggatcccactccttggtgttggtggcaggtggacccagtgggaagcgcaaagtctggctacagcacattggccgccttctgcgccgccggctcgcacgaagacgccttcacccggaaacccagcaccccgacaccatctccccactccgacgatgcctccctctccggttccatcgcgcagcgcagcccagccggcctcctcctgcggctgcccacacagaggtagaggtagagaggaggaggaggaaggggagagtccgagtcctagtcctagtccgaggaggaggagggttgaagacgacgacggcccacacagataagagtcgagtcgatatcggatgggccttgggccttacttcctacactacgggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaatagaaaagtttcctacatttttccttttctcattcctacgaatcaaaggcatgaatagtgtaggatttcaattcctttgtttttcctccattttccctccaattcaaagggggcctacattttttagcccacaccacacatttcgccccgccgcagacggcagaccacaccttacaacttcttcttcagttgccttccttttggatcctctcctctcctcctctcccgcaggcgcaaggtgtttgatgaaacgcctccatgcatgcatgtacacgagctgtgtgtctacatctctgtctcctttaatttcaatctcaccaacctggttgttaactgtgagtctgaaattctgcaggaagcagtttgttcattcaaaaataggttcaagaattagatactgtagtttcatctatctagatctggactagatatatacaccctgtcacactgaagccggcctgatcgaactcactggtttgtgtgccttcacactgcaatcctaaagggtcttcgccattcacactcctgcacactgctcttcgtatggtgcatatatattatctgctgactcgatccattgtcgcgtgcctatctctaagtgtggtactttctctaacctgcaaatatattgcattctagctagcctttctgcctgaaaatatatattgtattaactgattcaagtactgattgcattgactgcacctttttgggatagtttaacagtgtagcatggacttgattggggttatattaggtgcatgtgtgtgtatacaccaatacaccatggtatcgtacataccatggtcgcattcgtacggtgtctcctgtggactttgttgagtacccaccttgcttacagatggacctataagttccatagcttgcattgactgcacctttcttgacttacaagcacaaaggctcatttttttaagacatcatccctagattaaattaaaactttacatgaagcttgaaaacatagccaacgtgcttctgttttttttttacttttattttcgctcccaattcattgattttgtcaaaagcagattaattcatctcttggtgaatcctttcaaaaaaattcatctcttggtgaacaaagaatcattatataccatttccattatctaaaaaaccaaagaattatcaagtttaattactgaactgatatagagttctagacttcttttgagacagctgtgcttttcaaattgcagatcatgtactctaatccacacacaaaataatctgttagctcttttttttttgaacgaaaaacagtactatagtgccttttcattgaatagagcaggagaaaatacaacccctaggggcaaaagaaaaaaaaatctggagcctgcagctatacactatacaaagtgcgggattaactcgcgcagccgctttacccccgctaaagcccaaaggttagcttattctttgattctcgacatgaggaaacttgttgccacctctttgtggtcaaagattcgccgatttctctctttccatatttctcatacaactagcattatgagtgatcggagcccttttttcggagcatttggcatgtttgcaaggttctcccaccactgttgcactgacagtgcctcctcccattgagccggctcaatctgctggtagccgacccgtccagcaacgaggccctatatccttttagtgtatctacaagtggcaatgagatgcagcgccgtctcagcctcgcagtggcagaggacaaacacccattgttttgccatccccttgtcgcaagtcgatctgaagtccatactctattttgaatgatgagccaagcatgaaatttgcatttccccggcgcccaggctttccagattaaggagttgaaacttgtgctcggtgttccttgacattgcgcatggtaggccgaggaggtcgtgtagcgtccgctacttgtgaatttccaagtaatttggtccggttctccaatgcctaagtggacattccggccgcttcccacagggcaaccagttgtcaactagttctactataataggcgagtgtgattctagagccaggtcctgaacccaggcgtcctcctcctttccatttcgaagagacctccctctgtttttagagatcgcatagaccagtggcatgaggtctttgggtctttgtccctcgatccaggcggaatcccataagcgcgtcatgttcccatctccaattgttttctttgttaaggcggcgaaaagactcctgtcaatttcatcgcagggcgtttccagtcccacccaaggcttggtcggatccttccactcgtgccataaccatcgcagcctcaagaccctcgtgaatttctctagatctaggactcccaatcctccctgactggttggcaagcacgtctttttccaattgactttacattttcctccggtgatatctcccgttccggcctagagaaagcgacggcgctgcttgtctatttgctcaagggattccttcgtggttttcaaggcagtcaggagatagataggttgtgccgtaagcatagatttgacaagcgtggttcttctagctgctgccatgttcttccctgtccagtttgttatccttcctgagattttgtcaaagataggttgcaaatccgcctttcgtaatctacccagtaccaaggggaggcccaagtactttatggggaagtttgctcttatcgccggaacgccctcaagaacctccgtcaactcaatggtgtcacatctgatggccgccacttgggatttttgaaggttggtgacgagtcctatggcaatgccaaagcgatgtaggatgtctgcaaaagccgtgacatcgcctcgagtggggttaatgaagatgactgcgtcgtccgcatacatcgaggtcctcagacgggtcgttctccctcacaacttcgagattgcaccgagctctgttgcctttgagaggattcgttgcagggagtcaattgcaagtatgaatatcagtggtgaaagggggtccccttgtctaaggcctctgccatgcttaattcgctgccctggcgaaccattgaggagtacttgcgaagttgacgttgagaaaatagcccccaaccaatctctccatcttgttgggaaacccctttgctatagcaaggcaagaaggtagtcccagcgaatggaatcgaaggccttagttatgtctagcttgaatagcagcattgctcgcttcaagcggtggtatcttctagccttgtttcttacgaaaaggaagttgccatgaatgcttcttccttttatgaaggcactttgattgaccgaaatcaacgtatgcatgtgtggccttagccgcagcgcaagcatcttggagaagatcttggcgataccgtgaatgaggctaattggcctgtagtccgcgaccccctcagccccttctttcttaggtattaggacgatgttcgcggagttgagcagatttagatgtgcacatatgagattatagattgagtctaagactagaagaatgtcttctttgatgatttcccagcagactttgaagaagatcccagtgaagccatctggccttggggctttgtcggtgggcatctccttaatggccctatgcactagggctgtcaacgagccgagctcgagcgagctcgtcagcctaggctcgagctcgatacaagctcgagccgagctcgagccgagcctataaaatgttcgagctttccgacaggctcggctcgagctcgattaccgagcttgatttttaagtaaaatatatatatatttcaaagataatctttaaaaaaataattaatttctagtttatcatactaatagaagaggaaaaaagaataaaataaatatattatgtcaatataagacatacaaataacatatttgatctcctaagttattaagtaacaataaaaatgatatattactaggctcgttagaagctcgagctcggctcgacaaagctcgcgagcttagggagaggctcggctcggctcgtctggagctcgagccgagctcgaatcgagcctaggacgagccgagctcgagcagctcgcgagcctcgagcttttttgacagccctactatgcacctcttgctccgagaagggctccccttttagttttctttggcttacaatttgatattatcagatgtagtgtcactgaaaagtatgccaaagcaagtgctgctggttgtgcatggtggtagtgtactgatgtgcctcagaaaaacagtgcttcgtcatgcttgttagggcaatttgattgcacatggtaatagtattgttttttattgaataatggtaatagtattgttactcgttatatactcttccttcatcgatcgtgatttgcaaaagcaaaacccacagccaactcttgttaatttgaggaacatataccaacaacaatatcttactcctgtaaacattcaattaaaataaatatatagccgttcctattgttacaatcgtagaaacaagctatggctaatacaaatgaacacgctatatagtagtataaaagtaacttacagttgtccattctaaaaaaaaaaagtaataacttacagctgcctcttggtggtattaattaattggtcccctagtaactgtaaaaaataattgtgtgataactggcagagagtaggaagtattggatcctatattggagtattgctcattttatttaatttaatcattatacgaatgttcttgtatcagagtgtgaagtctagtgggagggtgaagtgccttaggttgagcaatggcttgaaatcgttgagcagatttacattgtgatccctccaggttcgattaaggtgaggctatcaagttattgatttatttttttcaatgctgggtgttctttcctgaccaaagctttttctggcagatgaggaccttctccttgtctgccttgtattcggtatcatgcttgtcacagttccatctcattcctttgacaatgatggctacagaatccagaaagtaggcgttctcgcggattatggcataaccagtgggacgaaggatacggtccatctcaagaagtacaaacttcatctcgcacctgcaattgcaacgtacggtaagtacgtgttaattgtaactggatggagtatttcttacttgctttcttgtgaatttgaagttagaaatgctgatttgcaagtgtacgtacctatgagactctgcagtaaacaagccatcaagatgcaatagatcgtacgtcctggggtatgtagagaatgcctcacacctacagtagagttgattggaaggacaatgagtagttgaataattaagctatgatatagtagaagaatgaattaaatgcaaatagtcaccagtcgtggttggtgccgatgaggcctctgtcgaagacgacgccgagggagttgggtccgtaggaggagacgacgttcatgacccagacggggtccttgatgaggctggcggcgaagcctccgtagacggtgttcatgtccatcacgttcctgatcttgtcgctccccagcgccgggagcagagccttgtagtgcttggtccgaagcttccacttgccatcgtcgtgcttgaaggcggcggcactgctcccgggaacggtgccaatgcgctctggggcgacggccaggcgctgcggccacttgggggtggcgtcgagcgccagcttcttgtagcgcgagaaagtgaaagaaggcgaggtgaggcaggagcgcatgggcacgtaccaggcggcgtccgggtcgacgctgtcgtcgcacttgggcggcgagaagacgggcgtgagcttgtcgtagcaggcagggtcggtggacttctgccacacggccgtcgcgacagccacagcttactagtaatatgccaaatggtttataaccctatggatataagcgttggctaaaccttcgagcgttagtaatatgccatgactacaggtattgctccacacttgctacagtcactgctctttttttcccttcttttatatctgaaagccaccgaaataagccggaaacaaaccagataatatttgcattcctcggggatataaagaactaaaattcacaaccaattttcagacaaatgatttttcagtttttctctaaggtccttctctgttaatgcataccaacaaaatgcatacttcctatagcaaacaagaacaggccgatgaacatataaaaaacaatacatttcgagctgcatcgtatatttttacacagagaaaagaggaaggaagattaaaaaagataagggccaaaaaaacaaccccacgtatatattgtttgaagcaccattcgagatagaaattgaatctgttactatgctcgaggtaaatatataatatacacggtgcaagtaagagtatattatgtttttctaccggaatccattttgtcatgcattctgtaagaccccaacgatccccacgcatgcaagagacaaggttgcactaaaacctaaactcaatttattcatccaaaaccacgatctgaaaccatacatacatccctagtaaatctgaaaccatacataagatgccactggtgccggtcctcagtaccgatcttcctcatcatcgctacatgaagagaaaagtatgtatattccctccacatctaaactgagtataagggttgttaattagaaaaaggtgatctcagtcatagaagtaaaaggatggctcagattaggtgaaattcacccaggaaaaaggatgtctctatgatgtacagatgctcatcatgttaacacttcactgaccgtaacatgtcaatcatgaattccgtgttgtcatctgaagaagcctaaaagagataaggtcttttaaaatggtaaaaagaacaataattgagagagtgaaggctagagtagacgctacacaccattttggaaaatgataactgatgttccaaacaaagttgcctcgcaatttccttaaaagcaaagtaacagaagcattagcatggctgcattggagttgataaagcatagaaacaactatggagttaactgaattggtggacaggagttaagagagagggagatctggttcagagagcatgtggaatacagaaattgaaccaaaaaagctggcatcagaaagctctaaccttcgtggcacagttgtcatcactatgtagcatcccattcagcctgatctgaaaaaagtttgcacaatgatccaactggactacaagttaacaaagtctaactaattgtgcattatgatatattgtccttttggctaggccatgcatttgagaatataaaaatatgaaaggaatttctacatttagccttgtccccttccgccctaaagcgccctgaaacaaactattttctcgtaacctgtgtttatttcacggccaacgtaggtaaatcattggtcgtgtattacgcaaatacatggatacatttctagcaacaagtaaagtcaggatattgcattaggatgctccttcttcagatcgtctagaaccatgtcgacccctgcgaagaattgaaatatcagtccaggccaaaacaacagatagcataaagtcgtagaccgcccactggcacatttcgtcgaacaccacccctgcattccagaaaactgctgaaaggggaagcagaaggaaaacctcacagccgcaggggccgaggagcaggacggagttgttgcaggcctcggagacggagctggcgacgaggtacttcagcttactgtgcccaacccagaacaaagcgcgtcaatcatgagggaggcgtctcgcgacgcggtcggcaggagggactgggcgccggctgcgcggtcagcggcgaggggcggcgccgccgtcgctggaggggggcacgagcgtcggaggcatatcgcgagttcgcgacgcggtcggtggggaggggagccgtcgcgctggtggcgaaacggaagggtggcagcaggggagagaggaggaggcgattagggtttgccggggggagtgcggcggcgcttgtggtggcaggggatgcgacggcgctgtaggttgggagagggaggcggagcgatttatgttggggaaggagagcgcgttgaagatggcaggaggagcgatctgagcggcgtgattttcggttgaggggagttggggaaatgcgcgcggaggttgagggggtacgtggaacgattctgtggcgttggattggatgattctcgtccgtagtatttgatgaatgagtatgtaggtgtaagaatgagttggtgaatta

SEQ ID NO: 34978 - DNA, 470 bp, Oryza sativa
aagttgcttgatgcgcttcagatctccctggttgatggcgtaaagttcgccgtcaataactcgcttattaccagtatcaacagctacagttgcaccatcaggaatgactggctccatactgtctcctgatgcaggaaaacacaggacaccagaaccatcactattggctccaactcgacggagcgttgcttttgaaaagcgcaatttaaaaccgttgtgatcctcatcgtgtactcgtccatcaccacacgcaaactcgatatccttcaaaaacggtacttccacctcatcgtcaggtaggggggtatttttgtcccaagcgtcgacagttccccactcagactctggcgggatgttgctctccagatccttctttggagaaccctctccatttaataaccagtcaagagaataaccgaatttttcagatatttgttgcgccgcctcacgacttaacgcgtctcttttta

SEQ ID NO: 34979 - DNA, 766 bp, Oryza sativa
gtggctcagtatgggcagaagagttatgcagataaccgacgctgtaatctggaattcgcagtggacgattttgtgtaccttcgggtcacgccattgcgagatgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtggagagaccagtgaaaatcctggacaccatggagcgcaggaccaggaaccaggtaatccgtttttgcaaggtccaatggagcaaccacgctgaggaagaagctacttgggagcgtgaagacgagatgaaagcagcccatcccgatctcttcgccagttcttccgaatctcggggtcgagattccgtttaaggggggtaggtttgtcacgtcccaaaacgactctaaaatatatcctctaaattatgcctagaataattaaaatccgtgtgaaagcctccaacaattaaaatgtgcaaagttaaaagtcaaataaggcttggaggatttttgtatatttcctaaaaagcctaaaatgcgtaaataaattttagtggaattttcagagcccaaataataattattaagaaataaacaaagttaaaatgattttataaaaagaaaa

SEQ ID NO: 34980 - DNA, 7632 bp, Oryza sativa
gagggagatgggccgagccggcccaagagggagagggagggaaaggggtctttttagagcttttctttttataaaatcattttaactttgtttatttcttaataattattatttgtgctctgaaaattccactaaaatttatttacgcattttaggctttttaggaaatatacaaaaatcctccaagccttatttgatttttaactttgcacattttaattgttggaggctttcacatggattttaattattctaggcataatttagaggatgtattttagagtcgttttgggacgtgacacgttctcatctgctccggcagcgtatagtaccaaggagtagacctgaaggaattcttctgggtcggtactcccatcgtacttctctattgccccgggtcggaatctctcaggccatcagacatcacgtagcgaatggttgaaagctctacacccggcgctgggggcggtgggttgttggcgatcgtacgtcctccgtggatgtctatcggatggtgaggatgaagagcaagatgatgatgacgatggttcacttggctccggtgtccgattccgaggacgacgttcgggttctcgagagtcctgtcatcatccaccattgtcgtcccggcgccgatctccattatcatcaccgtcatgtcggtgtcctcgaccaatatcgtccggcgtccgctgttcgcgatcatcgcggtcgtggcggttgtgacgattatcatggcgtcggttttcgctcgagcggcctcctcgctcttcgttctcgcgacgtcgtgaagagacacgatgtcgggaacaattctcgttgtctcgcgcgcgtcgtgcttttcggcagccattcagatggtcgcggagatcgccggtgccgcgaggtggaggggtagctcgttgaggcgacgtccgttgttccggtggttcgctgtcagcaccgccagctgtcggttgttctggttgcgctctggtagcggcctcctcgaacgcgttactgagattggctaccgattcccgtagtcgttctgtccaccgtgcgaggtcatcgttaagtacgggatcataggggatttctctcagtattgcgttgatggtgccgaggtgctgggccggcgtgaccgcttgattctccacctctgcgatagcatgtgcagacgtgctggtcccaccgttggcaaatacgtcgcgtggtgtactggaggatgatgagccatagtcactagtggagataggcacatctatgacaatctacttttgtcatggaagacgcgcaaatcgtcataaagtaacttctatgacgaatttatgacgaaatgggattcatcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttgacatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttgtatgtccacgtggtggtgtacgctaacgccacattgccgaaggtggaggcaccacgtgctctcattttgaagcgccacgtgtacatatctgatttgtgacacacgtctttacctgatgttgtcacgtgttgatttgtttggatgacacgttagcacagtagggatgaaggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggacagatttaagttaccctgggaaaggctcaagatacgtcgaaggagcaaattgttctcttcctgctgctgcttgaactctgccaactccttttgagtctttgccaaggcttcatttgcaagatttgcttgttcttttagttcgacaacttctgcatggagaatggctaaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggcagctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattagctttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattctttgttccttcttcaagacatagcgagcttgtgggatgcgaactgagttgccatcctgctgtaagtgcaagttatgtcttttgttcatatcatgcaaatctatcctcgaattgactgtgtcctttgtcttgccctcgattttgagcaatgtgcccaaaatgttgtcacatatgtttttctcaaagtgcatcacatcaagattatgtggcagcaacaaatctttccaatatgggagcttccacagacttactttgcggctataaattagtggcccttcattctctccacgttttcttttcttacttgtatcatgcttacccggtctaacatctttcaccttctctaactgctcgaggacctcatctgtgctgaattttcctggctcaacctggttttcatggtgtccatcaaaagcatggctttttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccaaattggcatattccttcagaaatagcacacaattattcttgcacacatggatcgacacatatccaaggcccaattcacgaagatattctttgcctcatcataagattttggtaattgacattgagggaatgccgaggacaacaacttcaataattcagtgaaagctgtattgttgattcgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttctctgttcatacaacacaaagcataatctttcatagctgaacttgcatttcatactcagagtaatgtacttatggaaaatcataccttatatctactgaacggcgttggtgatgggctgtgcgcgctgacgacaggattgagagaggaggtgctaggataagacagtgggcgaggagcagccgatccgtctcagtcgtcgaggatcccccgcgccgaccgggatccctccgcagccccaccgaccaagatcacttcaccgcgccgccacccaccacgatgctccacatcacgatgccggccagcctgtggagccgcccttccctgcaccgatgggataagaaacctcctcctctgcgccgtcccggtggctaggatccgcccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcatagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggatagccacgtatacaatgtggggtccagtgacaacctagatagccacatatgcaaggtgggaccaacagcagaatagagatttacttacaactgacgaaatatatttcagcatattgtattaataaaggagcgtcataagtgtgttacatgaatggtgcgcaccattttatgacgaaattatctattgttttatgacaccattttaaatttcgtcatggagtttcgatgtctaccctccgccatgagtgatccatgacgaaacatgaaatttcgtcatagatatgctgtattcaatgacgaaattatacaacgtcatgagcaaaacgccatagatggacgatttcctactagtggtcttcgagcaagtgtaggactgatggctcgtggggatcgatgtcgatcaccccaacaaatcgatccgagatcagcgtcactccttgttccttgtctgcatccctaagagagattcgtgactgctagaccttagaaagcggcgtcttcatggcgcggagaaggaccttacagcttgagaagtcgtgattcttcgtcttgtgaataggacaatagacatcacgagttggagaagtacgctggattccacgctctttgcaggcacgaatctcagcttgtacattgagaaaaacccagcaagcttgcaaggtgtgtttcctggtcttgtggataggacaccagggctttgttacctcggaagttgtccttgtcggctcgtggttcttgtcgaaaggacaaggtttggccgcactaggatccttctcgggctcgtatgacgtcgacgttccgttcttcgctacggcgggaggatccttcgacatggagtcgtctggggttatagccacggcgtcttgcttccggtcattgatggaccagccgagatcggtaccgtggtataaaccgggaagacgatttcgccgacttgagtccacaccagcattgttgaagtagggactccttggatgaggccagtgttgacgctgttgtcgacgaaacttgatgtcatagtagtagaaccttgagcaccaaggccccctacctggcgcaccactgtcgacaggggatacccgtagaccggatatagagggtattggggtacgctggtacgaggatctacgtagtacgacatcaagcaaacaggtaaaatggattatactggttcaggccccttgataggtaatagccc

SEQ ID NO: 34981 - DNA, 4370 bp, Oryza sativa
cgatgacaccgacgagatcgtagtcgagttgcttcgactagatcacccggcgacttggctcctgtaggctccggcttcgtaggctgtggtggttgtcttggctatgagattcgatgccttaggtcctcccggggggtcccttttatatcgcaagccaggtggtttccaagtagaacttggagacatcggaccctgcacggtatagtgacgacccagtcctatacgagtaggaatctttccatcggtggacttcgtgatgaatttccttagcgtatacaaagaacgtccgtacacgtgcaaatataccatattgccgcatagcgtatatccaaaggtagagggtatgccttatccgtaaccctaacacatataatagcacatatgttttctcaatgtattatttaaatatattaaaataacaatataattttaaattttgtactaactttacgaaactactaatgtgtaatattcatattgaattttatataagtgttagtcattaattatttttaatatcaaattttagttatttgtaaattatattcctatatagactctagactcgtctttcaatatttcttctttttaattctgaatttttgttatttgtaaattgtatttctatatagactctaggctcttcttgcaatattatttatttttaattctaaatttttattatttctaattatatttctatatggactctaaactcatctttcaatattctttaatttttaatttcgaatttcacttacttctaaattgtattcctatattgactttagactcttctgttcatgttttttttaatttcgaattttagttatttgtaaattgtatttttatacaaactctaaactctacttttaattttattatgtttattgcgaattttagttagttttaaattcctatatggattctatactctacttttaatattccttgtttttaattccgaatttctattatttcttaattgtatttctatatggactctatactcaacttctaatattccttatttttttaattccgaatttcagttatttataaattgtatttctatatggattccaatattccttagtttttaattccgaatatcaactatttctaaattgtatttttatatggactctgtttttctttttctccgattaatatgagaatttctaggccgtgagagcgaacgtggaggctcatttttctattcctttaataagttaatagatgttttaaagaaatgcaacattcaacaaaattaattgcgacaccaataggcaatatgtgaaacatcgaagaaacactactataacactgtgaaacatcaaagaaatgcaatataacattaagaaaaattattgcctatgcacaccaacaacaaggcagtgcacaccaagcaagcatgacatccagtcaaatagggtaagacacacaaacacagtaaagtgcaacaaaataagcaaggatttcgaaaaagaacatcctcaaaagacctccagcagagttctcataggccccaagactcggcaatgcagccgcacaaggttctacgtctgccgctggaactcacacccttgtatctactacagctatgtatccatcggagctcactgctgcctcgctcatcgccgacagatcgtgtgttggtgtctcatggggaggatggttccggtgctggtgatgcaaccggatggtagatctgaagtggaaatgagaagggaggatgaagcgaacacccaccatgtgcaaggagggatgatgcggtgctggacgaatgatggccaagggggattgagatcctctgcattgaagaagaaaatgaaaatgtagaggcgctacaatatcttgcattgactcatgttttgatttgttggatcttcatcgaatggtacaaactgttctttttttaagaatgcggtacaaacggtttgctacaatacttttccttgtattatagatgtaatttacatcctatgttcaataggggatggatggatggtatgctttgtatgtagaaacgtaataatgttttgatttgagaatttggatttcatttgagacaactaattttctttccagttgtaactaagtatggttttttttcccttccttgggtgagttcatgcatacttctacgggagaataggtgggaccgttggaggactaatagtttttatttccaatgataaataatatatgttttttagttagtatacgtacacagaagtttgttttcctttttttctactatttacagatatttttgtattcagtgggaagttaggtgggaggcattattttttattagtagatctaatctaatggtttaaaataatgggtcaccaatttaattgaaaattcagggctggatgtttttcttttttctcataatttctaagattttctctgatttattagaatgccatgtggcaatctagaagcgtttgtagcagtgccacgtggagcgtttgtaggaagttttattgactagtatataatagatcaacatccgaactataacggtatgcatgctaacatcttttattttgtttaccgacatatacatatgtacacattattcaaatgatacaatattatgtttgtaaaatataacacaaacacatccataaaagatttacttttagcatttgagtctgcatagagcacaccaatactatcactaacaccatccataatccaaacatatcaatgagaactgagcattgctcagtttatgtgctggggggatgttcacccagccagccaacctagctatagctaggttcaggtagcctctacttgggttcaaatcccgaacttatgtgtgtttctcatggggattttgtgtgccccgttcttcttaattcacagatagccagctgcgctcctcctggctattaacatttttccagcaaagtggtaggaagcaattgccttctcttgtaacttaccatcagttccccatggggctcaggcacaaacttggtaaagtcagatttaggcaatggagacaacaatctgagctcaaagtttctcagcaaatgactccaaatcgctttaatctgcatgtaagcatagccctcaccaacacaaccggtccttccgccgccaaaagaagcgtaagagaatttcccgccaaccttgtcctcctctctccctgcaggaccaaacctgtctggatcatacagatgaccatccttgtagatataaggtacctggttgctgatcactatagggcttgcaatggtgtgccctgcagggacagcatactcatggccttctctcgtccggacggtgaactgcttgtgcgccgtcctgactagcatgggtacaggagggtgcagccgtagggtctccttgatgcagctgtgcagcgtgcgcatctccatcaaagaaccgtagcgatcatccgtgattctgccgccgccgttgatgttgctgtgttctctggcgatcttatcctgctcgtcgacagccgcggtgaggaacctctcgtggctgagcaggcgagcaccggtccacacgctggtgtaggcgctcgtgtgcttcgcggcgaagagcaggcagatcatgagcgcggcgacctacgcctccgtcgtggcgcgaccgtccgccttgtacctagagtcgatcaggctttggagcacgtccttgtcgacattgtctccctcccgctgcttgcgagatctcactatgtcggagaagatggcgtggagcctcttgcgcgccatgtcgcggcggcggttggaagggatgagtggggtgtaggggaagaagacgctcatcaggttcacgccgccctcgatatcgcggaacaggttgcagacctcgtcaaacatcgtccccatcacctccttgccgaggaggcatctgccagagatcaacaggagtagttgctccagttcacgtcttaggtcaacggtgccatgttgcccccatttcgcaaagtaatcctgtacaatgcatagatgatgccatattgtaagttactcaagtttctgatgactgggtgctgtatttttagatgttggtataattaatcatctcaaaagtatcacccaataagatattactccttctggttcaatggttcaatgattcttgatattttggataacgacatggtttatataatatattttcactatgattttctattacaatatataaaaagtaaatatttatctaaaaaaaactttttaagactaatctatatatcatgttctagtgtccttaagttaaatatatatatagtctctttaaattaaatattttaaaagttataaatagtcaaaattctaactatttgatcccaatcttacccaaaacgttaagaattaaaaaccggagagggtatg

SEQ ID NO: 34982 - DNA, 3785 bp, Oryza sativa
atatatatatatatatatatatatatatatatatatatatatatatatatatatatatatatatatatatatattcaaattagcgttgaatatttgtccagtgatatttgacaccatacaaatataaaatatgatgtgaaattatttaaaaatatcataacatcatttattacatgtcgacgcatatgtcataatgtatttagcactatagtaaagctattatgagtcattaatggtttgtttaattaaaggaatacaacatgatggtaaattgttcagtcaaaaaaaaacatgatggtaaattgcatgtataatttaaaagttatgaacgtttcaagaccggtgatatattatgtcataatctatgtcgtcaagtttgctacttttatttgcataacatgtaaaatattagaacatagttccatgtgcaacttttttaataaaagcatagttcttaacatattttcttaagataaattatctggcactctattcaatcatattgacgaaattaattacaatctgcctaaaaattaacagactcaatggtagcgagaaacacatggaaaaaattcactcgagtaataatctcactaacatgagttagtgggttttgatattattatggatctaataatttttagatactttttactacttatatcgtaaccccgcactatattaaagaaagtgtaaagataagctatatcaaagaatactcacggcgtgtgtcacgtggttattatagatctaatttagcaatgcatgttggtgagcaaatggttgtcaatactaattgatgcgtgagaaggacatgcaaaaggatataatgtgacatttttttattagaatataggctatttcactaagaaaggctataataaaatatttcgacaacgaatatgacgcacatgtaggtgcactttcaataggattatataaacgtgtgttagaaggtgcatttgcaggcatgtgagtgtgaagttgcgtatgtagtggtgtgtgtgcgcgtgttcgtctactttataaaataaataaatacaatattccatatgtgaacattttttaattaaaatgtagttagtataaaaatatagttaatataggatgcaatatattttcttctgttttatattgaagatagatcctattttaaatagtgaattatggtttaaataatcactatggtagaaaataaagagagtaaaagaaaccatagaggagggtgcggaccatgaactgatcatgtgtatgtatacaaacatattacaggtttgaatctaaaattacgagggaaggatggatttactttttcccaactgtatctacaagttttattttctgcttttttttcagcgtatagtgagtaccacgtgtacttatgtttagaaggacagatggtagatacgcatacaaacataacaacttttggctatgttcacaggtctaggttctaatcctcgtttcccgcacatacgatttccgctactactaaacggtgtattttgtttggcaaaaaattttatagaaatgtggctgtaaaaagtcatattaacccgttttaagttttttaaactaatacttaggctgtgtttagattccaacttttttcttcaaacttccaacttttccgtcacatcaaatatttggacacatgtatggagcattaaatgtggacaaaaagaaaaactaattgcacagtccgactgtaaatcgcgagattacatttaaagaaataattaatccgtcattagcacatgtgggttactgtagcacttatggctaatcatgatgtaattaggctcagaagattcgtctcgcagtttacggtcggaatctgtaatttttttttgttattagtctatatttaatacttcaaatgtgtgtccgtatatgtaaaaaaaaattggccaaacttttacagcatcgaaacatggccttattttttttaaaagaaagctaattaatacttagcattgaaacatgtgcataataataagtaaccccgtattccatattaggacggaaggattaacattttttttcctaatcgtacacgtgtacagaggtagtatgtatgtttatttcctactttcgtccagtgaacagtgcgtatatacgtattttccttgacgtatatctgctgatgacatttttgaccggcacaataccctcgcacctacctgtcatacataggcggaagagaaggggtgggttattttttaaaatctaatctaatggtccacaataatgggtccaccaatttaaataaaaattaagggttggatgtatttctatcacgtggtggtttaagagcgtttttagattgtcacgtggcggcctaagagcatttgtaggaagtttaatagacttttagtatataatagatatttcataaacattacaatcgtacacctgttgtttttttggatttatgcaaaagaagtaatcaaaatctagtgcttgctcacctcaacttcttgaaccatgggatcaacatggatcctcagcctggctggcttcagagcatcaacaaagaagcgagcctgttcattcctggtggcgctgtctactccatgggcgatctctttgccaaacataggcaccgtgaactccaacaggttgccatggctgatctctgattccaaaccttggaagaaatgggctgagacctctggtccgaccaagaaggtcatcttcagtaatccagccaaatttatggtgaacacgctgccaaacttcgtgtacagttcatgcaatatggctggcaaaccactcctgaaaagagtaggcaagagtcgtaggagggcaattgaattcacaacaggtggaggaggtggcattttgcaggtaggatcagtggcacttcttctccttcctcctcttgcaatcttggtgacggctgcagtgatggccagaataatagccatggcgagccacgtgacgcagtggatgggactacgagaggaccattagcaatttgaaaaacgtctgtgcggaaaacaagataatggaagttaggaacttgccctaccaaatgaactctaactgtagttactacctccgtcctaagactctatttctggggcacgcatggttagcaataaacactttttatatagtagcttctaacattgtgaatggcgaggatgggaggcttaaccatacacaaattttttgttagaccgataatttcacactttattcttgtcttatggatccgcggtctatcctccctacctttctatagcctacaaacaggttatatgaataaggaaggtgcaacgtctatatttatatttactcatgtgttagacttatgatttcatcctttattcatatctatctcgttccaattctgttttttaagtcggttgtacggataaggatgtaaagtcctttgcatggataagaatgttgtgcctatatatatttatgctttggtatcaatctactatcacattaagtcaatccattaagttaatctttgctttcacttttttgaaataatagaaatggttcatatctcttgcctgtgctaataaggcacaagagctgtgcccaaaaaaagcaacaattggttcttccacggggaaaaaatattctaacccatatctatgcattatgctacatttcagttcatcttgccaacgaattcatgggatagaaatccatgctgcatactcacacattcaaaaggaacacaaaactgatgttacctaattctcacgatcaatggaacaacggatgcaggtagagatcactcaaatatatatttcagtaac

SEQ ID NO: 34983 - DNA, 22746 bp, Oryza sativa
agagcatacctgaatacaaagtcattcttctcctcgcagaactgtacactgcatatgtgtaagcagaaatagcctcctctcaactatatatactgcccctccagtttccaggatgcatatcctaaaagaaagaaaagaaaagtttccaggatgtatgcatcaacctaagtcaacagcaaccaaactattagcttgcatgtgccacgcgatcgcctaaataaaacaggctacaatagctcgaattttttaaaaaaataaaaaattaaacatgctgctagtattgatgattcagatctgttatcttagtccccgacgaagaaccaaactattcgcttgccaaaaacatgtttacataaataaaacaagctgcagtatcgtttgaattttttttaagaatgaagtgtatcggcgcgcgatccttgcatgtgtgtattacttaggtctcaaactttcaaaatgtatttttgattctcgaactcgttctgggtgccctaaggttcaaatgggtttaaacccattttgtgtactgatgtggtaggtagtacccactttgattcttttttgtttttctctcttctccttctatccttttttcgctttcttttcttttttcctacaagctcgagcaagagtctggagcagggttttcaattttgatttcggccatttcggttctaccaaattttcagtatttttggtacttattggaccgaatatttttgaaattttaacataatttaattgaatttgacaaattttaaccaaattcaaaaaaaagagaaaaactgaaaattttggctgagataatcacttggcgggggtcagtaattttggaaatttcgaaccaaaattacaatcactggtctgcagaagtttgacgcatgcaagatttgactagttcatacttgccggagtttgtaccatacgagccttgttatcgttgacgacggggacgacgccctccagtccatgctctacggcggccggcgagtcgttggtaggggccggcgcagctagcccaggcgaataactggtagcggaccaacgatggctccagcagaggagaatagatatttttatttttatttttcctatgtgactgacaagtgagtcccgctcacacaaatgcatcactgtgatattccggaggcggctacgtgtgcaaatcgtcggacggtgttgcaccatattgttgagggatgtttcacatgtttcatctcttgataaaaattgctttaatgaaaatgttccagatgtttcactagcagagaaaaaatgtttcagtgcttgtgcaaaattgtttcaattcttgagcaaaattgtttcaaccaaatcaatagtggaacatactgattgcaacacaaaaaaccaatgtgtgcaacattgaatcaaaatagaatgaaacaaaggtggtgttcttttctcctgaagataaaaatgaatatgaagattgagttttttacgcaaaacgaggtgatattaacgtaagattgattgagttttaattattacaaacttaaaaaatagattaatatgatattttagagcaactttgatatagaaagttttcgcacgaaatgtatcgcgtttaacagtttgaaaaacgtgccacaaaaatcttaatattcatccaactcttgttggagaaaagaacatgacctaaggtctagatcagagtgcaacaaaaatacaaataagctacaacatcactaaaattcgcaacaaagcccacctttgtcttcttctattccggtcaccgaaataaagcgaacgacatagggagacaagcgaggtgaggtgaaggtgtagatgacaacaagggcaaacaacgatatcaggagggcgacctcaccagggccagtcatatcggcatccggtccaacgccaccttcgcgtcgtgagctcacagctgctttgccggtggcaaaggtctagcgcctcatcttgtcctccctttcgcgtcagcctgatccatagtcaccagcaaggtcgtcggcatcctcccccctcaccgcttcgcgttgccccaccaccgccagcatggtcggcggcgtcctcctccctcttagcgtcgcgctgcccgccaccaccagcatgtcgccggcgacctcctccctcttcccgtctcggtggtcgctggcgacatgctccggtgtctctctctctctctctctctgatggttacgagaaatgagaggataaggttgtgggaatgacgggtcgaatcaatagtgggccccacctttcgtttctgttccgtccgatattttttgctccatcagacggtagatgcaaagcattttcgtgatattccacattagcgaagaagggagtttttgcccgtttggatttgcatggaactcaagacaaagtttagagacccgaaaatatattttgaacgtttagggacgtagatgatacgcctgtgaccggctggaccgctcatacacttcactcctttaattctcaggtgtgactttgatcgtgaacttttatcggaataagtttataaaaactaattaattattttaagagattatgaatggattttttaaagataaatatacacatattttttaaaaaaaattaatctaagtatttagaattcattgatggttagagttctaaaagtttgataaaaaaaatctaaatactccctctatcttaaaatatgttatttttctttcataaaatgtaagggattttgtgcatttgactttatggacaaaatatgttatattttgtgatataggtggtagcaacttataacatttaaaatttgtcatagtagttcttttttcatctatttattcatttcaaccgatcataatcatgcatctcatatttaattgtttacatactccctccgtactcataaaggaagtcgtttaggacaatgtttaagtcaaaccttgggaatataaatcatgaataactctcaagttgttgagtttgaaaatgtaaaaattatatgaatagatttgttttgaaaaatactttcataaaaatatacatatatcacttttcaataaatatttttatagaaacaagaagttaaaagttgtgttttagagaccgtgtcgatgtcctaaacaacttcctttatgagtacggagggagtactttctagtttatttaagcaagattaaggttaagggaaatgatttgtttcacttattttgttagctaaattctaaatcgttggattccagtcctatgtatctgattgcctgaaaatgcttgaattttcgtgcattgagatcagtgtctgaaatacttatatattttgtacaaatcctataataaatacttgagaacggatgtggtacaacgtttaattttgctgcattccgcacggaaaggcttttctaatcggtagctgctatcggtgcctttcagtctgattggtgtaagatatatttagaaatacgggaaaaccagatcgggacgctaaggtagtcaacgtgccctgtatggattcgttatgatcaccgttttttcctagagtgtatttggtgctcatttattttttttaatataatggaataaaaattctggccattgcttaaaagaagctacaatcacttattataaaattctctcaaatagagcaaacacttagacaacaataagaactgaaataataaagccaacacacaagaagaaaacaattattgaagtctatttgtgaacatccatccctagttggtgaaaatctacattaccgtatttggtactcatttatgaccacaaagaacgggtgtggctaatgggcgggtgatcgcccatagtgatcacccccatccccctatacgctcctatcccccttcctcccccccttcttctcttcctactacaccataaatttttaaaaaatagaaaaaataaagttggaaaattttatgtatagaaatactatatacataaaatatttgaattcaaattcaaatttgaaatggatatgtaaacttttgacttataaactttgagtctataaactaatatttgaattcaaattcaaatttgaaacgggtatgtaaacttttaacttataaactctaagtctataaactttaggtgtataaactttagatgtatagaaatactatatataaaaaatatttaaattcaaatttaaattttaatcggatatataaacttttgatttataaattttgggtctctaaactttagatgtgtaaacttgaggtgtacaaactttaggtgcataaatttactaaaataggaaagtaatgcggtgtaaaaaaggaaaccgcgtggaggaaggaaggtgatcgctaggggcgatcgatcgcccgttagtcttttcgacaaagaactatcgaggtggatcttacgacaaattaaagaaaaaattctcaccggtcataaatttttttgtttaacataaaactttgtgaaccgacaattttatatttaaaataagtttataaaatctgaggtattattatattgcaatattttttcaaggcaatttttatgcattcttgtttcttatgtgagcattttgagtttgatcaaatcttgttttaaaggttacacatttttgttagaaacacggtacaaaatataggtaagcacaaacacacgtacacatttacctttaggaccacacacctacaggtggtaatgggcctaattttagtctatgagggctgggtttaatatgtgatggacttaatttctatatatttttagcctaagaatatttgatggataggttggttatgaaaaaactcattggtcttgactcattaccacctctacccacatcctagcgctatgagtatctccaagagactggaccgtcatatcttgagattgacgaagtcaccatagatgtcttattgcctagtattactttagctgcacaggtagtctgatcgataaacgcagctatgatgtggacgacggaaccgaggatggctgtagaagatgatgcccaggcacaaacccgaaaggggcctccctagattggaggttgaggaagccttgaccaattgtgaaaacttcagccataccttgaagaaccatcgttggagacaaggatgaagactaacgcggtcgctactagataaccggagatgaacatcacggccagcacaaccttcattcaagcagatcctccatgaattccgaccattaattaatacgttgtccaaacgatgaataatgaattgagtattaattattataaaattgaaaatggatttattttgtaagtatttttttactttaaaaaagaaagcactgtttaacagctcgggaaactaatagtgtgctaaaaaaaattgagatagtagctcactctaattattaagctgaatcaagcatgccccaaatcttacacatgactcttgtgccaagactaaaacacaggaaacaaatctcataaaggataaaactaccacatgaaaatgacataaatgttgttgaacactttctttgacagagaattgctgagtacatttgtgggagctgcaggctttttccttttgacttgcttcctcacaagcagttaaaatgggatgtcttgaaatgattctcggtccaatatgaataatatttgagaacttttacaggacaatatactgctagtatatatgatctaacagtgtagattgatttggttttttagttaattagattacagtataaagtttgaaagggtaattttgtcttttctttgttattctatcatcaaatcgtgctatcgtcacgtgcttcgtcatcaaatagcgctcaggatgctcctcccctagcgcatgataagatccagaaccgggtactcctaattagattcaatctaaaacaaaaattactaaagtgttgttttattttctatcaaattcttaacatacccttctatatactgctagtatatactggtagtatattgtaccgtaaaagttctttaatatttaactgctttcaataatctactgctttgtacagaagcttgggcactcccctttcctcatccacgctttttttttctccacatgtacaatttacaatcgcaaatgcagacatgccgactgcttttgtccacatgtttggttcaggccgcttcccttggttcgaaacacgaactcagtgtgtttctttgaaatttaaatgtctgtgctttgctatgaattaatttgaattatatgcatgcactcgtccctgtagataaacttgattttagggatgaaatagatagccacaatgtgtagaatgactatcttgtaatataaaagtacataaggattagatggtaagaaaatataacatagacttggtggtgtggcagtctagcagattcactaccaccaccattgccttcttttagaagagtatatctagccagctcctctgagttatatttccttttcttttcctaacatacatattggcacatatctatactttctatatatattaatagtacataacttcaccgtatctagtaagtacataacttcaccttatcggttaagaggtaggaagcaattgccttctcttgtaacttaccatcactttcccttggggctcaggcacaagcttactccagtccgtcttaggaaatggagacaacaatttgagctcaaagtttctcagcaaatggctccagatcgccttaatctgcatgtaagcatagttctcgccgacgcagctgttccttccaccgccgaaagatgtgtaagagaatttcccgccgaccttgtcctcctctcttctaggaccaaacctgtctggatcatacaggtgagcatccttgtagatgtaaggcacacggttgctgatcactatagggctagccatggtgtgccctgccgggacacagtattcatggccttctctcgtccggacggtgaactgcctgagggctgtcctgacgatcatcggcgccggagggtgcagccggagcgtctccttgatgcagatgtgcagcatgtgcatctccatcaggaaaccatagtgatctgtgacgattctgccattgatgatgccgtgttttctgacgatctgatcctgctcgtcgacggccgcggccaggaacttctcgtgggtgagcaggcgagcgccggtccagacgctggtatgggtgctcgtgtgcttcgcggcgaagagaacgccggtgatgaggccagcgacctccgcctctgtcgtggcgcgaccatcggccttgtacctggaacaatgttttaaatagtggtttaaggcatttagcagttagtttctcaaacagctatagcggcaactatagtaggctaaatggagctatagcggctaatttgtacttcctccatttcatattataagactttctagcattgcccatattcatatatatattaatgaatctagacatgacaatgctagaaagtcttataatataaaccggagggagtacatgagagcaaatagatagaacccttctcaaacagctatagcgagagatagtggtagttatagagggagatttaaaaccctgacctggaatcgataaagctctggagcacgtccttgtcattgacctcctcctgatctccctgctgctgcttgcgggatctcacgatgtcggagaagatggcgtggagtctctcgcgcgccatgtcgcggcggcggttggaagggatgagtggggtgtaggggaagaagacgctcatcaggttcacgccaccctcgatatcgcggaacaggttgcagacctcgtcgaacttcgtccccatcacctccttgccgaggaggcatcggcctgagatcaacagtagtagttgctccagttcatgtttcagatcgaccgtgccgtgttgcccccatttcgcaaagtagtcctgcagaacatgtaggtgatgccaaattgtaagttactgaagcttgtaatgactgggtgccgtatgtacaaatcttgatctaattaatcatctcaaaagtgtcatccaactgtagtcaggtttcccaaactgtcggggtcggagttaccgcgcataaaaaaaatcacttaagacctatttggcagaactctccaactccgcattataattaaagtgatcatgtgtaagctaatcttcagatcttataaaattagaaacttacacctccaactaactcacaagtaagtgtcgttctagaatccgtgcaactaacccaacctgactttgaccaactttggaatataatagattttgggcatacgaaagtaacacaatagatcagatttatcttaaatttggaggcaaacataatcataacacttgctaattacaattacactgttgcttacctcaacctcttgaaccatgggatcaacatggatcctcaacctgaccggcttcagtgcctcagcaaagaatcgaccctgctcgatccgggtggcgttgtctacgccatggccgacctctttgccgaacataggcaccgtgaactcgaacaggtcgccatggctgacctccgattccaacccttggaagaaatgagccgagacctccggtccgaccaagaacgtcgccttcagcaatccggccacgcttacggtgaacacgctgccaaacttcgcgtacagctgctgcatcgtggctggcacatcgcctctgaagagagcaggcaggagccctaggagagcgatgcaattcacaacgggtggaggaggtggcgttttgcaggtaagatcagaggattcagataggcatcttcttcttcctcctcctaatgcaatcttggtgagagctgcagtgatggcaagaatggccatggcaagccacatggcactgctactagttaactccatgtttgttgtagcctgaaggtaaaacatggagacaattaagtagcctggaaatgcgacaagaagatgaaaatgactctgaactctcatcttggatttaagtgtagtttccaaccaattgtgcatgtgcgatgatgggaagcttagtaagcaggcccaagaaagagagagagagagagcatcaattggctcttttcgcagaagaaaatgagaatctaatccatatgacaaatttctgttcatcttgtaaataattcatgggataaaaaccatgctgcattcaaatcgaaaactaggtgtaatctgaccaaaatccacggcttaatggatgcagaatgatgaacactccagtataaagttcgacagctaataaccaaagaatcgggtcatctaattagcgaaattgagaacagagcatacctgaactgaatacaaagctattcttcaacctggcagaactgtggtcttcatgtaagctagcagaaatagcctcctctgaactatataatctgcagtgatggaaacagcaccttcaggaagcatctaatcaaagatgaagtgaattgtcaatctcttgtaatagcctactagtataagtattagcttgcgtgacacatgcccacataaataatacaggctgctaacctgctactgtgtagtacattgtatgattgactattgatcaatttagaattgggaaatcatgttttgtttatggttatgaaacttctggaaaaatttgataacgtagataattatgtgagatatcactacactaacatacaagtttaaatttgacctcaacaagttgaaaaaaaaatcaaatctgactgaatagtacttatactactcagggtgtaatttgttttcttatcaaatttgaagttgattttttgcaagatgatagataaataatgtaccaatattgtcccttttttaaagattttttataactatttaaatagtatttgagataacaaacaagagagtagacatacgcttaggtgaaaaaacagaaccagttccatttagagttagctagtcgccgaaggataatcaaaatatatatgtccaactgattgaattagaaaatatgccaatatggacaatttaggtgggtatagcctcgctgctcatgtcacaaatatgtcgtttgctattttttcggtcttcggggatgtaactctgacgaccatactttttatatacaataagtttatgaggttacgaaagtaattcaagacaagaatatgcataccaattttaagttttcaaattaagtattttagaattcttttatggttggagtttcaaaagttgcatagaaatcaacaacatatttgatatatatgtaatgcgcatatttgatcattaccgtggaaaatatgggtaccgggtattcacacggccttcatgttcgactagatataggaggtatgtcagatccatgtactatgtaatagaagagtatatgtaatagaagagtatgacttgatcgtaatgttgccttgtgttatatgacaggacctataatatcgatcgagtattatcatgtgatagattggaaaactgatgtcaagtccgattaggttttcctctttgtaatcctgccccccaacctatataagattggcaggaagccctccaaagacaaatggcgagataagtcacgattagatcatcagatcaatacaattcccgtggatacaatccccaaacagaattagggtcttattaccttcgtttcaggttataaaactttctagcattatccatattcacatagtgtctagatctatatatatatatatatatatatatatatatatatatatatatatatatgcgcaatgttagaaagtcttatgtccgattaggtttttctctttgtaatcctgcatccgtctaatttcggtcttgtgcgctacatttttctcttaccgattttcagaattgacaattgtctttttctaatcatatacaggcagcgtttgcaaccgtgctgcaaaacaaggtctccaactataacctgctggctgccttgggtgtagccgtgcaggtgtgcaccacattggaaatggtcgtataaaagccaccacctcctataatattcttgcgtgattgattagtgtgcggtagatgcggaaaatacggaaaccagatcgagacgccaagaagtcaacgtgtcctgctaatggattagttatggtcactattactttttgacaaaattttgtgaaactatatcaaactattacaaaagtacatattcattataatatactcctatcatgtcttatgactacacacaacatgtcttatgaaaaagtatggtactcctagcagtgataaatatttgtcattctattctaatcaaaacaaatatttgatgttctagacaatatttgatacaattttgggaatttgattattaatttctgtatatttagaataaatgtataaattacaattttataaaatctaataactttaagatggtatgatagtgcttttcatggaaaaagttatatatagcatttcaagtaagtatttgagaattattgatgatcaaagttttaaaagtttttatcaccttttacgcgtccctaacacacgctaggaatgaaattggaggcactagacctcagtgcacgggaaacgtgcaatcccactgaacgcgcacgcgtgtgtgtaccctattacctagccaggaccaaccgaagtcagtcccggggaaagaggggaaaatccccccgggcgagcacgagtgtcgaacctggggtttgaacgctcgcgggctgcgtgcccaccagcgacgcttgccacctgagcaagcgctcggtctctgaacatcaaatatttattgtctgccgcagatgccattcgatgctaaggagaaggtcgagttcaaatcaccgcaaatctggggccagggctatcaacgctacaaacgccgacatcggcgatgcttgtcgacgccatacaccttcctagatgcgatgtcactgacgcctcatccctctccttcgtgccttgggatagtctccgggtcaaaacctggtacggatgtttggagtattgatgacgatattgtagatgtgatcttcttaggccatcccaaccctccatgtcatatagtttccatagcactaaatacattgacacataaaaaaaaattctatgtggcaagagagttaatgatgagagaggtaaaaagatgaagaaacaatttctcatgcaagaaaccatttctacacaagaaccaagaataaaattaaggggataggtggataaaaggagagagaagagaggggattggatgagaatttaatttgaagacaccatccattaaaaacatagtttctacacatgatatctatatgaaatgacaagtatggaaactactagatgagttggggatggccttaaagacgtgtcgtattggaagttccgtaatggtgggtatctttagcgttggatcagctctgattgtaatggtggcgtctaagatctggacgtatgagtgaatttagagattacagttcagttaccttctgacgttatcttctgctttgattttacgtcacatacacatggtgatgcttcaattgatggagatggaaaatcgaattatcgatctcgacctgacataacatacattggtcgtcctgtaaggcatgtttcttttagtttgggattattataatccagattattgggagtaagctgaaagaaacagacaacttattgaagtagcttattataatctgtagcccaacttattataatctgataagcttatttaggtgagctttttctagattattgggtgaaaaattacccaccatgccaccccactccctatttagacttgcaaacccaataatctaggctctaataatctaggaaagaaataactaaccgcgaaagaaacaactaaccgcttattctactacagattataacaatctagtttatagtaatctgactcaataatcttatattataataatccaagttgaaagaaacagggctaatccgatttttgatggagattatgcttgtgggcgcgcatggtggcccacaaactgggccctgctccttattgtggcctttgtgggtacgaattcggcggcccaaaaacctctgtgggctaaggcctacccaaacccgtacttgtgcggcccaggttgggtctacgggtccacatggaccgtcggatcataacatctcgtgatgcggatcgagctataattttacggaagagcccctgctttaacctgtatttaccgtttaagcccctccccatactaatcacggcaaaaaccccttgccgccgtcgacgccttcccgccgccgcccgacctcgccgtcgccgccgatctcgccggccacctaggtggtcatgtaactgattccgcgctctatcttcctcgcctgtctccgcaggtatgctacacgggcgcaaatgcgtgagccggctggccgctggcggcgtggtggaggcatcgccggcggccaccgtggagaggccagcctcgtacctccgccagctagcagtgttccagaccagcaggtttatctctcgttttaagcctcctcattagccttcacttcttcatcggttttcccacatctctgatttaggagtagcttttgtaggtttgctccttgcagtcctctccctgaacatattctgaatgtttactcttgagttttttttggataatgaaaatggattatatctctggtctctattgtaagacaggtagccataactttgttaaagaaaaaggtaaaaataaaaatggatgaaaatagaacataagatatgggatatttattattgattagcgttaaaccatgtagattttttagctagcaattctaatagaattacagcacccatagtggaatacaagaccattggttaccaattccaagagtttactcttaaattctgaagtaacagataggtatattcatgtgcaggagaaattatcagtatctgaactgcaacagtatgctaagttgctaacatgtttggttttgtttatggaatgggacaaaatctttgcacatgccaattctacaccaagggtaaaacaggatagcatatctcacagggatacaattactacatgaaaatgagaatgcaatattattgaaacactctcttgtaactcagagttcagttacattggccccagccttttcctttgactgcttctgcttacagcggttaaatgggtgtctgaaatgattttcagtccaatatgaataataataataataatatttatctgctttggatatcctactgctttatacaggagcttggctctgctggcgcggaacgtccataaccagttaccggtccagcagcgatccctctatgattcagcaagcacctgaagcgtgccagtcttgcgctgagcgctgctatttcccactcctttgaaagcttctcaaacggagtccacaaccgctcttcaaattaacaagtgagttttggtgagataagaaaaacttttctgttattttgggataaaagtttacgaattctagctaatcgagtatataagagtgagaagtcatgtatctgattatacctgcagctgctgcagcacgtggccaaatggtttgctgaatgtcagacgcatctatgtgttcagcccacatgcatacctcaccaccaagaaccaacttctgctgtgccgggttcttgatatttctcagtggttcattcatataaaatccatcccatgtaacttccaagtgatctaggtaccacttatcctggttgctcacaatgcatctcaaaccagcagcaacaactttttctgcaactccacctccaagcctgttataatttgtggtgaaaaatactagctgttaatttccaatagctgcacaaacagatgatttctggctgggtcctcctaattaggagaagaaactgcactatataatggtattgaaacttttcttgcaatcctttcaccttttcttaataaaggtttgcaatcccattacttcaataaatttccttgtttaaacaacattcctctagttttatattacttgttggacattgcaaaatacagatactaccataagttgttctctatgaatgggcatttactgacgtgtaaacaaactatgcaaactaatttgttcaaagagaaatttagtgccatcacaatgatgtataaattgacaaataccatccaatgtaagcataacatatggtcgcaggaccaatattagaaatatctaatgacatattccagcttggtgatctttgccttcttcaaatgagaatgtgctatatttgagatttggcaaatgtggtcattgtttcttataataggcatgacaatataatttggcaagagcatacaactttgttttattttcttttcctaacaaggatgctgataattttttatataatgacaatcaagaggcagttaggaaataccagttatgcaccacagttctgcggtctagtttgtctccaaagttgttaaaggtttcttccctacaaggacaagaaagtgtatcaatagctatttgaaagatctagatctgcaaaaccaagtcacataccagttaataacttcgtagccatgtgattttgctatcttttgagctctcaatacaaaatatctgtaggcatcagattctttcataccatgttgggccaacctgcacaccaggaaaaatacttcagattagatcaaatgactgatcatccctgctacagaaggacctggtgatggtggtgagtcggccatcaccaacacatctacaattggtgggatcttctgcaggtagaaaaatagatgataatgcatatgtcatggttatttatgggttgatgcttggttgcaaaatgttttggcctcagaaacatatataattttcatgtttagttcttatttttttaatctgttccaaggctcgggtattttgctacaataaagagaaaatattgtcaataagtgcatatcaagtatgctggtgctcttattctttatactagttctagataagagcataccatgctttaacgcgtgggggggaagtccagcaacctgaaattcatagtgagtaattattagattactaaactactatatgatatgagatctgctgctctgcaggggagatacttttgcagacttacttgtattgacctcatcacctcccaaatggacaaacttgaacttaaaaaccttgctgaaatctgaaagagcatcaaaagttattagtgaatattatacaagatcatcaatttgtttttcacaatatattcattattcggttcgttgaactgcttttttttttccttttgttggtaagtataagataaatggctgtttttttctctttcaaagtaataaaagtaccactcaaaatataacgtgatttctgttggtaaaccgtgaattacctgaaagaattccattaatcacttggaatgtagattcgctgctgacatcaagtggttctttacaagtagctgatggccacaacgacggataaccaacacccctaaaacaaaaagaaatgcgcaatttatttgcaaccttttgatattcctactgtcatatctagttaaataacttcatccgtaaggcactgtgctttctggatttaaaaggtataccatgagtacaacaaaaacaaaggattcaggttttcatcagtaaaacctgaatagtcatggagcatatgctagagaagaacagcattggcatattaaatacttaccatgagagagcatggccaggaacatcaatctcagctaagacattgacacctcgtcgttcagcatacctgcagattattgataagttatcttaccttggttaaatccaacagcatagctaactgatctctaaattgatcacatcattctccaaagaaggaatgggttttagagttttgttttttattttctgctgagttccctttgcaatatttatataaattacttaacgtggttttactgcatgctcttagctcctgttacttcatagtgaaggtaaataaattcttatgtccagccataaccttagagtgatatttgctaaattctgctctttcacatgaaaaatgaaagacagaaaaactcactgaacaatgtcgatagcatcatccattgtatatctctctgagtaagagtatgcaccattccataattttgggtatgaaggtatttctataggaaatgactgttcatccacgatatgccaatgaagaacattctgcatgatgatagagtaagcagattatatgatgcaactaaaactaaaggaatatctggagaaggaccattgcaatggagagaattatcaatcaagattgaagaactggtttcttgtgaaaagatcaaacctaccaacttgctgtaggtcatcgaatcgattacgctttttattactgggacaggaaaggtaatgccttgaagtatctgtaggatgccagtgcattgagttgaaaaaagatcaggtattatctttcctcaaactatttgaggacaatagtagatgtatcagataaatcctttaaaagaaagagatatcagacgctatttttacatgcacaatatttactgattcttcatataagcctagtatggaacatgtggagtaagtatgagcatccatcttagaattattcatgatggtggttaacaacaccaaaaaagaaaaaagacttgtgaacaaatggaaaagagattatgaagaaatggaatatattttggttcaaaacttctgatagctgtaagggtttatattaatggaacaatagggatggtccctgctagaagttctgaaaaaaaggacaattcacggcaatatgtacaagagcaaatacaagataaaggagttcaacggaggaaggttacaaggtactatttctcccatggatcaatgctagctttcatttctagtttcaggcttatgatatggtcagtagattgtgagtatgttacttttacaattttacttatgggggtgagcaacattaactatctggatgctactgttacagtcaagtatatttattacaataccctaaaggccttgatacaactgttgttgacaaaaccaatccaatatttagaatatatctcaccaataagaagccctcgataaggaaatctgggcatgtccgtgatgctccaaggggcagactgaagttcaattaaccttgaggtgaaatcaaagttacacaattggctaaacgtctgcaacgatagaaggtacactgttagattgtctgaaagtgatcgtgttgtcttttttatctatgatcatccagatgcattgagtggataaaccatgccaagttaccttcaaggcatgaagtgctccaaaaactgtttgggcctgcaataaagacatagtgaggtgacagcaaaaaaaaaaaagtgtcacaattcctagaactaagccacacgatttcattattttccgtgaattctcaaaggaagaatgtctgcagttaaagtgtcggcatctgatgtcatattctgccaacctttcatgttgacagcacagttagcagagcatatattttttttatcactaacctcaatttgagcataaattggacttccagttgcaggcactgacaaattgtataattcatccacccagaagttgagctgcagaggacaaaatcaaccaaatacaggtcacaagaaggtaagaaaaaaggagaacacccaaagttcacaaggctttacctcatcgccgggcaaatgcacgacgacattcacaccggcgagcagcggcaagccctgggagctgccattgatgacgtggtccagctctatcagcgtcaccatcctctggaacgcgtccttcaggatggcctccccgtcggcgtacttgctcccctccgccgtcatcctgagctccctgctgacgtgcagcgtctgcccgcctttgctcgccgtcgccggcattggccacacctcgacgacgctcccctcatcggcggcgacggcgcaggacaccaccgccgccaccgccaccaccaccagcaacctcagagccatcgctggcgccatcctatccctgcaagaaacccggcaagtacggcttcacacctactatatgtagcagaatctgcaagaaacgcatggagaattttaagagattatattaactgcgacgaggatctcgcacctacttgaatgcagcttcaaaaaccgtcgccgtcagtaacgccggcgaccagaccacgccggagcaagaagatgaagagaaacgccgttgccgattgatccggggatgtgccgaagtggaagagcttaataatgtgcacgccagcgactaggtgggtgcaagaaaaggccgcaacttttagcgcccttttgcctctgccttcccgccttttgcaagaaaaacaacaagaagaagatgatagtgcatcctgctcctgctgctgctgctgctgctgcctttatgaattgtgccaaactatggagtgcacaggtggatagcagtggcagtagagaacatcagtaacaatggtggctaatgcagccacaacacaagcatgtgatgtgatggtgtggtattagtgtagggagagatctgtgcttggatgtggaggaagggtactctctccgtcctaaaatataagatttttatttatgaatgtccagattcataactaaaaattgctatattttgggacggggtagtagttaattaggttggtaggatagggtaggggagagaaatgtggatgttttggatgagtgatgatattgttaacaatggagtcttttttgctgaaatgatcagaggagaagaactaagggaatggaagggagtgtgcctagctgccattatcaggtaggtaaaagtagtttactgacaaatgccgagcgttggagtatcacttaagattgtgtcttgtgtagttgtgtgcttaaagcatcgagcttccgtctctttgaacgtgtgttaaaatagcgtaccagtagattacatgtgtgtaggtagtgtacgtgggtgatgtgtaagtgcatgtctcattaggaaaaatgataaaaatagattatagggacagagaaaaaatgataacaatgaatgttgctggatttgtttttccttttttttcaggattttggttggcaggagctctatttacggtgtgcagcagtaacagaagggggagcatctgttggcgtaattggtttggtagatcacatgtacatgtccttttctccctgtccagtgcatgactactgacacgtgatggtccttgatctcgtgactcgctgggtctcgtggtctgcctcggattatgcttactccattctggtttagtccctggatcccatagaaaaccaaccaaataccgaataccgaatatgatatattctattgttacgaatctggatatatatctgtctagatttgttgtcttagaatatatcatacccaattctatattcactttttttaaaggacagaaggaatacctaactcttaataaataataaaaccagaccaatctttttccatgtgccagtgagagaatgtttcatggcagggatgggagactgatcttctatttgcttaggatgatcatccgcatgtgtaatctgcagacctgcagaaaacaaattcattaataatcaggcagggggtgcaacctgcatttgagtgaccatcctaaactggaaggttgatcttgctgtaaccagcatgttaggcactactgaactcataattaaggactactgttcgagagtagttttcacatctcgtgctagattagttccgcaggagattctaccagatttctcctaccgtcggttgccatgatgaccgggcttacttatggtacaataaaagctcaataacaatttcaaataaaaaagttaaatatttaaatatttttttaccgtgttaactggaattaccatcgggggtgctgtaaccctttcgatgtacagtaattaaaaccctggggctttgcgcgatcccgaagagcaacaatcagttgcctttccgtaacgctgctggaatctccggttttggtcagtacagagcttagcctgtccagttaatgttgcgtgcgactgcgtgcggtgcggccatgtgcagctgcggctcgtcgtaatcaagtccatcaggaccattagatcttatccgttcttattttagagaaagagagagagcttgggctactgatccaggctatatatgattagggcatggctaactcagggtaccctctcaagtaccatgtaggatgggacaatactcccagaaagctaatttcttatagtgctagttactttaagtggtagtcttacatttttatttcagcttctagtgtttttccatttagtcctcataatttttcaatttatatagaagttcaaattttacactaaacacctcaaaatctagaaattaatataaaatctctcctccaccctcttcttcctagttcccattgaaacccaatccccctccccacatctcttccacttcacgcctctccagcttgagttctcctcccactggctctcctcttctctcccctccccggcggagtggaccgacgcggcggtggcagatccaagcggtggcggcagccgggatcgacgcggcccttctctccagtccactccctctccacattcttcccgacgtggggtgccggcttggggtgaggcatctctccaacacggctcctcgcccgttcctcggccaaaagctgacgaaactatgcggctctctgctggggtcgcggctctatgtcggggtgcggtcctggccgagctgttaggaacccaattcctccaattcaatagcaaagatccaccatacaagcaaccattgttttggggtgaaaaagaaaagaaaaactagggaatacaagttctagaagcttctaaaactaggagaggtagctagaggtatgaagagaggtagaggagagagatcgccaaggttccagcccggaaccaggacgccgccgccgcccgtggccgaagccgccgatgtctgtgttctgttcgatgccttccaacaatgctgctgctgcttttgtatgctgccccttctgcttgcttgggcctcgcttggacttggctagcttggcccatatacagcccaattacgttccgttcagctggacaatgccgacaggccctacacgttagtgcaccgcgtgtaggcgctgctcggcgagcaccaaggcaccaaagcattatgtatcgttgagagttgtgttcacatcaaatacattatatatgcactactttcccagcccatgtttcagtagtttgatgtctctaattcaattgacatttcttgagacaaaataaaattggaggagacacatgatatatagtgtgatggaatgtgtatgtctaaatttatgtagtacatcagccactaataaggttttttttaaaaaaaattgtgtatgtttttttttctgcctgataagaaaaaaatattaccccatttttactaccattaagcattactagcttttatcacgacacaattcttcgattactccataccggtatagcctctctcttaaaggtgcgttggctcatttacatggcctctttggatcgagattttcttttggggtgtatttttgtgaataatgttacgatagcagcatcagcatgcgcagaacgtcatgggaaatgctgctattgtcaactatttggacagcccatgcaatatatatactattatgaaatatactattatgaaagacactggtgattgtggttttgccaacttttatactttttgcaaattagttcctgatgtttcttgatattatataatagtataatgtttgtttgaatcaagtgaatattatgtattcaaataagcaaacaagttcatgatatattattaatattttcttttactcgtagc

SEQ ID NO: 34984 - DNA, 3163 bp, Oryza sativa
aaagtgtgggcatttgctagtttgtgggtaataatgcttataaaagaaaaaaaatcagtgtgcaatgaaaatgctcctttggtttttaatagttaacattggacatatgcttaatcattcatcttattaaaaaatataatatgtaattatgatttattttatcattcaagttatttaaagtatgacttaattttttttatatttgcatagattatttttagtaagaggaatgtacgtaaaaaagctaacggcatcatatattgaaaatctgttaaccgaagagattgaaccttcgaaatggttataagaaatgttgatgtcttaaaacatttatcttgagattatttatttatgcactaaaaatactcacacagtacaacaaaaacctcatatagagacactttatagaggcacttcaaaaattgcctagaaaacttttactctggagacattttcagctcagtttattagattctattttgtagaggcattctttcggcactgtaaaatgcgcctgatatgtaaaggcattttcttgggatatttcaaactatgtagagacactttttggatgataatgtgtactaaatgaataaatataagcaactaagggcacaaacatacaagtaattaatgacatggatttgagttggttagtgcattgaagataaaaatgattcgtccaagagaccatgagttcaatgcatgacaaaacgcaaaggaactattttattcttattttttggactggtttcatatgtttgtggtacaatttaatgtttctagaaaatgcctctaccatcttataggcattttataaaatatctcttcgtttgtagagacaattcaccataagacacctattagatattttttaaaatacctctacagtattgtaaaggcaattttcttgtagtgacaacactagtgtctgtagtcacctttgttctagtttttagcatttttgtcgttatggttaactcctccattatcaaggcattttgtgaagaccattcatcatggcataatagattatcataaggtttttctttagatgaaaatcgcatggaaaataggttgtggtggcgccagggtactatgaggcttgtccatcgagggatgcttcttttgtgtgatatctttacatgtcggtctagagagtcgccttgtcaacatatggcagatgcagctggtgctgcgcggtgctaggacattatctgtgccgctttgcacttcttttcctacttgcccctacacgtggtagagaatacggtttgaactttttttcacgacttcctcaaataatccaataagacatggcatgaccaccaagtataccaaacaatatctaaaacaaagcatcaaatgcaatgatgcaaaactttacatatcacctctatctgttacataccacttgtacaactaagacgcacaccaaaaagagagaaattgatgagataatgagtcagtcctcttgtcgatactccgccggtatgtggggtccaggcaaagatgagtcaggtggggcccaactcgatgtcgcacgtgcacttcctttttcaccaaccccaccgagaagttgctataaaaggaccaacaatctttgcacactatcctccacaagagaaactaggatcttcaagtatagctagcattgcgccctcatttcatccatggcaatgcagctgtccttgcctgtcttgccaacgggttttcgtttccatccaaccgatgaggaactagtcatcaactacctccagaggcgtgctaccgggctatcgtgccccatccccataatcgcagatgtcgaaatatacaacttcaacccgtgggagcttccatgtaagccatatgtgtagtctagtgtgcattaatatttatgcttgattatagaatggatgaacttaccaactactatacacaatgtgttaatgatattggtgttgcagccatggctctatttggggaacatgagtggtacttttttacactacgcgaccacaggtaccccaatagtgtgcgccctagtcgctcagcggcgtcaggcttttggaaggccaccggcactgacaagcccgtccaagttgctaacatgcaaagcactcctgtagctatgaagaaggcacttgtattctatgttggccgcccgcccatggaaaccaagactacatggatcatgcatgagtaccgtctcacaaacacgggagggtccactgcctcccacccatccttgtcttcatccaccgcacacccttctgtgaaggtacaaacaacacaaactatattgagaaattattttttttcttgagagaatggtccttcgtttttagtgtgtcgtctgtttagttatgaaattctttgacaaggtaatacatgacaaaattcgacttctgtaacttgtagaaaaaactaactacactcctccttgcaaaagaaaaaacagagtacatattccattcctagtcgatctcaatcgttagttcatcatatatgcaaggcttaatatctcccccttttttactgatcttaccaatagattaaccatgttatcatggatctatatgcgtatatatgcagctagacgagtgggtgctatgcaagatcttcaacaagtccccagagccggacaacaccgcaccaccatcaaacgtcgtctcacggttacagtgctcgccgccgctgccgccgccggcggcaccgcccggcaactacccgccgctgccggtgggtgcgacgaacgacggcggcgtgttcgccggcgccggcgacatgctcttcaccatccaagagcaccaggagggaacaccatcgatgctgccgccgatccctaaccttgagccaccggcggcaacaattgggaattcctctctcaatggcactgctgctgctgctgctgctgctgatggccatggccgccttgaggaagaggacaccagcgcctacaccttcaccgaccaggaaatggagcagatgctcatggacctgatggaccaggatttctttggcaatgatcaaccccaggagtgaactgtgtggtggagtgattttcatatcattccatagctctgatctgtgctggagagtgaatttagtatctattgtaccagatagaataaacccagaaaagaaataaaagaaggccaaagaaaaaagcaaaaagaaa

SEQ ID NO: 34985 - DNA, 9163 bp, Oryza sativa
aagcagggctttcttttgtagtttgccatctcaatcttgcaccgtgatgttataaaaaaacaaaattaattattgtgctacactgtacttttggctgtgttcggcagcaatctttcccaactcatcttcatcgtcttttgcacgcaccctttttaaacagctaaacagttacgaaagttgttttaaaaattatattaattcattttttaaaaagtatctaacacttaatgaagcgtgcgctaactatttacttcgttttacgtgcacgacagattagttccaaacctcacaatctgaacacagcctaaaacgtttcgggaagaacgcatgctagctgagcaaaggctctgtttgaaacttgccgccggcaaccttagctctataacttggccggtaggagggcgagccttttgggcctatttagcacagctagagttcagccaaacagtttcagctctatctaaaagggagcgaagttgggtggtgctctctcacaaaatgaactagagaggtggagctgggtttaggcaactctataactccactccagacccaactcctgaagcttatttagcacagctagagttcagccaaacagtttcaactctacctaaaagggagcggagctgggtggtgctctctcacaaaatgaactagagaggtggagctgggtttaggcagctctataactccactacagatccaactcctgaagctaaatttaagagttggggctctatctgttactcttaatttcctagacaatgatatgtttggggaggttgcagcggagcagcacttgtctctggcgaggagcccagttgcaacgaatgggccttaggttgggccttattatgggctgtatgggatcctccctcttgggcctagtttagatgggcctcaagatccacatctatggcctgaagaactttttgtcaaattatggcccatccatagaagctttaggaaatgtaattagttcattttaggttcctcatgttgacgtcaactttgaaattcatccctgaacctcaatttgctaaaccagtgtacatgagattccaaggcagtatagtgctcggttccgactaacgtggtggctgagtcagcgtgagatccacatgtcaaggcacttcaatctaatataaaaaaaaacaaaaaaggtggaccccacatattagtgacacattctccccttctccctctctttgtatgccagcccaaccactccccattttgccggccatgtcgttcctctcgacgttgttgtacgacctctctgccagcgctgagcccaccctcgacctgcactctcacccttcctcctccagtcctcctgatcccactcaccagttgacctaacagcaggcgggtcgaaggccatcaaggagttgcatcgacgtcaaaggcggaggagcggccgccagaggccatccaggagctgcattggcaccactgtacatgctagctttgctcatggcggtgaccatctcgtttccgctgctgctcctgctcaacatgacaggagtattgttcacgccgcgcactcctcctctagctccgtccgccttagccagcgctgaggatggagaaaacgccgactttttcttcttccccttcctgaccctctacaagagtgtccatgtcctgctgttcattgacacggacacagtgccgacgtcaatagacctggccaccgacattgcgtctggccttgttgtcctcctctgcttgcctaacctcgccaacctcatggtggggaagcacagcagcgactggtggtggtggtctaccatgcaagcacgttcgtcacggagtcagcaacctcgttgaccccctacttctggggggaagcggccggtgccaccgaagacgcgagacttggaggccggccacccttctccttgccgccagccgaatgcaggacaccacacgcggcctgccttcatgaggatgaggaagagaggggagatgggggaagaggaaagagttggtgctaacatgcggggcccacgtgggtcccatactaactcaacacatatgaccaaagttaagcaccacattggacaaaatcgggagccatactgccttgggataaaagttgatctacttttgcaagttcggggacggctatacctggtatcgtagtctaggggcgaatttcaaactccgcatcaagttaagggacctgaactaaacttattcataggaaatttccatctctactcagcctacaaaggtgttccctcttccaatatagtgagttagtgacttatcctattaataaccaaaaactaaccaacaatccgaaattctgaatcatgaaatgattacctatgcaattagttgtgctttaaatggtactccctccgtcccataatatagcaatctaggacgggacacttcatagtacaacgaatccagacatgcttcctgtactatgaaatgtattatgaaatgtcacgtccggtactaggttgctatattatgggacggatggagtaataaggagacatatacaagtataatcgtataaatggtttgtttatcctaaagtacttcataacaattactataaaacactcattccactcgtaaatatttgatgtttaggataagctttagctaaacttttaaaattttaaccaccattaacttttcaaatgcttaacaaaaaatgggattcgattttgacttcaaagtactatcataataacatattttcaaaaaagattttataaacttaattcaatataaactaatagccaaaattttaattttttttactaaatcccattctaaacgttaaaaaaaattatggctggaagaagtaacgaatcacatgttttttcttatctttttaggacgagctaagtgtgcttatccattaattagagggaataaagtacatggaactatcagaagtacaagggaaaaacaaaagagaaattaagcaaggaaagatacttcacggttgcaaagtacttgccaattgccaaaacatcattattatcagaaaattgtttatatagtccttatttgaaaaggaggtaatattttcacctcctctcctaacatcctaaccttttcttttcgcgtcaatttccagtaaggttaagccagcaaccaaaggcccagtgaacagcgaaattcattattaagtgagtgggttgccatgttagcattgttcccaaggttgtggccaagtatcttcatatgcctccttttctctacaagccttcagataacggagctgcctccttaggtgcaatatctgtcaatataaatagtagctctacttagaatagaaggtagtgtttttttttaatcatgagatatgcttggaagccccctactaagaatgaaagcttgatagaacgggaaaaagatatgtagataggtgtttccttgaattaactgaagtaatggatcttacggttcttttatgtgaaagtaaaactcagagctgtgaaataaaatattgggtcactatgcgggatgttgggtttatgtgtaaacattgatttagaagatgactatgtagaaaagcgttatatgattactagagacccttgtttatctatactacttcaaatgttagtagtggtggtgtccattcccgcatcacccctaccactaatatctgagcctcacagtctatactattacaccacctttcaacaagtcatcctccatttcactatttgctcatcccaaatttgaaaatcacctacttgtttaataagaaaaatcacagtaccacacaaaaattaattaagactaaataagtgcttattaattgatttaataagctagcaacttaatttgttttccgtggaaaaaacatattggtactttggtagagagcaaaggtaaacaatcaatgcaaggttctaggagtgagacagcacacctccagtttaagaggatcaggaagatcgtccgtagaaacaaggctctgaaattcagctttcaacttctcatcttcaatgcacaaccatgtgctaggatgtaacgacagtaatagaacagttagaatgtctgtgtttgatggataattgacagtttcattgctcagagttgaattgcagaagcatgtttcagtcgaggatatcggtgaaagcttatcaacatgtccattgccttcagataccactttgcctgtaatgacatttttaagcccctcatcattcacttgtgtacatccggaacaagtttcactgaaaaataatccatctcttgatgacagattcccacttagcaatgcggttgcttcacagcacacactggctgcaatctgggaaatggaatcttcgtccgttaaagacgagcaactacaacagggctgcttagaacattgcagtttgtggaccagctgaaaaagcttagtatcacggatttgctgtaggaccttttcctgcaagcgaacatacaacattaacttggtgaacagaggaaacaaaactgacccaaccaacagaaatggaaaattaaaatgaccttcaggaaaggcatttcgttagcctctttacttgggctggatcctccttcctcttgtctcctaacttcaatgacccatttgataaaatttccagcattgggaggaagatgattcactaaacgggaaagaattgttaggacattgtctacgctgttatccctcaaaagatttgggacaacttctatgcaatactttgccatgctttgccagctttcatccctgcaattctgcatagcattgaaaggaatgagaaaaaaatagatcaagggtgacacttgacacttacatatttgattcaccaagcattggcatgttaatttaccactgcacggatcaataaaggagcttcagtattccttgagataagcatgaacctaccaaatatgaagatgccgacatgttaaactcgccaactacaaactaatttgcccatttagtctaaactgacacatcattgcatagtttcaggacaaaacacgtaggtagcgtgatattaaggccaacatattgcatatctcaacttctcaagagccccaatgaccacgtttaagtgctagacggactgagcatacaccctacagcattgtccaaattttcttcattaacgctaaacggactgagcatacaccctacagcattgtccaaattttcttcattaacagtaataaactgataattgcagagcagtgtttcctgattcctgattcctgacagtcgatgaacactagataacccaaattaatacagtcgcttaatccaagagctgcattgttacaagacactaatcccaacgctgcatacaagaacctctaaaacacattagggccctttgaaacgtaggattttaaaaacacaggatttcgataggaacgagttttaacaaaaatgaaggattttgataggaatggattgaggaattccataggattctatagtgtcggatcctttatttcaaaggactatttagggaaaattcctacaggatttgagaaacacccaagggtcttccgactagctccacaaggtggtgggctagacgacctgggttcgaagcctcaccccttctaattatttgatattagttcattgcctaatattcgcgtctttttaattcctacaggatttgaaattctacaaagttctaatgtttttcgttcagatcaaggggggccttaatgtccacaagagacaggaagatatactagagaatatataccccctgagaagcccagttgcttcatcaatcgtgttcatggcttcccaaagaagcggcagcggaatccaatgaggagggtatttgaagcgagcgacatccaggatcagcgccatgtcctgcccagcatggtagccgccaatcggcgagaaatgccctgttccagtctgcatcgaatccaaacaaacatcattcgttcagaacgaacagcaaacagaaatcgtcgaatttcgagtttcgagagaggtgcggacgagcaggcagcaacctggccgagaagcttccggtggtaggaggcgactagatggcaatcctgggaggaggcgcagcgcagaaggtggcggcggaggtcggcgagcgtggcctgggcggcgcggaaggtcggacgtcggcgccggagcagtgggcgaggcaggcgaccttgccgaaggtgatcccctccgccctgaccgtgtcgaggtgctcgcagcagtcgagcatggactcgtcgaaccaccgccaggggcccttccaccgccgccccgggtcgatgcggagcgcgttgaggacgacggcgagcgtggcgaggccgcagaaggccggctccgactgcgtctggaagacggagacgaggctgaagaacccctgcatggtgcccccctggagcgcctccgcgaacagccgccgcccctccgccgacgcgaactccaccgccggcggcgacggcagggcgcgcccgtacagcgacggcaccgccgccgccgcctggttgctttccgctcggctgcttggtttagacgccattgcggcaaaagctttcgtctcgtctcgtgtcgtggattccgagtattcgacctcgagcaaagggaatgtgcatcgcattccctcggcaggtggtaataggctggatagggtagggcccaagaaccaaaaacccaagggctctcaactccgaagccggagaagtccaagttggatagtgcttattaaaacgaaaagaaaagtaaaatccatgttattataatattttttttcaacaaacacatccttttatttgaacgatagactccgagaagtcattagtcaccactcaccaggcggtttacatatcccaatgttccatattcgaggtgagggaatgatgagaaaattgatattgtcatattcataacgaggtttcgctggaatgccactctcaaatgtggcttcatcaaaataccatttttcaaacgaagctaacttgtcggaatgccatttcatccatttcttatcaatagatgattttttttccttgtttttgtcggtgatttgaccaaaatacccctatagattccatctcttcaattgcttttctgttcgtcagtggcaagccaccatcgccatttcttctccgttgctcctccccaagcctgcattctaacgccaacaccatgcccccttcctcaattcgctctaggggcgccactccctgcgcccgcactcacccaggaggtccaccccacgccatcaatgcattctccgacgctgaacccacctctaggagcaaccacggtcgcaccaatcacagccgcacgagcatatgtgccttctacccgagctcctccttagtgacgtcgctgtcatggacctccgcccccatcgcaccagtcacgcccgtgcgggcatatgtgccttctacccgagcttcttcttagtcgtctcgctgtcgtggacctccgcccccgtcgcaccggtcacgcccgtgcgagcatctcccgaacacgacgtctccagcacctctgctcttccccttcctcgtttcgctttgctcttctccccttcctgccatcattcgccatctccatcgccaacgaccctctttctcacacatgtgggtggataggccaaggcaaaaaggtcggtgtatgtgtcaaaacatttccaaatcatataaaatggacaaaatggcattccggcaagttggcttcgtttaaaaatggcattttaacgaaaccacattcgaaagtagcatttcagcgaaaccccaccctaaaaatggcataatatcaattttctcggaaggcagaggtgctagctcgaggcttggccgacttggccatggcagaggttgtccagccatggtgcacggtaacaaggcgttgtccagagctggcgtcacccacgcagtgccttcctccaaaaaattgattatttttcttttgtgtcgatgggctaaaactataatgttgcagggtcctataacaaattttatcaaaaaaaatgattaaagcaacttcacatatactatctccgtcccatattacttgtctttttgagtttttatttgtcaatatttaatcattcgtcttattcaaaaaattttagaattattatttattttgtttgtcatttgctttattgtcaaaagtactttacatatgacttattttttttatatttgcactagtttttcaaataaaacgaatggtcaaacgttgtaaataaaaaaaatcaaaaacgtcacctattatgagacggagggagtatataactatggatatggcatataaacacaaacaatatatgatatttataaagaaagcatcatattgttcgtgtcgtatcataaatcacatggcacagaatttattcggatacaaatgcaggatgattaagaaggccacatctctatagattctgctactcccttcgtcccatcccataatataagagattttgagtttttcttgcaacgtttgaccactcgttttattcaaatttttttgaaattattatttattttatttgtgacttactttattatctacagtactttaagcacaactttttattttttatatttgcaaaaaaaatttgaataagatgagtggtcaaacgttgcaaacaaaaactcaaaatcccttatattgtgggacggagggagtacgagatactccattaaggttgtgtttagttcagcgcaaagtttggattttggttgaaattggagatgatgtgactgaaaagttgtgtgtgtatgacaggttgatgtgatgggaaaggactgaagtttggatccaaaatttggatccaaactttggatctaaacacagcctaaaacatcatctgtctttcgctgctactctaccacaggttctattgcgcttgttttttttattctggattctggatctttatttccacacttttcaagctaataaacagcgcatttcgaaaaaaatattttttttcttcaaatacattttaaaacaactttacaactatatactagttgatttattcatcaatgcattaacttttgtaggataaaaagatgtatggaaactttggacattattttgcacttaaataggtcaaagctcctcgaaaaagaaaaaaaatgtcgagacacacctgaacggctagaatttgtggttggtttgcaaaaataggtgcactagagttcatcgtattcggaaaggaataatgaa

SEQ ID NO: 34986 - DNA, 18769 bp, Oryza sativa
cggaaccctaacggcgatggtattttttgaacaaaattgtttgtgcgatggtatttcttggaacccacacttgtcgatggcatttctgggacttggacgcttgtcaatggtatttcttggattatctcaatttttaatcataagaaactagggcatagacttcttctagttttcaagaatacctaataactatttttctttgcgggaaaaacaggaaaatatattattcataaggcaaaatttgctataggataccgaaagattgtggcatttgccgtgagacacttgaaaatcgtgtatttgctcatggatactgaaaaaagtggtaattagctgctggacacttctcccattattttattatttccggtcaaaatagagaaataaactatggttaaagacaagtttgcccatgggttcacttgtcaatctttctctctgtttttcttcttcctttctttgtctgtccatctctttctcattgcgccgccgctgagctccgccatggccgagccatcgtgcgtcgtcaccgtcggcggtgaaccccgggtttagtgtcgaccaaaccgagcatcgtgctcctgctgcaccgcctcctcgccgtcgacgatgggagcagatcatcacgtgctctagatcatcacgtgctctagcctgagaagcttcggcgagctgctcacgcgagagctgaacacacggctgcaattgagccccgacacgtccgtgctgtcgtcatcgccacttcactccctagcagcagtaacggccgcacacccggcatcgacgtcgacgctcaactactacgcgacgttgttcgacggcctgcagcggagcacgacggagcacgacggcgccggcggagcgcgtgctgctcgggatggagatccgcagcgtggtggcatgcgagggggcggagcgggtggagcggcatgagtgggcgtgacagtggtcagcgcggatgaaggcagccgggctggagcgggtggggctgtgctacggcggcgccatggaggcgaggaagctttgccgaccaaactttgccgacctcatccgtgctctggaatgccgccgtgcgtcattgccgtcagcggcccccgggatgcgccgccaccggcgccggcaccgccccgccgtggccgagccatcccggctcaggccggccgccgtcgcgaggaagaatggggaaaagaaaagaagagagagaggaagaacagttcgtgtccaagggtattttggtacttacacagctctttctctctccattttgaccgaaaataataaaataataggatgagtgtccaacagctaattaccacttttttcagtatccacgagcaaatacatgattttgggtgtctcacagcaaagaccacaatctttcagtgttctgtagcaaattttgcctattcataaggagagtccacatcaagaagatgtgaaatgagattgcagctgttatcaggccagaaaggttaaggccttacatctgcccttgtttggaagaaaatgactaacgctattttgatataaattagaagtttggttgaaattgaaacgatgtgacggaaaagttggaagtttgtatgtgtaggaaaattttgatgtgatggaaaagttgaaagtttgaagaaaaattttggaactaaactcggccatcgatgaactttcatgactttgatctccctgttacttgacacgaggtcacacacctccttgactatgtaaaatcaaatatgtttttaattatattctgtgatgaacaatatgcattggagattattggttttgatatttggaatttatttgtgaagtggttttggagatgattggatttcacaggtgatctacaggtactgctgattgggtccggtcagaccgggcacgggttgccggtcagaccggcggtgatcgagcgaccagaccggccagctcgcggtttgaccggccgacgctgtgtcggtttcggtttcgggttgtttgtttgggtatccatgattgtttcatgattatggcttctagatggatactatgcgtatgtaatactgttgtttgctactaatgaattaagttggggatagcttggtctcggaatatggtttctttgtttgttctatgtgtaggtgactcgagatgccgggagagtatttgcggtgatggaccgggagtcggcttggggataagacgacgtttgtggtggtcagagatcatgcgggatactaaggctagagtccaatgcatgtggttggtgaagattccatatggcatacgatggaggtattgtgtatgaatgggatgcggagtcgaatttggaaggagtcaaaatttggtatgattggttatgtaaagtttgtttcttgtactatatggtttcctatgaggattaggacttctagtatgagattggttcgtggctttaggctgcctaccttgggtataaataaagagggagcgtgagactttccggcatcgcttttgagagcaatagagttgatagttgagttagggtttcgagtttagtcgagatttttgtaaggagtgctgttgatgtactttgtaaacacatagagaatcaataaagtcgtcatccattttaagagttcttcgatttgtgtttcaccgggtttcggcggtcaaatcggcgggtgacccgcggttagaccggcggcggcaacagagagtggcaggcgatctcggtggttcgaccggagttcgatctcggtcagatcgacgttcatcaggcggtcaaaccggcgcatacacttcggtcagaccgcgatccgttaaatttgagggtaacttttatttccgctaaatgttttggtttttgggcataccaaccattcaccccccccccctctggttggcttagttctgatgtttcgatcctacagactagaaaggctaataactatttaatgtgctatgcggatgaaaatatatgaaatataatagctacacaaagttttttcccaatatagcttcactttgggccatgttttattatcgatgtttcgctttgtaccaccctttaaccaatgttttcatcatacataatcttgttttggtttcactttggatcatccgactctcttctcaagtatatgaatgacctcgagtataccagctgctattcgtgaataaactggccgctattcgtcaataacttccttagctgtatgtagaccgcttctttgacatatgataaattgtatgtagatgaataaaagagttgacggtgatttaaaatgccacataggtaaaattacccggcccaaagtgaaaatattagttgaaggctgatccaaaacgaaacatcgacaataaaatgtgtcctagagtgaaatttactctatattacttagtttaattttttaaatgtgttaagaataaaattagccagaagtctatacttaatgccaagtttggatttattttttatgtacaataaacaatttgtcgcaaactttatgttcagagatgttaaactaaatttacacaatttgcgccatcttctctattgtatcggtcccaacttttccaccgtctccgttactacatgaccctcttatcttactcttatttttcattagtgtgcttgctttgaaaggatatgtgtttatgagttttaaattttgaattaaaccaatacctccacaaattattatgaaattgtcctaaatttagctattttaccatgcaaattttgaagtgttagtataatatatacaatttgttgtacccaatattaatttactcgtagggtcttgataaaaagtacaatacaatactatttttatggattgtttttcatattataccataattgggtggggcgtgtacagtagcaagcatggtcagtgctcagcggaaagccatgacgatggtttcaaccatccaagggggtccgttccgttcgtccccgccacggtcacgtcatgtgtgaaatcagccgaaccattccgagggcccagtggtcgttcaacgcttcccacttgcccccataaatctgtttgactagaaaataagcgctccgtttggtgcgttttatttataacctgtgtatttttggatatatttatattgtacatttaactctatttttttttatgtttgtgtttaaatctacatttgatcgttaattttgtttaaaaaatatatggttatcatttgttttgttttgattaatattgtgactaatattattttgaatatgactatattattacatatttgtataaaaatcttaaataagatgaatggtcagacatatatttaaatatcaacgttatctaactaaatgaataaaataattagtttaggctaatcatgttgatgacaatttattgtactttcaataactttattaaaattgatggtttcaaaagtaatactacaaaataagcatatttttattgcttatatatatatatatatatattaaagagagaatttagtgtatatgagttcgaaagacgactgcgtttgcgttcgttctggttccagctacccgcctcgtttttcgcgcgcacgcttattaaactgctaaaagatgtgtttttataaaaagtttttgtacgaaagtttcttaaaaaaatcatatttatctatttttgaaaaaataatagctaatactaggtcccgttcttttctccaataagagttagatgaagattaagattttcgtggcacggttttcaaattgctaaatgatacgtttcatgcgaaaactttctatataaaagttactctaaaatatcatattaatctaattttcaagtttgtaataattaaaacacaatctagtatcacctcgttttacgtaaaaaacttaatattcatcttcaggagaaaagaacaccaccttaattaatcatgtgctaatggatcgctccgttttctgtgcacactgttctagatagaacctccagcaacaaacagatcgttaagtggctaaaaagagtgctaactcagtgcgatggatcctgcatgcattccacgtttcattacgtactctctttctatcgttatcctctctacccaagtcaccaactcaccaccattgctctctacatcgcctctcgtttgagaagacaacttccacactcccagccatagcggcatacacggatgcatctagcgcagccaccgcagcaccgttacggcgctccctcatctcgatcgcccgacggagagctggaccgaggaggtgaccgtcgccggcgcatccccggcttccccgcacgagtgccgactgcgcccgtgcatctcccgactcggctatattctcttgtccctccacggatccactcccgaagatgcttgcttgctgttgctgaagatatgtgctgattggtgttgctaatgcattctttatgttcttgtgtacctgtatagtgtgtccgtggatccggccacgtagatcgagcagccatcgcccctcctcctcctcatcgcccaaaacaggtgacaccttgccggcggcagcctgcggcactgtgagtagggagatggagatagtaatctattttttcttgcgattgttttctgggatttttttctccaatacttcggacttttctagatgagatcgcacgtttgtaaaaaacccctctcaaaacttgtaatttacatttaggtccacagaacggtttaaccgtcgatactcatctaacggctgtggataggtgcgtatacgtggcactttctacagccaagaatcaggaggagagctccataagagatgccatgtggcccaattagaagcctgggatctgaccctgaaatcggtttataagatttgacctgactaatccctgtcaagttcacaccccctacctcggtaaccaaggaactattccatccgtacacaaatataatcacttaatatctactaatataataatttataatactaatctcattatcatcttcagtagaaacgaacaccatctaattatcctatcaatcacttctcgtttaatctttttcatcttaccctcaatcattcttacacttttatctactctctccggttttattttaattaacgttttggacaataacacggactataaaatatatctttgatcttatttttctattataatatatacaataaataaatgcatgtttgctgttattatagtgttttgaaagacaaatctatatatattgttctaatttctttaaactaaatatttttaaagttattaatggtcaaaattataaaagtttgatcccaaccttacctaaaatgtcaattattatgcaaccggagggagtactcctcatgacataaagatcttttctcctctattttactcttttctaaataatctaaaaaatatctaccgtatattatcatttcaatgccgtcaattgagcggcgccgatgtccactgcccagtgagatggtgagctcgtctcggttttctggagaccaaaacggaagaagagaggaaaggttgaatgaaaaaccatggtctttgatcgttgctgttcatttagcatggaatgggagctataaattttcattagaaagcttagttggtgcttaagcacaggaattttgcgataagcgctttcagattatacaaagaaaatatcatatcttgtgattttttttaaaatacataggctaggtgacaaaaagattgcgatagcatcattagcatatttatagttctcggacctaaaaaaatggacttcgttttatagtttttttactatatctacatagactaggggcatgtttagttcccaaacaaaatttttacgttgtcacattgaatgtttgaatacatgtatagagtattaaatatagacaaataaaaaaccaattacacagttcgccaggaaattacgagacgaatcttttaagcctaattgcgctatgatttgacaatgtattgctacagtaaatatttgctaatgatagactgattaggcttaataaattcgtctcgctgttttctgtcggaatctataatttattttgttattatactacgtttaatacttaaaatatgtatccgtatatccgatgtgatatataggggcaaaaatttttgccaactaaacgaggtctaggtgaacgtagctcagtttggtgcagaatatcaagaatgtaacaattcaccggcaaccatggctttcgtgctcgctttggtgaagccatatgcttcatggtggacatcccctttagcaattagcaaaggtgaggggaatataacattttttaaatactactaacattgtgtgaaagcaccaaccgaattttacaaagttggtttaatatcgaaagcgcttagatacgcgcctaaaccttctactttgcctaatataggtgtaaaatctttctcaagctaattttacttttggtgaatagtcaaaacacacgaaatactggtagtatcagcttccccataataaatgggtgagattaatctaacaatactaacatgcaacccaaatggtttaattaatgctccgttggaaaaaaaaaacctcaatcacattctattcgaagcacttttttcttaatttctacaaatctgatttcttcatggttcttacaaaatagatgttgtccaaacgtgggctcgccttttcttcccataaaatccatctaattccctggttttattgggctagtttgaaacaaactaattttaaaagaaatatattaagcgtatgttttttaatagttaaatgaataaatagctgaataattatgtgatacaaatgaatcactccttcaattctaaaatataacaagttttatttagatactaacaattatattttaagacagagatagcaactcttataaaatttaaaatatatttaaaataaattatatatatatataatatttttaattaccaaattcacatccttgataagtttcaggaagcacgccgcgttaatccattcatgcttctctaccaagtagaatgggactgtttggttggtaaccaaatttggcagccatattaccatacaaaatgggaaaatgtactaattcccaccccacccccctctcgaactatcgcggtcgaccgaattgcacccccgaaccacaaaaatggacattcttcaccccaacaatgtaaaccggacgaattaccctcctcgacccaatccgcggtgggtttggtctacgtggcgtacgcgcggcattccagttagcattctatttatttaaaaaaatgtgggacccacctgtcatacactcatactctctcttctctttctcattctctctctctcccatcgtcggcgcgggatctgggtgtgcgggagacagcagccgcggaggagttggccggcggtaaaggtgggggcgccgtcggagaggcgcggcggagggggcccgacgggaagtggatggccacggggccggggcagggccggacgtcagagggttgcgggggctgggtccgccgccccaagctctgtccttccccgccaccctcgtcctccccgcacgcatgccatcgagagggagggggcccgagctcgtccgccccccaccgccgtcctgctgccctcgtcctcctcgcgcgcacgccaccgagagagagggggaagccacgccgagctccgtccgccccaagcttcgtctgcccgcacgccgccaagagtgagggggaagccgtgccaagcggccgcctcctcatccgctgccgccgccgccaccgctccgtgtcccccgctgccgccgatccatgagagagagaggaagagtgagatagagagtgagagagaagagagagtatgagtgtatgacaggtgggtcctatattttttttatataaatagaatgctgactggattgtcacgcgtacgccacgtagaccaaaaccaccgcggattaagtcgagggggtaattcgtccggtttgcatagttgggggtaaagaatgtccggttttgtagttcaagggtgcaatacggttgaccgcgataattaggggggtaattcgtactttttcctacaaaatgtgaccaacaaaccgttcatcataaatgtaacaacattttgactagaagctaagggcctgtttggttgataccctgagtaccatgcctgagaaaattgcatgcctggcaggcatagaagaagctgatgaagatggcctggtcaggcagcctgacattttacttgtttgggttgtgacattttacttgtttggttgtgtacctttgcctgagaggaagaaacatgattaggatctggatgagaaccgctaagtcaggtactaattataattagaaggagggaaaaagaagggataaaagaggcaaaattgcatcgttcctccaaataaatcaatgtagtacccagcttttgataaacaaatcacttgtatacatcatgaagggaaaacagaacggtaaaacacaagaaaaaaaaaatccctaaatccacgcatctagcaaaacctgcaacaatttctttcagctggttggcaattgattcaatcaaacaaaccatgaaagccttcagtgtcttgcacggtatcagatctggaatggctgcagtgcctgcttccttcccgtgcttcacgcgaacggcggatacaacagagcgaagcagcaggatgcagagggatccggcgagtcagcctcttcctcggtgaatccagcaaggatggaggtggctgattcacatgacggcgatggagacaacaactgcagcagctccgcgtgacgatggcggcggcggcggcggcgggggcacgcgtgtggctgttgaaatcctatcgttctctccagatagaagaagaagattacggtggtaagtggattcgcctggagctcaggcgacctatttggctcaggctaacgacgtgcgggaggacatcaagccaggcgtggaatcttgagtcccagggagacaaccaaagaacctcgcgttatactcaggctagtatcgggtcaggcaatttcttcccagggcagcaaccaaacaggccctaagtctatgacatacaaatccaatagatattaaagtgtgttgtatcataactgtgctaaccaactaaagtctagactaataaattatgatatatcaaagctttggcgtggcaacgtttgatagacaatcaaacaacttctgcatgccctaactcttttttttttaaggaaatgccctaactcttgatattttcgtcctataaaattgatatttagtacttgtcggtgatatgggcccgggggtatcatgtttagagggaggaggctgcccccccaatgccacgtggccctcccccaaggggagtcgggcccgaggtagggtggcggccactccttcccaaagactagtcggaggaggctaccccccgatgccatgtgaccctccccggaggggagtcaggcccgaggtggggtggcggccactccttcccaaagactagtcggaggaggttgtcccccgatgccacgtggccctcccccgaggggggagttaggcccgaggtagggtggcggccactccttcctagagactggatgaaggagactgccccccgatgccacgtggccctcccctgaggggagtcaggcccgaggtggggcggcggccactccctggccaagactagagggagaaggctgccccaggcgccacgtggccctccctcgaggagggatcgggcccgaggtcgggcagcggcggccccctcccgtgactaggggtcaggctcccccgaccccctctttaggtcaccacgtacaggtgcccacctacccgtatttatggtgacccgagcagtcgcgccaatgcggcttgcagtgtactcaaccggtctgtgaccggtcgaatgactgatgggactgactagtgtgcctgtgcgctgctcgtgtgttaggcggcatgcagcctgacatatcccatcaaataatgatggtgagaggttctcatcatcttatcccagctggagtcggtcctcccgctctggttaaagctaggctcccttttcccggtgtaataggagcccagaagttttcacccattaaatggtgaatgacatgggcgctccccgtgtcaggcggcatggtgtggtaggccccacgaccaaggcgacgtgtatacaacttccaagttaaggaacaagacaggcatttaatgcaaagatggtaatatttctcgaggaagttaggttgttgggcctatttggtatccccttgaactataaaaggaggaccttgcctaccgagaaaagggacgacgctcagtaaacctgaactctaggagaagaagagcgagagtgctctccgtagtttaggaacccttgtaacactcaaccataatcccaaacacaggagtagggtattacgcttctcagcggcccgaacctgtataaaccccttttatctcatcgtctttggaggattgaaccccctcaagatcacacagcttcgctcaccaagccctcgaatctcacccgctgcccccggccgaactcacaaaggggggcctcacggttccctgatggaggagttcattcttcgacagtactctatttgttctaaaatataagagatattgggcggatctgacatatcctagtactacgaatctggacagattcgactctcccgtattttttggatggagagaatatataacttcgtatcaaacttgtggttacaagaaatatttcatattattcccttcgtctcataaaaaatcaacataataccgggtattgacatatcataatactataaatttaaaccaacatgtaacccattcaattttatgttatttttaacgagatggagggagtaatattttagaacgggtatggtggatttttttttttttagaaaaagcactcgtgttccaagtcccaactcggtcttccccagttccatctgtccacacactccacagcaacaggcttgcagcctgcacaacagtgcttgtgtagttgtgtcgcgtgtgtgtctgagagagagatcagagatgagggcgggcgggttgactgggagagtagaccaggaagtcgtcttcactgaaagtccgtggaatgccgcgtccctccatcgaaagcgagaggggccccgccctacactgccaaacgtccctctcccccagggccccaccaccccttgaaccaaaaaaaaaaaagaaaatctctcgcctacgcctagtagggattagtagtagtagtactactcctcgtcgtcgtcgtcctcgccttctcttttgacgggcttgcctcccctcccctccctcctttgccccccgcgtccaagtcttccttctcccaccatcgtcgtaactatctcgttgttcattcgcctcctccgctcctcgtcttcgggtgtgcgggctcccttcctcctgcttcttcaggtgagacgagctctgctttttaattcttgttcttgtgccttggtgtgttcttgtggggctttatttgggggtgtacagtggatatgatcttcgtgagtggttttgcggtttagtgttcttggagcgcaggaggatctcccggacccggaattgttatgcaaggatggagaggtgaatttcgggggtgctggtagagtggtagtacggcgatggaattaggggagaggaattctgttcgtattgctgctgttgttgttgccgatgcgtgggtttcttgaggaggaccaagggttcgtccaggactcatccgcttggggatttttgatgatcatacgcgaatcatttcgagtggcggagaagggcggccggagtgcctgaccacttttggtgcgagatcgaagagaaaagatagtgtttgtttgtttggatggtggtggtgccttcttttgggggatatttttttcctcgttagatttttttcgcaacaaaagtagggcgcctttttgagacacgagagaagccgagatattaaaattagagaccttttgatcgctctaaaatagaattgattgaggcatagaacgatggttttgtgtgttagaacctgcttccagtagacgattctttgttactcgttctcattcatgcatctacttgttcttccttttgcctatcttaataattagaaagtttaccgcttgtgtgatttgctttgtctaaggtggggatcagttctctactgatgtagtgatgttggctgcttacagttgggattctttgatgttgttgttactatcataaattaagtcacaatttccatcgtactaggataattatactgtggcacactaactttcaggctagagcatcgtatgtttacctgtaatttcgtgacatggtgttattgattcttgcaggcgactgctaattttgaagtgccatttctcatcgtcaaggagaggtggcattaatccgcagcaagtgctcgatgacagatcattattatgctcctctgaggcttattcttctcttgatattgagtgccacctgttttggctctgaacttgatgttcagtgcttgaaaaccatattccagtcagtgaccgatcccaatggtatactcaaatcctcatggagttttgtcaacaacggcacccctggttacatctgcaaatttactggggtggaatgttggcatccagatgagaaccgagttctttctttgcgtctcggcaaccttggtcttcagggtccatttcctgcaggccttcagaactgtactagtatgactgggctagatctgtcgagtaacaactttacaggactcattcctcaggacatctcccagcaaataccatacttgacatcactggacctctcctacaataggttttcaggccaaatcccagtaaatatttcaaatatgacatatttaaacacactcaatctccaacataaccagttcactggtcaaattccactgcagttcaatcttcttggtcggttaacatcattcaatgttgcagagaaccgactatcagggcctattccaaataatctaaataaatttccgtcatcaaattttgctggtaatcaaggcctttgtgggctaccattggatggctgccaagcttcagcaaagagcaagaacaatgcagcaatcattggagctgttgttggtgttgtagttgtgatcataattggcgtaataatcgtattcttttgtctgcggaaattaccagccaagaagccaaaggtcgaggaagaaaataagtgggcaaagagtatcaaaggaactaaaaccatcaaggtgaaaataccctactattactatttatttcccttttcttttataatacaaaagaaattttgtgtaacattattcgtaaaagaagctaacgtaaacttcttactgtcatggccttttcaattattcaggtttctatgttcgagaatccagtttcaaagatgaaactaagcgatcttatgaaggctaccaatgaattttgcaaagagaacatcataggtactgggagaacaggaactatgtacagggcagtgctacctgatggttcttttcttgctgtcaaaaggctacaagattctcaacattctgaaactcaattcacgtcggagatgaagacacttggccaagtaaggcatcgcaacttagttcctctcctaggattttgcattgctaagaggaaaaggttgttggtgtacaagcacatgccgaaaggttcactctatgatcagttaaatcaagaagaaggcaaagactgtaagatggattggactctgaggttaagaaccggcattggtgcagcaaaaggtcttgcgtatcttcatcacacttgcaatcctcgagtccttcaccgcaatataagctccaagtgcatcctcctagatgaggactacgaaccaaagatatcagattttggacttgctaggcttatgaatccaatagacacccaccttagcacctttgttaatggagaatttggagatcttggttatgtggcaccagagtatgcacgtactctggtggccacgccaaagggtgatgtgtacagcttcggtgttgttcttcttgagcttatcaccggcgagaggcctactcatgtttcaactgcaccggagaatttcagagggagcctagtagagtggatcaactacctatcaaacaatgccctcctccaagatgccgttgacaagtcattgatagggaagggcagtgacggcgagctaatgcaatttctgaaagtcgcatgttcttgcacaatttccactccaaaggagagaccgacaatgtttgaggtctatcagctcctcagagccattggagaaaagtaccatttctcggcggaggatgacttgatgatgctgccacctctaagcacagatggagaaacccttgacgagctcattgttgcccagtaactgcaaacccaatgttccacagaaggcaaccaagtggaggttgtttcttctgcgcgtcattaccatgcttagatgagtgaggtggctttacatgatgtactattaagtagtatcagtatactgcatccgctgtataatttttgtagcttgttgttatctaccattgggaggtgctagcagcagcaatgatgatctttcactcaaccgatatggggatggggtattaactactcctaatagtagtttgctcctcatgtgatgggaatatgccatattggcatttattcagtcatttttcatgatgtcatttgtacttacgccacgggatgaggaatactgaacgtcaaaatgtgtggaatgccaccttatgatgtcttccagccaaagtgcacctgagtatgcaagcaaacttgggaatttcattatttcaacttgcagtgtaagagtagtgggtcattgtcttttgtaaatgtagtatagcttttgctggttgaaactattttttttcttggtctataaaagcttcttttcatgctagccacttctattgttgaaatatgcagaaatatcaagattaaagaaaagaatggtgtaggaatattgcaaattaagcagagttatttttagcttataaaaacatgtcacctttatttggtcaaaactcttgcctggtcttaaagggccgtgtgcgttccagggaaattcatggacttttgtagtggttatctggttgatgcatctggaaatactgatattgatgggaaaaaatgctcctcttttaagtcgtttttttttcttggtgggggtggtccagaaaacctcttacacgtatgaacaccggtcaaaatttttgacttcaacgaatgttatatctggaatcatcaagattactgataaaaaatacctgcaagaaatattaatgaaaaatcaaggcgtatgcataccgattgctagatagcgttgctttggtgctctctacgggtattattataccactagtattattaggagtaaattaataactaatatactttttcatttatgttttttcttggctaaatcgatctatgatcacccattacgctggcatcgctcatgtttcatgaaaaaacaaaaaagaaaaaaaggtttagtcactgctaaatgatgattataccccttcgcacccttttacatttctactactattaactagggtggttgtataaatagatctgaacccttcgatcaaatgagatcaatagttcggattattttctaatacatgtagagagtaccgtaatgaggctcttgctagaagtatttcgctgctatttatttagtggacacataaaacttttgctctctgaaaaaatttcacatgtgacttcagaagcagcataaagtttacgggcttgttcggtttgtaggatttttcaaaacgtacgaataggaaaaacataaaatagtataaaaatacaagtgcaaacctaagaattgaaaaacataggaaactttactatggttgtgtagcaaacaatacaatggattgaaaacattgggttagagtggattatatttttctttgttttcccataaaagggagggatagaaaattttcatctggtgcattcctttgaaacgaacgatagtgcactgtccattccgaaggactatatattactgtacttttccttcacaataagccctagcagtgcaagccacgcttggcttggcgtgccttcagcctattccaacaaggattttggaccaaaattcatctctaggtcacccaccccacagtgctgtacccacgtcttcctcctcatcctaatccccacgccgcttttctcggcttttcatccccacacgctgattctcgccagaccgcctctttcctctcccctctccacctcaccgacggcggtggcggcgtcctcgatgccggaggcggcgcggtggcctcgcttgcggaggtcctcgaggcggcggctcagatctggacggacggcgacgcggcggcacacgtggcggcggcggcggctcggtcgacgacggcaacctcggcggttgcctcgtcgtcctccgcagatctggagcggcgcacacggtggtggtggtggtggtcgtcgtcgtcgccaccgacgcgcggtggtggtcgccgccgacgccgcgtcgtcgttgcccgcggtggcgcacgccatccccgccagccggactctccctcttcccggcgcgccgcctaccccaacgtcgagcggcggcgacatcctcgggacctggcgaagaaccggcggcggctgcgcagatttggagcgtcctcgccgtcctcaacgacggcggcggcgccgcggatctgaagacgtggcggcggtggggggtcctcgccccgccctcctcacggacggcggcggtggcgtgtcctcgccccaccctcttcaccggcgacggtggcgtggattggagctggcctcggagtcgcgcgttctcgtcctcgcatctctcatcagtgggccccgcgctctactttttaagcgaggttctcgttccttcgctggtaaccgaagaagctattgaagctatgggacacacaaactttttttgccagcgaggacgaaggaacgctccatgtagacgaagtaacgcccactgtgaagggccttacaatccccttttaaattttttttacaataacctgcagcagaagttttccaaattaaaaggcaggataataaatggttaacaaaattctagatcgaacgaacatcgttttcatataagtggcatctttttttttctttttaccattttaattaatttatttatatataaaatttaatttttctaattccgttccttgcctatattatgattgccactaaatagttaaaatctataaatatggaaattcctaagtgacctgcaaatcacttctgtaaaaatggcattgtttcggatcatttccatcacagtttttattacccatccgttccatattgtaaggctttctaacattgcttatatttatatttatgttaatgaatttagacacatacatatagcattgcaatgctagttatggaaaaacatttttaaaactgataaaaaatggttaaagcaggaacataaagcatctgtgagtgttgggttcggcggtgagcctcccccaacagtgttgcgaaccaaagcgaggttttttcgcgggtctcagaaggggaagcagccaagcttttcccgcgtcccgcgacgagggttttgggtccgccgccacccaccgccgccgccgcccgccaggtatgcgtctccctaattccccatcttgattagggatttataatagtctctttgtggggatgggggaaaagtacttcgcatttcacctgcatgtttagcattcagccaggtcccctagttttcttttttttggggatgaaaatgttgatccgatgtgaagtttttaggaattatttttagttttttaggc

SEQ ID NO: 34987 - DNA, 2161 bp, Oryza sativa
cgaatctcgaacgttcatttctcgatccaacggtagttttcaagttttcactacatatgtggtttgcactagatattttccccttttgttctgaactaatcatgatacctttggatgaactttgtagattttttttactaccggcttttactaaacttgcacacattaattttcagttcgaaagcttgagagatagatggaaggcgaggatgagtctccttctcctggagagaatgagttgcctttgtgggggcatgttaagatattggatgggttcgctcctcgctgtggaacaaacatgaggttcctatgcgactattgcagttgtgtctttcgtggaagctattccacagtgaaggcacatttgcttaaaatttctaaacaaggtgttccagcttgcccaggagtgaccttcaatatcttaatgaaactatccagtgaagttgatgcagcagaagattcaattctaatccaggtgcgtaaaaaaaggaatgtaacagaatcttgtagcagtgactattctggtgacgaaccagaatcttgtagtagtgactattctggtgacgcaccgtgtatgggcaaagttattgtacaagcgaaaagaaaaaagagcagagctgaatgtcgagataacttcgatgctcagtttgcaagaatgttctattcttcaggttactaccttaaacttaaaaacttgtatattttccttttgggaacatgcataagtttgcacataacagggtactctgtttatgttgtatccatcgcccttcactttttgttttatcttagcaggcttgtccttcaactctgcaagggacccatacttccggagttcattttcttttattttgaagaatattattcctggttatgttcctcctgattgcaaaaggttgaagacaactcttctgcaaaaagaaagggctcgcattgaagacttactaaaacccatcaaaagcatgtggaggaaggcaggtgtgacgatagtttctgatggttggtcagatattcgacagcgctcacttgtcaacattctggctgtcaatgaatgtggacccatttttctgcaagcaattaacaatgaagatgaggtgaatacaaaggagtacattgcagagaagctcattgctgttattgaagaggttggtccagaaaatgttgtccaagtgatcacagataatgatcctgtttgcagagctgctgggctgctgattgaagaaaaatacgatcacatccaatggatgccttgtattgctcatactttaagtcttgccttgaaggatgttttttctcctaacaatactggagatgttgccttcaaagatagccattggatttctgaagttgtagaggatgcaattatgatcaagaatttcataataaatcataccatgatatcatctatactgagtgagttcagtaagttgaagattcttgctatttcgaacacaagattcgcttcagatcttgttatgttaaagaggtttcggctgatcaagcaatctctaataatgttggtcatcagtgacaagtggtggccggtttactgtaatgataacatggagcaagcacagcttgtgaagtacaagcttactgataactcgtggtggaaacaagttgattacattctttctttcactgagcctatatattcgatgatgcgcgtgacagacactgaagagccacgccttcatcttatcaatgaaatgtggaatactatggtcgagaaggtaaaggctgccatttataagcatgaatcaagagagcctgaagaggagtcagcattttactctgttgtgcatggcattctagaagattggtggagcaggagcaaaactccgctccagtgtttggcgcactcactaaatccaaggtgaatcttgctttgtagttaccaagtgatttgtattcctgaagccattatttgatatatatgcctctttgtggtctcttttgtaggtattacagtgacagctggattaatcaagctgctaatcgtctacccccacatagagatgctgagatttctcgagtgaggaataattgcttgaggaaattgttttttactacagacaacttgagaactgtcaagtcagaatatggagagtttgctcttctgggaacaaaacattttagcttgaattcaagagctgatagg

SEQ ID NO: 34988 - DNA, 12088 bp, Oryza sativa
gtccatgttgatttgcatgtacagtagcatatctctattactagaatatagcaacacccactcttctagcatttaaaatttactccatgtttcatattataggttgctttgtattctttttctagtaattttttttaagtttgatcaaatttatggaaaaaatacaacgatagattcaacacaaaacaaacatattattaaaatatattgaattttacttttagtgaaattaatttagtgttataaattttgctagattttgataatatgaaaatgttttattagaaaaatgtcaaagcgacttaaaacgtgaaacggaggtagtatgtcgaaacgtagcaatttctacagctaccctctcatcttaaccaattacaacaatctctcatttaatttttcccatctattacctcatctcaactacctccatcccaaaatataaacatttggatatgaatctgaacacatagttatctaaatttaaagctaaatatgtttatattttgggacggagggggtatctggggatggctaattggcgcgcgcgccagctagcactccctcccctcgcgctagcttttctttttcgcaattttcctttttcgcttttacttgattttttgttaatcttctacacacgttttttcaaatctttaagttgaaagtttttaaatctttaacttgaaagttttcaaatcttagcttaaaaggttttcaaatcttaacttgaaaggttttcaaatctggacttaaaagttttcaattttgagttgaaaattttcaaatctcaagttaaaagttttaattttcaaatctcaagttaaaagtttttaaatcttaaattgaaagttttcaaatcttaaatttaatttgaaagttctaaattggactttaaagtttgcaaatttgtagtgaaaaggaaaataatgttttggaaaaaaaaagtttatcttgattggcctaatttatactacctccatttcaggacataagactttctagcattgcccacatttatatataatgaatctaggcaaacatatatctctagattcattaatatatatatatatgtgggcaatgctagcaagtcttataatatgaaatggaggaagtagaacctaattacgtataaaaattaagttaatcacgctgtcagggttatggataccacatacctaatagtagttgactaaatctcggcacgactcaccacataccatatcctatacggaaacaacctgcggatataggaagagttccggataaggaaagacaaccagagttctatatggaaacgacaaggactactctgattgtatccatattggtttacctagttctatttgtacaagggacacctatgggtataaatacaagactccctaggaggaaaggggacacacccaccatagaagagacaatcaacacccaccacaatctacggaacaatagatcaagacagaagatcaacatacaagccaatatacgctaagacaagccgccgggtatcgacatcagagatatgcctggatcgaccctatccggaacctacagaggccggccgtagggacgcgttgtctctgatctcgccgggcatgaactcgaggaagaagactaccctgatgtcgactatgagtcagatcttcagaccgccatgtcgataacagttagatatgctacccaaatattgtactggtgtgattatgatggataagagcaatgaccggcttcgaccaacaggatgtagggttattacccgataattcaggggcccgaacctgtataaaaatccctgtctccatctcttttacctcaatctcgcatatatcatggtaccgacgatctccataccatgcaaataccggaatcgcgacatcaaacgttgttagtggcgcgccaggtaggggattttggtgctttaggatttcgacgagatgggttcaaaaagatggattcttcaacaataagctactcgactacttcgaaccagggagatccaacccagccaaagtacgtcccccaacgagatctgaaccatcgtcgtcgataattcgatccggcgagatcgaccaagatgtcaccgccgcgggtttcgagactttcagccgagtccgattgctttgagaccgagcgcttgattgttccgtctcagacacaaagtgctactgacaaaacagaatactactacatgtcgcctgtatccgtggtcggattggatcgatctcaagtgcagcagccggacagccaagcgagaagacggctgactacatcacgtgttgacacatactccgtatgtcagcatgcatacagtgggaccgatgtacagtattgcatggtgtgtaccgaagagctgagctatctcagccataggtatgcatacatacgtacataggcatgccatctacacgtgccaatcgctgaggacaattcagtttggctaaaaggtaattagtggattgatttattaattaatctattaatttcatagatacatccggcatgtatctacaaaggtatacaatattttatctgcaatttatcatatctattcagatcatacagcattgtcagatctataatttattatgtttacctacaatatattttttatacaatatctgttgcgcgggtgtccccgatgttaaatcgactacgatctaatgctgagggctcgctctgtcttcttctgtataaatcatgcttgtttacggtctacataatgcctggtatttacatctgctcgttatatcctgataatactagaagatccatgcaattttttagtacatactcgatattctccgctatatgtcttgtcttctagaaaatatttttcaggaacaattgagcactcgaatagtttgtggtcgagtacaccgtattatcgagaacaacctcgacaaatgcagagtcgtcgcgcccaacctaccaacgaagaccgacgacctatctcatagcaccggccatggctggactactcgagaaaaggttgttaacggatagttcctcgcgaacgccgtcggcttgatcacccgacatgattgcgaatggacgtccggatatgctacaagttgggtgtgtgagtcatgctggccatatgagatgcacatgtaataaaccaactctagcacttccattggtgttcgagagatgattctactcgctcgctggttctcgaaccagtactagcaatctcccgcaccgcaaacctccattggtgttcgagagatgattctactcgctcgctggttctcgaaccagtacgtagcaatctctcgcaccgcaactttcattagtgttcgagagatgattctactcgctcgctggttctcgaaccagtacgtagcaatctcccgcactgcaacctccattagtgttcgagagatgattctacacgttcgatagtcctcgaaccagtacgtagcaatctcccgcaccgcaacttccattggtgttctagagacgattctactcgctcgctggttctcgaaccagtacgtagcaatctcccacaccacaacttccattggtgttcgagagatgattttacttgctcgctggttctcgaaccagtacgtagcaatctcccgcaccgcaacttccattggtattcgagagatgattctactcgctcgctggttctcgaaccagtacgtagcaatctctcgcaccgcaacctcagatggtcgtggtacgattacaacaataacgcagcggtcctcgcaccacgacttcaaatgatcgagagacacctactcactggttctcaaccaatcaatcgtagtgatctctcgtacatttacttctagtggttgagttacgactactacctggttcttgaccagaggtgtagcgattctcccattacctctacttcaacaaagttgatatcatgtacacaatatcgccaagtgttttacccagagatcccttaccacaaagacacctagcgttgaaacctatcctaatgtccctttacgccatcttgacaaggcctccgaggaacctgagggaacttcggctggggacgcccagagcggataaggccttgtaggatcctttagagacgaaagaccatgtaagatctggtcgtgtaagagttctcaccgtgcgtattaaccaagccgtgtaatcggaaatggattttctaacttcacggctgggggctaggatcagtgcttgttcaaccgaggcaggtcaaaggttcaagagctttatcctccgagaacgattctccgacgacaaggctgggggctacggagagtgtataactcaacaaactgactgatcgaagtcggtaaaagagtagacgctcatatacaaaacattggtctgtaagtttaattcattttcagttttccattcattctataacatgttaccctttgagcgttcgctcgggggctatttctatctaatattcttttctgagtattgatttcaggaaaattctattcgacattatcgaaggctccatgtctctatggttgtacaccaagatcaactaaggcgagtacgagaaatgttgacaaggcttcgtcgcagattctacgccttctcgatcactcgagaacagttggtggatctcgacaaggaatacggaatgaaaaaatggtgtacccgccgagataaaatttcttgacttcaatccaaattctcgattacagcaagacgggagacttagtcgtatgctctgctactttcttggttgacgtcggagattgactcagacaaaccctttaggtgcccgcacgaggctgataaaggaagtctaatgttatctttgaactcaccgagaacggtcacgtaagctcgataacagttcctccaaggtctgcagttgagaatatgaactcgctcatttgcattgaagtcgggggctactgtcagggttatggataccacatacctaattgtagttgactaaatctcggcaggactcaccacgtaccatatcctatacggaaataacctgcggatatagtaggagtttcggataagaaaagacaaccagagttctatatggaaacgacaaggactactcggattgtatccatattggtttccctagttctacttggacaaggggacacatatgggtataaaaacaagactccctaggaggaaaggggacacacccaccatagaagagacaatcaacacccaccacaatctacggaacaatagatcaaagacagaagatcaacatacaagccaatatacgccaagacaagccgccgggtatcgacatcagagatatgcctggatcgaccctatccgggacctacagaggccggccgtagggatctagcgctgtctctgatctcgccgggcatgaactcgaggaggaagactaccctgttgttgactacgagtcagaccttcagaccgccatgtcgacaacaattagataggctaccccaaatattgtactggtgtgattatgatgaataagagcaatgaccggcttcggccaacaggatgtagggttattacctgataattcaggggcctgaacctgtataaaaatccctgtctccatctcttttacctcaatctcgtatataccctggtaccgacgatccccataccatgcaaatatcagaatcgcgacatcaaacgtcgacacacgcttttttccttccgtacatgcggcagatttgttgcgtcgaaaaaataggaacgtttttcatagagcttgcttcgttgtgaaaaaatggaaaacgcgttgcaaaaaaaaggtaaatgcgtctgtgtagaggccagaaaacgagcgcgacttaacctctatgcgctaattaggattcgcgggagtatatatcaccaacttcacatccatgaataatttcagaaatccttatatttgaaatctttatatttttttatgggaacggacaaataccgtgcaaaaatggaacgttaggaaactaatcaccttttctaaaaaaaaaaggtaaaagaagaaaactaatcaccttaggaaacagttctggcaagtgggccctagctgccaggcgatgcaatgcacagctagtactactcgcgagtcaccatccatctcatctcgtcggcgagtgagcttccttcgcgcgggctgaggtgaaaaggtggagagggtttcccgcgtctcgcgacgagggtttaggcccagccaccgccgccgccgccgcggtgccagagccagctcgccgcgggcaacaggtatgcatgtccggcgcgcccctcccctcctcccccctgccccccattctctctctttccctctgcgtgtgcgcgtgctcgtgcttccttcgcgatggcggtcggatgcggaggcgttgcgaggggggaagcgcacgagacgttcacaggtttcctggactggttaccccgtcggcgaggagtgatttccccccattgagattaggttttttttttattttgacgcgtgcattttgaggcatggtgattggggggaaatattgcatccgatgcattttattggtgggagtgccaattttggtggcaaaatgaaaaatcaagtgatctatgggaggttgttgttgatctcctatattatttttagatattttttaggcgaccttctggtaggttttctttttctttttttaacaaaatctttcgttggtgtagagaggaacttggagcttcaatgggggaacctagtgttgcacggtatgtacattttcctgggattttctaatatcgagcaaaaaaggagcatttgcatactcaccttgtaaactgtttatgacatctttgtaacagttccaaagactgtgatatggagtatgatgatagttcttctagacaaagtggcgagcctttgtgggaacatgcggaaggtgtggaacgatctgtcgattattcagatggcttgccccctacaagcaagggtatgtttcagtcaaataaaagaaagagcaaagctgcagatgaggatcttcatatgaaacttcgaactcgattggatgctgaagttgctagaatgttctattcttcaggttaataccttaaacatgaaatcttcgtgttcatgttgtatggaatgccattgaacgcatgtttcaattttcaggattatccttaaaggccgcgacggacccattctttaagagcgcattctctcgtgccacctccatgcctggtttcacggctgaagaggatgagcatcaagatgaccagccttccctagttacacaaatgttcttttccataggttaacatctcaaacttgaaggtctttcagtttgtatgtatggattgtcctttagtatcattcatatttgcaggtttgtcccccactattacaaggaacccatattatcggggttcattcgctatggtcgcgttgttccagattcctggatatgttcctcctggggtcgaccagctgaagacaactctcttgcagaaagaaagggctgacattgaaaacatgctgcagaccataaaaaacacgtggaggaaagcaggtgtgacgattgtttctgatgggtggtcagattttaaaaggcgacctatcatcaatatcatagctgtcaatgaagctgggccagtttttttgcaagcaattaacaatgaagatgggtggatgtggatgatggatgactacattgcagagaagctcattgctgcaattgaagacgttggatcagaaaatgttgtccaagtgatcacagacaatgatcctttttgcagagctgctggggtgctgattgaacagaagtacagtcacatccaatggacgccaagtgttgctcattctttaagtcttgccttggagaatatttgtgctgctaagaatgccgaaaatgttgtcttcaaagactgccactggatttcagaagttataggggatgcaaaaatgataaatgattttataagtaatcattctatggtactatccatgatcagcgagttcagtaagctgaagatacttggcattgctcacacaagatttgcttcagatattgtcatgctaaagaggtttcggtttgactaagcaatctcttatagggattgtcatcagtgacaagtggtccgtttacagtaaagatgacgaggggaaagcaaagcttgtgatgaaaaaaacttactgatgaattgtggtgggatcaagttgattacattcttgctttcacagaaccgatatattcaatgatacgcatcacggacactgaaaagcaatgcattcatttgatctatggaatgtggaatgatatgacagagaaggtaaaggctattatttataaacatgaaggcaagggggctgatgaagaatcaactttttactctgctgtaaatggcatttagtagattggtggggcaagaccagaactccactccactgtttagcacatgcactaaatccaagatgagtcctggtttaagttactaaatgatttcttttttaagccatgtaatatcactatcttttggtctgttctgtaggtgttacgccgatagttggattgatgaaggcgctaatcgtcaacccccacatagtgatgctgagattaatgaaatggcaaatgactgcttgaagaaattatttcctgctgcagatgacttgacggcgattaaagcagagtatgcaaagttttctcttttgagcacggagtttgcttcctcaggtacaggatgctttaacttgaattccatcactgatagggatgttcttgacccaaaaacatggtgggtgacccatggcagtccaacacctaagttgcaggagctagccctcacgattcttggccatcctgcctcggcatcctgctgtgagagaaactggaccacatataaattgattcgcgcagccatgaagattgagagccgtcctaaatgggttgatgatttggtgtttgtccacaccagtttgcggctttggacaagaaccacagttttactatagtgatccagagtcaatgttttgggacattgggggtaacgccgatattcttgcaagcttagtccctgctgatttacttgagtttgctgacttctcactcgacgaacctgagttcgagcttgccattcttgaagggctggaaggtgatgatttggcatgaagatggaggtggattggtggaagactttctagaatcctagctcaatctgtgaatggcctgatgccacctttcctatcaggctgtcactcgggtctaccttgtcttttggggaaagtggtgtgttttggttatgtacttatgtggccactctggtagtatgcaaaactttgcagtatgcaatgctactacctccgtcccaaaatataaccacttttagctacgaatctggacacggttgtctagattcatagctaaaaatgcttacattttgagacggagggagtatatagtagtggtagtgatggactggtggtagactggaagtatgcatgcaaagctatgcaatggcaggtagtggtaatggtattatgcaaagctatgtgataagactttgctattatatatgcaaatctgtggaaactggacggtttgctttttatgctcgtgtcattgtgtggaggtcattttgagtgcattcttcacctcttccaaaacatgtttggattcacctgaccggtgtatagatgtggtagggtgctggtctttatgttctttattttggtttttgcgtggtccatgtgtgcattttggagtacgtgaaatgtgacacggtgtggattgaacagccaggggctgttcgagggacgagtggatccttttctcccttgcatccattcttgctggtggtgttcgaatctttctctcgctccatttacctttgcatccatttttgtttgtagtgtttaaaattctagttcttatttttcagttgtttggaggcattggttggtggtttggtgacggcttcgttgtaggcctggtggcatatggtctcgtatatcggtggtcagtgcagtgtgttagcccattggtgtaagagtcatcgacatgtggtggtgaatttgcttttctttttctaattatagccttcagggtgtgtagcattgtattttttttcctgatatatctatatgaaacatctccctgattggtggtgtttgtttgaaaagaaagtttatgtggtgctatggtagcatgtagcatcacgtttatgtctatggtggtaaaattaacatgcaaatctatgtgagtactttggtttggttataaggagtaccaataacacatttgatagttttgaggggacgaaaaactcagtataactataaattcattacgtgtttgaaggtgtgtgctcaataactatggtgtagtactactactacactataattaagtacacggttgatttttttttcaatctttgtttgcacgaactcaaagcggattcaatgatccagaaatcaagagtttttcctctaaaaactgtcacgagttttttttaaggaattccgcgtgcaatgcattttgggcttgtttactttgatgctattttcaaccatatcatttttaagtaaagttgctaaaaaaatgtctacatttagtttgttgccaaatttaatcaatatataagaaatcctattaaaattttaataatattatcatcttactaaaattaacgcttgggtagccctcactcccgtggatttgccaccgtttaaccgcgccctctttgaacgcgggagcttggactttgacccggtcagctaatcctagcaccaagcaaaaacgacgacttggtcagctggtcctcgtaatgtgaagttgtgaaccgccccacccaaatttcccccaaatcgacgacgacgacgcccccaattgctcgtcggcacaagcaacaaccgccgccgcgccaagctaaccctagcccacgagatgcccgcgcccgcgcccgcggcgccgtggcccgtgtcgcaggagatctcgtccctggccgaccgcctcctcgcccacgccggcggcgacggcgacggcgccgcggggatgcgggacctcgcgggcgcgctcctccggatccagcccgtcgcgcgcggggtcgagcggcgcggggacgcggggcagcgcgacctcgcggactggctcctccagctcaagggcgccgtcgccgaggccgacgacctcctcgacgagctcctcctccgccgccgccacgggagccggctcagcccttcgttagcgtcctgcttagctcgcggcaagccgccctcccgggagctcaagcgactggtgggcaggatcgaccgcatccacgacgtctccgagcgtctcgttgacgccgcggcggaagaagaagccggcgaggcgggtcgcggcgtgaggtcgccgaaccgcgtgaccggctccgtgctcacggagaggaaggtgtttgggcgtgagaaagagtgtggcgaggtaatcagcaggctggtggattgtccggagaatgcatgctcttctgctcttccggttgttgcaatcgtcggacatggtggaatggggaagacaaccgttgcgcagttcgtttacaacgatgagaggattgaacagaaatttgatatcaaagcctgggtctgtgtctgggatagatctgatgccgcagagctaacaagggagatattgcagtccattggtggtccggatgatacgctgtacggtgataattctgccaaattggatattctgcaggcaaaacttgaagtattggtcaggtcaaagaggtttctactagttcttgatgatgtttggaatgatgaggctaagatggagctggagaataaggatctgtggagaaaggtgctggcacctcttaggtctgccgggagaggcagcaagatcttggtgaccactcgaatgaaactagtagcgcggtatctcaattcgactcatgttgtctcccttgatgtgttgggaagcagcgactgctggttgttgttaaaggaggctgctctgggtggagaaagcaaggatattcctcctgatttgcaagagattggaagaaccattgctgcaaaggcaaagggctcccctttagtttccaaggctcttggacagatgcttagaaacaccacgagtacatggaggtggagagcacttttggatgcagaaattagtcataacatcattatatcgtctct

SEQ ID NO: 34989 - DNA, 3440 bp, Oryza sativa
tgttcacgattgcatgaaaattgatgaaggcatgcttagtgtgattccaccaacagtgcgccacttgtctgtctcaactgattattttccacagctcaagagtaagtgtaagttggaaaggctacggacattattagttcttagaagctcttcgttgtcattgagtcatcttcctagtaaatttctatctgaatttaagaacttgcgtgttcttgatcttagtgagtcagatattttagaattaccagaaaccattagccagttgtttcatcttcattacctagctttatgccacatgactagcaaacttcccaaatgtatatacaagcttgtacagagtggtgtcctggatatgcctatactgctatttcttgatagtcatcctagaggtatgagcaaatttgtcacacagaaaacatcttgaaacttgttgcaacaccaacaaggggtagtcagactgtatcaaggcctaattttgcttccaataaaagcagattattcctaaagaatatcaacaagggggtgtggttggtctatgaaggctgtgcataatgaagggagttgccatttcgtaggtacaagagatctggtggactcaaatctgtcagagactttcagtgtgtgtgcactaatttgttgtctgatcaacggaacaactaaccatgagatagtattctaatttggtggatcaagtctttccagaatgtgataaagcaaggatctggttgcacacatccttcaaaaggttgaagtatttcctgttggtgttttgtaccaatgttctccaggtcaattggcagtatttcaagccttgtatcactggagtagctacccactttgcttatatttggtattctgacaagatctgtacagtcttctctttctattttcattttcacattttgtaagctgttgtactttttatttcactcgggttgtccactactgatctttttctttcaaggaaagaagaaaaagaatgatgatttgagactacatttttgttgcatgttgctgtaatggattgtgcactccattttatgatggtgtgcattggatttcagtacctcattagtctcaatagacgatataccgtaagttctgatagatgggggaaacaggtacaagcaaagtgaaacttggaagcataaaccacatttgctatctctgtgcgtctttctgtataattcctgagtaaatcatgtaggtaacaaaattgaaatgcttatatgcagggaagataaattaattgtgatttagtttcatagaaattcagcttgtgatttaatctcttgattttgctggggccatgggaaggaaagcaagtagaagtaggccttggggggttgggttttgggagtggcggcgcaacttcggggaataggattggtactctctcatttctaagttgatcattatataatcgcatggacatagatttcatcagaatataattaatgcaacataggagaatatgtgcatgctaagtatttcatcagaatataattaatgcagcataggagaatataattaatacagcataggagaatatgtgcatgctaaggtgtaattggcatggtgttttaatcaatgcatgcattgtggaagaatgtgtgcatggtgtcttgattgatgtgatttaaattatccttggttttggtgcataaacttatatgatgatcaatttagaaatgatgaagtattatatagtggaatatgatgatcaatttgggaagtagggagtattacatagtggaattaacggtgaggttagcattgaaatttgatttttatccctaattcccctttttgttacaagttaccagaattattagagtttacattagagacttgactacttgagcccttgtttggagggagcatgggattttgagtagctagctggagaggatagggaatagttaggtttctagcttataacttctaatttattttccgaattctacagctatgattcttgaaatctgcgtggaaatttatactttttgaggagctatagattttgaaagaagctacatctacttaaaaactcctccaaacgatacctaaatcttatgcaaaaatggaattgtgggatttgtctaaacaacatgaaaaaattcccttccaactcccacacccacaccatttattaacctcaaattcatcatatccatgatccatatcaacaaaaatcccataacccctaatcaaaggaagcagttaatagcctttcctctatgaacatttaattcctccttaaaaacttccccaaacctaaggcaaccaaaagtggccgacggctgccaatcacagtttatgcataagtttgtcatagctcatctgtacgagtagtatttctgttcaaccaatttgaagacggaaagatatagtttctcacggtagaccgatattacaattgttcacagctcagtaaactgaagcaagacagtatttgaacatgcgcaggtgaagtgcaccggctaacgtaggaaaaaaaacgaaacatatttcaggaaatgtgaccagttcactacaaatgcagcacatacatttacagacagtacacaattgttccagccagaaaaatctgttggggttcgtctggtatcgttcatcttgcgtgccggaaattttgacacaattggccagtatcactacaatgaaacagagatacatctcattgattgttaaaacttacaagtacagtgaaatgtgcatatgctaatggtatcaaacacacctgcaaaattagcctctgaagtctgaaccctgatcagtggatcagtttcattgggatcgaagctattttatcccattctggtccatccttattttgtagttggctcagcaacgttggcttgcaaccaatcagatgaacaacctgcagtgaagatgggaagccacttggcaaggactccaatccagtgcagttcattatgctcagttttctcagagaggttaagctgttgaagttggcagggaaagattctacggtgaccctggagcaattttcaatcaacactgtttcaagtgtggcaaaactaggcaatgaatgcagagaagacaattgggggcactgccgaatgtttagctcatgaaacttcgtcaagttgctcgggttctcaatctgtggaagagtggttattttactgcagtggactatatccagtaaggtcagcgattgtaaaccttgtaaacaagtacccaactcctcgtcagtcatctctaaataagatatttgcagcctcttgagggaagtaagtgcatgaagctcttcaaactttacatcttggcagtgcctcaaggtcaaatcaacaatttcctgcacttgttgctggtggaacaaaccattggtaaggacagcggcagaacatgtttccaatttaactttgttggcttttgatgatgaaaaagaagatagtttcaggtgtgacaca

SEQ ID NO: 34990 - DNA, 5781 bp, Oryza sativa
  unsure (1)..(5781): unsure at all n locations
cagcccaaccaacatggtgaggtattaccgtgatatctcctaatatgaatctcttcaacatctggatgtggtttaaggccttctaagacctcagcatcgacagaagggacacttttgccaggggagttccattccaattccagcacctttatgctctgtttcttgcttaatccagctttgctggcctcttctttgcttgctacaacatcaaggttcttgatatggagctttcttcggagatcattcatatcgttcaagtcttctaatgtatgacccttttcctttttaacatggaactcaattgatccctggagatggatcatttttccaattccgacaattttcgatgtgtttgtcctgtttatatccaaatggcggagatatttcaacttccacatgtcttttggaaactcctcaagctgacacctcttagggatatatagggtctcaagaaggaaaagttttgtcactgattttggaagctttgtaatcgtcttgcaaagagaaaggtacctcagatgtatcaactggccaactttatctgataattcaaccatatcacagccatccaaaccaagcacacggagacctttcaattccttgaggacatcatctggcaatggaacaacggaagatgaggaatgcttgagaataatgaatgtgcgcaacctcttgagctcggcccgacctttgagctgcatcaccgcatcactggtcacagataagtgacggacagtatcaggtatgcgtatgtcttttttctcaaactctacactttcaactcttgcgcagtcaattcgagagacattgtcggccaggtcatgcatcaggtcgtggatgtagtagtaagttcggcggccttccttgcgctcatggaagaatgattgtgccacaagttgattaaagtactccttccctacatcctcctccaattgattcttcgtatcatctggcctgaactggataaaacccagggccatccaaatcttaatcaacttgtcacgattgaacctccagttctttgggaatatgctgcatatcgcaaagcatggttggatgtgctcctgcaggttctgataacacagctccagtgtggagctaacattgtcatatatttccatcttcaagatcctcttccactcagtcaaacttggtttccgctttagcatgccaccgacaaccttggcagccaatggcaaccccttgagcttcacagcaatctgctccccaatttccttcaattccgggtgcctgtcaacatcattgttgtcgaaggcaaacttcttgaacaacaaccaaacatcagcgaactccagcccattcagccaaacaaacttgctcgcattcagcaagtctgccacaatcctcttcctggtggtaaccacgatcttactcccagctcggccaaatctgaggggagctaacacatcagcccacatatccctgtacgagttctcattctcatctttattccagacattgtcaagaatcagcaagaaccggcgcgacgagacggcctccttcagccgccgctgcagccgatcgaagctattcgtgtcgtcggggagttccgcggactgcaggatttgcttcgcgagatcgagcttgctgtaattgcctgcgggacacacccacatgatcagatcgaaggcctccttcacctcatgatcatggcacaggacgcgtgcgagcgtcgtcttcccaatgcctccgagccccaagatagcggcgacggggatggtgtcatcggcggcggcgctccgatcctcgccttcggcttcgggcgtgctgccgattagccaagacaccaattgctcacgctccttgtcgcgcccaaacacctcaccatcctccagaatcgagccggtgaccggaccatccgaggttaggagcgtgctgctcggctcgccggaacctggcttggtcagccccgccgcctgcatcagccggccggagttcgcgcggatgctgctcagtttctccacgacggccttgagcctattgaccgactcgtccttgccaacgagctgcttgccgatcttgccaatggaagaagaccctagtaggctgaccttgccgtcgttgggggcgagcctccggtaggcgaactcgtcgaggacgtcgtcggcctcgtacaccacctccttgagctggcgcagccagcgtacgagctcacagttgcctctcccgccgccgccgccgccgaggcagcgctcgacgcagcccgcctcggcgcggagctgattgagctcatcctccagctgcttgagcgcgtcggggacgccgccgttgagccacctgaacctgtcggaggcgcaggacctggccttgtcgaccactatcctgatgaccgggcacaccagccagccgaccaccgccgcctcccccatctggtcagtcggccgggccgccgtcggagagcgaagcaaaccgcgggggagattgcggacgaacagtggtggactggtggtggtggcgagtcttccttcaagtcaccggctatggcagagagagagagaggaggggtttgggtgggtggtcgggctgaggagaaaaccatttttggggcgtataccctcgccatttcggggcgccttccccttccggcgaccgggcggagaggggcgttgactctgaccggttcacgccgctgggcgctggcgccgcgcgggcgtagggtctctcccgcgactcgcctcccgttccggccacgtctgctcacccgccgctgctggtgtggcgccgcgccgcccaccgggccacggtccgccacagagctcgccatcggcggcaggggcggagtaggtgatttgggccgtgccgtgccggcccaccatgctggggcggtggcccaagcacggcgtgccgtgccgagcccggtctggcacggaaggcgcgggccatttgtccacctataggctggaggaataagttcacttttggtccctctatttgttgcccagtcccattttcgtcccttgaccataaaactgggtatgacccgtcctccaacttacgaaaaccgggtaaatgtggtcactctatggttttgaaggcagttttcgctgacgtggcgcctacgtggcttgtttgactaggtcttcgtcccacgtgacattgacgtggcacttacgtgacaattacatctcgaaaaaataataaaaagtgtggccccacatgtcagctgcacacacaaaaaaattaaaataatggggcccatgtgggccctacatgttaccctcactcctctcttcttccctctcccttctctctcttcttccctttcccctctctctctccttcccgggcagcggatggcgcgggtgggcggtggagcaagcgagctctgacggcagcggtgggcgtggtcggcgtcgcgccttgacggagcgcccccggtccgcgtgaaggtgagcagtgcggtggcgccctggaagatggcgatgaggatggcgaggagaggggaagccgaggggggaaacgagcgacgaggaggaggacttccttgtcgggtccgcccgggacgccgccgccttcttctctagcgcagtgctcactgctggggagccccccctcccagaatccgccgccatccgtgtcgccgccgccgaccacccggacgccgacctctaggcgccgctccctcctctcccgccgccacgcgccgctccctcttttcctgccggcggccatcagggagaagggcggcggacggctaggtgagcagcgaaagagagagatggccgccgccgccccacaagcctcgcgcgtcgtcgcctgccgccggccatgcgctgtccgttgccacgccgcccgctgccggcgcgctgtccgccgccgctcgccgctggacaccgcccgacgagaggagggagcagagagatggggagagccggagagaggaggaagaagaggattggatttggtcatttgagaatgacatatggggcccacgtgggccccaccatatttatttttttatgtagctgacatgtgggacccaccattttaaaaatttttcctgtggctgatatgtgggcccacaatttttattattttttcgatatataattaccacgtcagcgccacatcaatgccacgtgggacagaaaactaatcaaacaagccatgtatgcgccacgtcagccaaaaccaccttcaaaaccaccgagggacctcgtttgcttggttttcggaagttgggggacgggttgtacccggttttgcggtcaagggacgaaaatcggactaggcgacaaatagagggacccaaagtgaacttattcctaggctggaagttgggtggtgatgggtcagggtccatgggctctttcacaacccacctcaacccttaagagcccctttaaatctgatgaatgtaaaaatggagtatgaaaaacacgggattctaataagaatgtaagtgcaaaacagatgattgtaaaagggaaatttccaagaggttagagctattgctaaatttcttacaaaatctctataggattgtccattccatagggatttcaaaggatcacataggattcaatcctttgttcaaaggccttaataggaaatttttctataggattgaaattctccgaaattcctatgtttatcctccgaatcaaaggggcccaaatattttcagcacaaaaactacttataattttcagttcaaccattcttagatccaaccgtcacattgtgtaggtcaaaaagttagacccattaccaccgttgcgcaaaggtagaaaggagtgggccatgacccatgtatgtggaggaggcgtaggagtggcagaaggaaaaagtccattttggcccgtcaccgtcaactattgatcgaatctgattggtaatcactcaaccataaaaccagagatatcgtatcccaacagcttgtttggtaactcgagggaaggggattaggagtttacacgagggaatttatgatgagattaatatgggaatttgatttttaatcccaatatcttgtttggtaggggtgatagaaattgatagggagtttaattggagattaggtcattaataaaaacggatggctgagatttgtttagacaaagtaaaggaggaattccctcccaattacctgcccctacctaggtattgaaaaggtgggagttcctttctcaattccccatccccatcccaccaaaattcccatgtctcccaaccaaacaaaacatttaatagcctcattcctctaaacttccaatccctcctgaaaactccctccaaccaaacgggccacaagtgttaaaaccagggcccaaaatgactcccttgattttagggttgttttagatgacctgttgtaaagttatgatcaagatgatgagtttaggtcaagagttgttgcttgaattcatcgaaagtggtgacaacaaaatgtgacggcaataaaaaggagaatggagtaaacaattctgaaggattggaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34991 - DNA, 481 bp, Oryza sativa
tgggccccaccatatttatttttttatgtaactgacatgtgggacccaccattttaaaaatttttcctgtggctgatatgtgggcccacaatttttattatttttcgaatataaaattaccaggtcagcgccacatcaatgccacggtgggacagaaagctaatcaaacaagccatgtaggcgccacgtcagccaaaaaccaccttcaaaaccaccgagggacctcgtttgcttggttttcggaagttgggggacgggttgtacccggttttgcggtcaagggacgaaaatcggactaggcgacaaatagagggacccaaagtgaacttattcctaggctggaagttgggtggtgatgggtcagggtccatgggctctttcacaacccacctcaacccttaagagcccctttaaatctgatgaatgtaaaaatggagtatgaaaaacacgggattctaataagaatgtaagtgcaaaacag

SEQ ID NO: 34992 - DNA, 1424 bp, Oryza sativa
ttattccttgtcccaggaggcaaggtacaccaaaagttgatacatttcagagtttatcaattctggtcaattctggtcaattctggtcgtgacaggccataggcacggcggagcggcggccgagagaggggaagggaagggggaaaagaagcggcggtccacggctcaccctaggtcgacggcgacgacgaaaaacgcggccggagcggaggaaggtggcggcgcggttcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctctattccggcgaggaggaagggcggcgagaggcggaaacggacagaggaggtgcggggagggtttaaatagggttggaagggggagagagcggccggcggggaaggaataggcgcgggaggtctggccgccatcaatggcgccggcgatatttgcgggggcaaatccgcccgtttgaacgcgagagagagaaggaaaaatgggggaaaagggagaggggatcacggggagtgatttccccctctttattgcacgtggagacggcgggaggcggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgtggggagaggccggatgggccgcggggagaggagagggagggggaggtagatgggccgagccggcccaagagagagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacatggccgccgccggcgaccataggggcgcgggcgccgcctctcgctggctgcgccggcttggccgccctcgggcgcgccgagtggctgacgcgtgggacccacggcgccggtcggtgtgagcccgggtgcacccggtccaccgtggaccgtgaggctgccgcgtgggccccactcccgtggacccggtccgcgcgccccctcccctcggctgacgcaataagcccttttaaaattaaaatttaaatgaagaaattcgcaaatattcattt

SEQ ID NO: 34993 - DNA, 15325 bp, Oryza sativa
cggtgagccgtggaccgccgcttcggtttccccctttccctcccctctctcggccgccgctccgccgtgcctatggccgccgccggcgaccataggggcgcgggcgcgccgcctcccgccgttgcgccggcgtgcccgccttcgggcgcaccgagcggctgccgcgtggggcccggctgtcagccgcccgcaccctcgggtgcggctgacgcgtgggacccacggcgccgtccggtgtgagcccgggtgcgcccggtccaccgtggaccgtgaggctgccgcgtgggccccactcccgtggacccggtccgcgcgcccctcccctcggctgacgcaataagccctttttaaattaaaatttaaatgaagaaattcgcaaatattcatttaaagagcatataaacttcaaatggtcataacttggccatttgaactcggaattggaccgttcaagtctctaatttttccttaagaagtcaagaacccatttttgtgctttgttcctgcttgttatatggagtttagaagagtaaaagccttttcttttttttcgttggtcgtgtagacgccgcagcttcggaagatccgctcttcgtggaacttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttattatgaccttattattgttattgttattatttccttgttccccctagaataaacaaaaccccaactagtggacactctactcatggtactactagtatgattttaggtagatgcttcgctggttaattaggcaacattaggtggttttacaactctagactttgggaatattctcatcacctggacactttggaatggatggattattgtggaattggattcacacctccccctctattcaaaatcctcaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggattaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaattttttcccaaacccagaagaggagcccctggaagatgaaggctttggtgtctagctcgtgcctgccgtcaagcgcctgtggtcgtcgctctagtcttccgctgtttcccgtttgtctttgtgtgtgctgggccttcgccgcccatgtaataaattaactatttacgcttccgcttgataaactctgaaatatatcaacttttggtgtaccttgcctcctgggacaaggaataatacacgcacgtaaggaacgcccgttgggttaattccggtcgtgacagaacgcgttagcaaactatttgccgacggcgttgaaaggttctgcgcgttcgtggctgatgcacctcccgccctactcgatttcttcatgggcagatctgtggcagcaattcatcaccaacttccaaggaacttacaagcgccacgcgatcgaagacgatctacacgcgttaacacagaatccgggcgaatctttgagggactatgtttggcgctttaatgagtacagaaatacaatccccgaaatcaccgacgcctctgtgatgcgctttgaaaaccggtgtcagagatcgctatactacccaggagttggcaacaaggcgaatcacaactactcgaagattgttcgaggtcgtcgatcgatgcgctcacgcagacgatgcactgagacgcaagaatgacaagctgaagacagggggagagaagaaaccaaccaatgacgcacctgaaccaagcaagaagaaaagtggcaatagtgggaaaaggaaagctcaagcggaagtccttgcgtcggaatacgagcgccctcccaaacacccagacccacaaggcagcgacacgaagagaatatggtgccccatacacaagtcgaacatacattctctagaggattgcctcatcttcaaaaagtcgctggaaaagcaactggcattggagaagggcaagtgagtacgtgtagtcgagaaggccgctgaagcaaccactcaggactcggactcggcgtacccagattccgatcttcatgtctcgcacatcttcggaggttccacggcgtactcctcaaagcgagaatagaagaaagtggagcgtgtgaaagtgcattaatccccctagtgggttttggtgattaatgacaaatgtggttaagggactaatgagttcattgagtgactttcaggtgcattagtccaaggtgtggaagatggatgcttggagacccccaaaaggtacaaaatcaaagcggaccggaactcgagaagtgcataggatagtttatcttttgaaattgagtttttaggaaaaaccgtactattaagaggggttccaggtgatgctctgagatatatcaagtgctcttagtgtgaactaagtgtcaagtttccctaggagtcatttttgcaaatactccatctgtccaaaaatgcaagtccggaacttcctgtcttccgggtccggaagttccggtcttgtgaaaaagattttcctaagtgtagttcggaagttccggtcttccaggtccggaacttcctgtctagtttccagttcaaatttgtgagtaacggctagatgacgtcacctagccgttatacatatacagctagtttccagctcattccttggccattccactttcacttttcacctagagctattgctagcctctcccaagtttttcttgccttctccactcaatcaagagcctaattcttgtgagaaagagagattgagagggagagaagaagatttggagatgtgtgaagactaggatcttgggtgagcacttggaatatctcgtgggatatcatctcggtgcttattactcttggagatgatctcctagacggttaggtgtcgcccgcgagaatccgttgcatattgtggatgtcccgggtaagtttgtgaaggatttcctctcctccgaaagggaacaaggtaagttagtgaagttcttgtgctgagattttagaggctttccaagtagagaaatccacacttgtggtggatttctagaagtaggttgagttggatcttggtggtcactcaattctagaaatttgcctaggggtgtttggtgttgaaggctgtggattttctctggggtttttgcacaagtgacgcaaggggttaatcgagacccagctctttggagctcctcaacggagagtaggatcgcaagattcgaacttcgggaaaaaaatcgctcttgtctctttctgtgatgcttctgtggatgattctgtgatatatcctctgcttagaatacctgtgcaccatcttgtgaagattggcttagtctcttgtttcgaaatttgaatttcatctctgttctgttacccggaagttcctgtcttagaacaccgtaagtttcgggcctgggaggccggaagttccggagttccttaccaggaagttctgggtttgtttgaattttatcgctgcgatttgtttttaagctttcagggacagcctattcacccccctctaggcttcatcagcacgttcagcgtgaagtttgttcgacatggcagggggctgcacccaagatgaagtggtctgaacagaagatcgagttttcagatgaggaccaccccaaggctgctgttatcccaggacgatatccgatcgtggtcgaacccactattcggaatatcaaggtagcgcgagttctcgttgatagaggcagctccatcaatcttctcttcgccagcaccttggacgcaatggggattccacgaagcgagttgacacctactgatcaacccttccacggaatcactcctcagtcatcgtccaagccattgggcaagatcacgcttcctgtgactttcggcagagcgagcaacttccgaacagagcagatcacgtttgatgttgctgagtttgacacagcatacaatgccatcatcgggagaactgcactcgcgaagttcatggccgcatctcactacgcgtatcaagtgctcaagatgcccgggccgaagggaacaatcactattcaagggaatgcaaagctggcggtccaatgcgacaagcggagcctcgacatggtcgagcacactcccagcccacccgccacagccgagccacccaagaaagtgagcaaaacaaccaagacgctgaaaccagacggtgcaatcaaaatcgttctactcttcagtgccaaccccgtcaagacagtcaagatcggggcatcactgaacgagaaataggaactcgcgctcatcaccttcctccacgacaatgctgacgtattcgcttggcagccgtccgacatgccgggggtccccagggaggtgattgagcataaactcatggtgcgacccgatgccaagccagtaaaacaaaaactgtggagatttgcaccagatcggaaacaggccatacgagaagagctcgacaaacttctcaaagctggtttcatcagagaggtactccatccagagtggctagccaatccagtcatggtgcggaaggccaacgggaggtggaggatgtgcctcaacaaggcgtgccccaaggatcacttccctctccctcgaatagaccaactggtggactcaacagctggttgcgagttgttaaacttccttgacgcttactccggctaccaccaaatcagcatggcaaaagaggacgaggagaagacagcattcatcacgccgttcagtgtattctgctacgttaagatgccgtttggactgataaccgcaagaaacacttttcagcgcatggtccaaggggcacttaacgatcagcttggaaacaatgtcgaggcctacgtcgatgatattgttgtcaagaccaagacaggcaactcattgattgacgatctatgggaaaccttcgacaacctccgacgatatcgcctcatgctcaatcctgagaagtgcacgttcagagtaccatcgggcaagctgctcgggttcctcgtctctggcagaggaatagaagcaaaccccgagaagatcaaggcaatcgagaacatgaagtcgcccacaagactcaaggaagtacagaagctaaccggatgcatggcggcactaagcaggttcgtcgctaggatgggagaacgaggacagcctttcctcgctctactgaaataataagacaaatatgtatggacacaggaagcagaagaggcgtttatcgcactcaagcgcaacctgtcaaatccccctgtacttgtttctccccaacctaatgaagaattattcctctatattgccgccacgccctattctgtgagtactgtcattgttgtcgagagagaaaaggtgcaaagaccagtctactacgtcagcgaagctctccacgacgcgaagacaagatacctacagatccaaaaactgctctatgcagtaatcatgacatcaagaaagctacgccactacttccaagcccacagggtcacggttgtctcctccttccctcttggtgaagtcgtgagaaacaaagacattgtcggccgcattgcgaaatgggtagtcgagctaagccagtttgatgtccactttttaccacgaacagccatcaagtcccaggttcttgccgacttcgtagccgattggaatatgcctgaaaacaggttagatagtcaaaccgacaacaaaacatggacaatggcgttcgatggcgtactcaacagccaaggagcaggtgcggggttcatcttgacatcaccttcgggagatcagttcaagcatgcaattcaccttaacttcagggcaaccaacaacacagccgagtacgaaggactactagctgggataagagctgcagctgcacttggagtcaagcgactgatcgtaaaaggggattccgaactagtcgcaaaccaggtgcacaaagactacaagtgctcttgccccgagttgtccaagtatctcgcagaagtcaggaagctggaaaaaagatttgatgggatcgaggtccgacacgtatatcacaaggacaacatcaagccggatgatctagtacggcgtgcgtccagatgagagccactcgaacccggcacctttctggacatcctgacaaagccatcagtgaaaaaagcaaacgacgaagatagcccaatcggccccgacatcagctcgggggctacagaggtagagcgtgccattgccaacatcgagaccacggacgactggtggaccccactcattaaattcataagcagtgacaagttgcccgaggatgatacagaagctgagaaaataacccgtcaagcaaaaatctactgtatgatcggcgacgatctatacaagaaggcgccaaatggggtacttctcaattgcgtctcgtccgacgacggccgacatttccttctcgacatacatgaaaggatatgcgagtcacacgccgccggccaaacattggtcagaaaagcttttcgacaagggtttttctggccaacctccctcaaagacgtttgcgacatggttcagcggtgtaaagcctgtcaatttcacagtaaacacacaaagctaccagcgcaagcgctccagactatccctcttacttggctgttctcgtgctgggggcttgacatactcggaccattcccacgaggacagggcggctacaggttcctattcgtggcgatcgacaaattcactaagtggatcgaagtgacacccacgagggaaatcaaggccgaaaacgccatcaaattcatcaaagggatattctgcagatacggcttgcctcaccgcatcataacagacaatggctcccagttcattagtgccgacttccaggattactgcatcaggctgggagtcaggatctgcttcgcctcagtttctcaccctcagagcaatggacaggtcgagagagcaaacgacatagtactacaaggaatcaaaacccgtgtatacgacaggcttatgtcacatgacaagaaatgggtcgaataactcccatcggtactatgggccgtgcgcaccacaccgacaacgtccaacaaggagacacccttcttcctcatgtacggcttagaggccatgctccccaccgagctacgatatcagagtatacgagtacagaagtactccgacgaggatcaagatcaacagtgaaacgacgacgtgaacctactcgaggaacaccgagaacgagttgccgtcagggcagctagctaccaacaggcccttcgccggtatcacgagaagcgcatccaagcacatatactttcgatcggcgactacgtcctccagcgagttcaaagccaagcagggcgaaacaaactctcacccaaatgggaaggaccgtacacgatcacacaagtcttgcagccaggtgcattcaagattgcagatggcgatggtcgcgagttagcaaattcttggaacattgaccaattgcgcaaattctatgtataagtcaatagtatccatacttgtaagacatcttacaacttcaaaaaagcctattttcaggtacatatttcaatcaaagtgtcccttcccgatgatcccttacccagatgacacctagcgttgaaacctatcctcatgtccctttacgccgtcttgacaaggccgccgaggaacctaagggaacttcggctggggacgtccagagctgataaggccttgtcggattctgtagagacgaaagaccatgtaagacctagttgtgtaagagttctcgccgtgcgtattaatcaagccgtgtaatcggaaatggactttccaacttcacggctgggggctaggatcagtgcttgttcaactaaggcaggttaaaggtccaagagccttatcttccgagaagaattctccgatgataaggctgggggctagggagagtgtatgactcaagtgactgttcgaagtcgcgaagtgagaagacactcgtacacactccatcaagagtaagaaagcttagttagatagatttcttttctatttcacaagtatttcttataacccacaaaaaattcaaaatatattacactctaccctgagatacttgtcacaggatacggagtctaccaagaaggccaacgccagtccatcgactggaagactttctccgcaagcggcgccatcgacttcgccagctggtctatctccgcgggagttctccgagaacgtgcaaacccttcgtggaggaactcgaggtgcagctgcggacgatgatctcgtatacaggccagcacgtgccctcccgcatatcggctcgaccgacgacactcttgcttcaaggcctcatcgatatgcttgccgataccttcaagctgggcgtaggccccattcagccacgagatgtatccagccgcaaattccttgggatacccgcgaggtactcggagttccttgcaaactcccgccatggctgtacaacaactccggaggtacgagttgaaccacacctcgcgacctcgaagtgcttccacggcccgatccttcttcacttcttacatagtcccctcgagttctgccacctcaaacttcgtccttcagtattgcatgcgatgatctcggtcggcaagcacactctcgaggtctgctcagcatggaaacgactaagtcaagctgtccgcctctctcgagaacatggtaaactaagtcaatccaaataaaagagcgaagggggtggaaacaaaaaggaccaacctaaggaagtcatcgccatgcccgtttccacgggcagattctggtccacgacgtcctgtggcacatacggctcaagcgcaaagtgccggcacgagtacaggcaactcaggctgcccgcgctgctggacatcctcgacatcgacatctctacacacaatagcaaagtactcggaatcaaaatgctaaagaaaactaaggtgataactgcacacacaaaggcagttggaaccgacgaaagttttacagagcatgattgattaaagagtacatgcaaactgaagtcctactctttgaaaagtgggagaacagactctcccagatcaccgactttctccatcacgtccttacgcgcgttgttagtagccccctgatcttagatcctctggagatcgagttcagggtgtgccaaccatacgcacgcgaggacgtggcacatcccggtgtagatcctgttggacttctcctccccgatcctggccgcatgcctagagatcgcctccatcgccgtcgccagttccgcgagcgaagtcgtcagcgagaactcgtcggggttcgccgggatggtggtcgtaacaccacactcccccgcgagctggtgtaggccggtgtaggtgacccccagcgaaacacggatctccgacaggttgttctcgagttccgacatgcggttctcgagcccctaccgttgccgctcgttgccggccaccagctccctcattttctggaggtccttgcgaacctctgccaagtcacgtgccagcttgtcggcgcgttctttcgccgacgacgccgccaccgccctcgcctccgcaatctcgcgacctatgctgcgagcgccggcctcgaggatgcgccccatctcgacatggagctcctcccaggtgaggacgtcagcaggcggacctcgagcgggcacaagatcactggcaggactgctgggcgttacctcacggctcctgggcacgaccacgacatctgtcgaggccaccgcaggagacgcgctggagttccctccggacccatcttgcaccgccttcgcccgcgctgccctacgaaagattgccatgttggccatcaaaacaagctgccagaatttcgtccacttacttctcgccaagtatcaccagcctctgctgtcgcggaggcgggggagacacatccgaggcctaagtaaaccgagtacgatgtgaggacgacatcttccgactacgcaatcgataaccaaagaggcttaccgatggggtgggcgttttctggcggttgccgagcacggaggaaaacttcctccctttcctcggaacattgccgcaactggtcgtggcagcagcggcggcaatggccacgtcggacgcctcctgggcgacgccctctttcaacaaagccgcagcctggtggtccacgagcggcccaatgacgttagtcagagggagagcctgcaccacatgaagttaggatgcgatttaggaagaaaaagataaagggtcattgattacactcacgttgattgcagcttcgcgctcagccgcccctttctcacaaagaggggcggggacgttgctcgccgtcgtggggccgctgaccatcacctggccgacacggtgctccacggtctcgctgttcaaacctgtagatcgggaaccagattttgataagtcaggaggaatgtgcgcgtaagggagggaacccagaatgcaagaaaaatacctcgaggagatactcgggtctcgtcctccggcccagagtagtcaaaggcgggatgggctcgagcctggagcggctggatccgtctaccaatgaagtcggcagcgacttcataccccgacaaccctcgtactccgaggtcatcgatgatatcaataaaagactgaagggatggggtcaaggcgggtttggcggtccaagacggaatcttatctggttgttcctcagggacaacgaagactgcatccgaattctctatttgaagatagaaccacctcgcccgccatttactacgagaagaggggcactggaaggggatgtatcgcgacttcaggccatcccgaagtccgaaaccaacacacccggatacctttttaggttccatccagcgcaactcgtagtagaaacgaaagaggtcaagaaacggctctaccccaatgtaggcctcacagatgtgtgaaaaaatgctgaggaaggctatggaattggggttcagatggagcacagaaagaccgtagaaattcaagacgagaaggaaaaactcagaaggcggaggaagaaaaccacagagaatatagtcctcaaccgcaaccatgcggcccaagacgggttcaggttcagtacctcctggtttcctctccatggtcccgtaaccggggagagcgccttcctcctgcaacttcttcagggatgcgctggtggaagtggacttgtcgaggtccattgccgccggggatcggcggagaagagaccgagacgagtaagttagggttcgtgcggaagcgaaaaaaacgaagagcgtttggaggctagaaagttttcgcaacaagcggactccaaaatggattcacaaaactcccttaaataggcacactaccgacggtgcgaattccaaggaaaggagatagatggccgccggaaatttctgggtccgttacgcgcggcagttttggaacttcaatttaaattcactcataaccgttgaacttcgcatggtgttgtcgactattccttgtctctacggttcttacaccgagaacgaccagtcgagaacgacaacaactccaacatcagaagtcgcgatcggttacatgagttcatttaagcagaagtcgggggctactgtcagggttacggataaggcataccctctacccttggatatacgctatgcggcaatatggtatatctgcgcgtgtacggacgttctctgtatacgctaaggaaattcatcacgaagtccaccgatggaaagattcctacccgtataggactgggtcgtcactataccgtgcagggtccgatgtctccgagttctacttggaaaccacctggcttgcgatataaaagggacccccgggaggacctaaggcatcgaatctcatagccaagacaaccaccacagcctacgaagccggagcctacaggagccaagtcgccgggtgatctagtcgaaccaactcgactacgatctcgtcggtatcatcgagttctgttattccctttgtaacttgtggtttccactatataatcccataccaactggattagggctattacctatcaggggcctgaaccagtataatccctgtttcctgtttgcttgatgtcgtactacgtagatcctcatatcaacgtacctcaataccctctatatctggtttacgggtatccccgtcgacaatatgagagaagatataattatgatagccgcacacatcatgctagttattcttaaagtgacaaaacatttttttataaacgatgaaacaacgttcaaatttgaaacaaaaattaggcacccaatttataatcgttacccaatggactccctcctccctctcactctattggtgccaggtgccattagtttgattcaatatggctgtgttcgcgatcctacaagttcacatcttttattggcttgtttttcacgcgaataattcccaaactactatacgatgtgtttagctaatacttagaacatagtggacacatcttaataatataaatctgaacaaaccttctgtctgagatttctaataataggatatgtctcctctggtattgggttattattttgtgggacgtgaaactatgtggtaatgagtcgtttcattttacaagtataggtttttatgggccacagcccaaaggacttttgggccgtatgagtcacccgtctcggcacccgcatatatacggccagtgggtccaattgacgagccgttcaaacttccttttgtgatgcagccatttcgccgatcacgacgaacggcaaagtatatgtatatatatatatatttttttgagaaacacaatacaaacgcaggcgctcacaacgtgtgcacactcacccctatgaacgcacacacgcacaccctacccctatgagcacctccggaagactggaccggcatatccctacccctatgagcacctccggaatactgggccggcctatgagcacctccggaagactcaccccttatgagcacctccggaatactgggccgacctatgagcacctccggaagactcactcctatgaacgcacacacgcacaccctacccctatgagcacctccggaagactgggccaggcgcctcgctgtcgatgggtacgtcgcctaccactgaaagaataattagccgtaaatgcgagcacccgtatcaaatctaggatttaaacccgggtgggctgtttccaccacaagaaacctagccagttgagctatgctcacttcacgaacggcaaagtatataattcttcagttccaaaaaaatttcttcatgtttcgtttgctcccggtcctggatgcctcaagcagtcgtagattatcagactatatagaacggccggccaaggaagttaatattaagttgggatcgattggacggcatactaattaataccgaaattctatccaaaactgttagtctcatattttcgcttatacttatacttatgagaaaaaatttaaattttcaatcttaaatttgtagtcgattttgagtttttcatcgaagtttattttttagcatttgcctttagatcactaagaacatttatataaaagttttatagcaaattatttttgtttgtaaatatatatgttgaataagccaaaatacgtatgttttaatgtttaaattttgcgatgactgctagtactaactaccccatgctgctagtttatcacagctccatcgtagagtttttttttcttcagtgatcatgacaacccaactaagctagctagctaccagcagctgcatgaatactagttgagatttgataacagttatgtttaatttgtaatggttgccagctagccttactgcgggatttgctagttttatcatataatgaaatcaatgttttaaatgattagatgcaactctttgtatatacaaaatagatgataatacggcttcatatatagcttcttttattacaatacaattcatgttttattttttgaaacgccattgtgtattgttatgatatatgaaagttattttcatgcacaatctggtagtgtagcactactctacttcatcttaagcatgtttcaaaaatgagtttggattcatgatacctaattattgtatgttatccaattgtttataacaaaacaaagctcacatcttatgtaataattagagttgtatttagaaaaaaaatattagtattatctttgaggatttggatgtacagaatggataacaatgtcacgcatgattatgagctataaggaggtgaatggatgattagctagcttcttgatccaatggcttaaaattgttgatgatgtggcttcttacatgtcttgttttatatgagcaaatgcttcttagtgggtaccaactatataggaagataggagtgaacccaattaattaaacaacatgcagcgagccacattatttacaaaagagtggccattggattaccattacttctaatcacagccgtgggatcagctctatgtttaacgacagccataaatgtattaattgtagcttaacatacattgagaattttattaattgtcttgctttgatttaatgtttttttcctggtgttttagaaggatttctattgcttcgggata

SEQ ID NO: 34994 - DNA, 8472 bp, Oryza sativa
ggcccatctccattccgggtctctctctctctctccctctctctctttccctcgttatgccggcgcgtgccggaaccgcgcagagcgcctcctccctccagtcgctcccccctccccgcttttatcctggcgagcaccccgcccgcgaaatcggcccccgcgccccgttgttcgcgcgcgcgcgcccgcgtggtcgccgcccgtcccgcgcttgcgccgtttgagtcatccggccccgctgccttgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcttgccgcgcctgcccgcgcctgtcgcccgtgtcgccgcttcgctccacaccgcccccgccgtcatcgccgtcgtcatcgccctgcccccgccactccacgcgctcgctccatcgccgtcgtcacgcatgattatgagctataaggaggtgaatggatgattagctagcttcttgatccaatggcttaaaattgttgatgatgtggcttcttacatgtcttgttttatatgagcaaatgcttcttagtgggtaccaactatataggaagataggagtgaacccaattaattaaacaacatgcagcgagccacattatttacaaaagagtggccattggattaccattacttctaatcacagccgtgggatcagctctatgtttaacgacagccataaatgtattaattgtagcttaacatacattgagaattttattaattgtcttgctttgatttaatgtttttttcctggtgttttagaaggatttctattgcttcgggatattctgtagcgcccgttccgtcgtggcgcctagcgggaaaactatctcttaaaaaccctatttgcgaaagctgtttctttgcttgtggtctagtgtccgtgccatctcagatctcaaatccccgatctatcatcgaattcaatcccgaatccaaatccttccaaattaatccctccacaaaagtctatttcgcctcccccgggttcgatgggccgaatccctctcggcccatctcccttcccggctctctctctctctctccctctctctctctccctcgctctgcccgcgcgtgccggaaccgcgccgagcgcctcctccctcccgtcgctcccccctccccgcctctatcctggcgagcaccccgcccgcgaaatcggcccccgcgcgccgttgttcgcgcgcgcgcgcccgcgtggtcgccgcccgtgccgcgcttgcgccgtctgcgtcatccggccccgctgccctgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcctgccgcgcctgcccgcgcctgtcgcccgtgtcgccgcttcgctccacaccgcccccgccgtcatcgccgtcgtcatcgccctgcccccgccactccacgcgctagcctccaagggacggaggcagagctcctcctccctctgccgcgtcgcccccgctcccctcctccttttcccaaagaggcaaggggcaagccccctttctctccctccttttccccttttcctcccgccggcgtcatcctccctccgccctgtcgccgatttggccgctagccggagcgccagctcgctggcttgaccgtccaaagtcggttcccctctcccaaaccgacattgccatcctataaagcccaagcgccctccctctcttctcctctcgtttgtcccatcgcctccactccattgtcgccgcctcccgtgctctgttcgccgtcgccgtttgtcgtcgcgcgtgtcggaggagccggcacgagcgaggacgcagaaggggactccgggcgcgccctcttcttcctcttcctcggcccgaggccgaaacgatcacgtttcgcgtcgtcggctctcgtcactgcgcccgcccgcacggtagcgcatttccccgttctccctcttcgctccatctcctccccttagactcgggtagtagcatgagtagcctccccgtagctagccggcgccgccctgacggctgccgtcgttcgccgtgtgctcgccaccgtcgccgcccgagctcggaagcgccgctcgtcgccggcctcgctcgacgccgctccgcccaatccaacgctagcatcggattcccgtagccgcgtagatgctctcgccgccgggaatcggcccctcgtgacctcgtcaccgtttcccccttcttccgccgccggttgccgccgccacaatccgccgccgtcgagcatcccccggcaaatccaagccgttggctcgactcccctcgtcccgtgcaacttcccggtgtgctcgctttcgcctagatcgccgtgtttcgctccgccgctcgccaccgccgtccgccgtccgttccggccggcgtcttcttcaacctcccgccggcccgcgtggctgccacgtagccgccacgtcggcgccagctcggccaagaccgggtcgagccgaccccggtcagccactccctctggccccgctcgcgggcgcggtccaccgtgagccgtgaggctgcgcgtgggcccgccgcatccgcgtccaccgcgaaccacgcgcatgcaccgcgccccgctccacaccctagcgccgcgccgcgtgctccctccgcacggtgagccgagccgctaacaagcgggtcccaccccggaccacgcgagatggactcggtccaccggcgccctctctctcccctcctgcgccctattgggctgtgtcctcttgggccggccgacccatttagctcggccgagccgccccttttctctcgggccgcgccctagccgcccgagggaagtctacttcccctccctcttccttttcttttttccaaaagggtttaattaaatcctttttcctttagaccaaaaatccattaatcttagaaaattcaatatcttctcaaccgtaagtccgtttgactccgttcaacttccaaatttcctcaaatctcgagatctatctaatggcacgcttagggggtcattaatggggctttattttcgccgtttgttgagtcgtcccgttttgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcacacttaatctgcttgtcccgtctgcaaggcagattggcggacctacctaacttgttgcatctgatccttccattgttaattgttgtatcatgtccccttgtaaccatctagttgcgcctcgatattcgtgcactatgtactcctactctataataaagagacctctgttgctgtgatattctgtcttcctgtggtaccagcactgtattcctgggactggtatcgattaacaggttaatttggagcgtcacgggctagtctcgctcggggctagttcggggcgtgacatattcattctataatcaattcgatccccggccgggccaatccgcctgaaaaaaggttgtttgggtttacgtaaaggttgtttgaatttacgaaatgtttgcttggatttatgaaaagttttttttagatgtatacatgattttttttccaccgccctaaacaaaggacgggaagaagatagtgaacatatcctctaaattgatcatccgtaaaaattaggagtaaagtattgataccaatttttttagataatggaatgaaacatcccggcctttactccaaagagctatagccaattattacaaatagtaacacacttatataaagtcttaatccaaaataaaacgatcaaaccaaccaaaattaaaagaaagacctaacatgacaaggaaaacattattccagcctattagagaatctccatccatgattagcaaaagattgcataaccgttgactcaagagtacgacatgcaacattcaggaaaactccctcttcctcacacttttgtagttgaccccagagctgaagtcaatatgttgtcctgaaaattacctacacataggaaacagatggtgatttgtcaataaccctatcaaccaattatgaggaaagttttaataatgagtgtttgcagaacgccgccggttcattttgttttttcaacagaatcttcaggtgtatttggtttttaagagtgatgaaatctgtttcgtagtcataagaggttcacaggtcggctgtttggttttaaaaagaacaggggtatttggttttaaaagaacaggttctttatttttctttttttaaaatacagtacaaacacaggtaccctatcttaacgtgcggcaaccactgaaaatccatctggatcccatctctcaacgtgtggcaaccactgatccatctggatccattggtggtcgttcatcctgctgatcagttgagtcgccagaatgaaacaaaaatggtttgatgttttttagttagtggccggctgcggacactagttcatgcttgcataaattattatccttaatgcttccatgaccagctaatcctaactctctactttagggcacccacaatgattatctataggctctctacaagagatccatgtcagcatattttcctacttggaatgtattaaatgaagagagagagcaaaactatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtactcttatataagcctcgcactgtcgcccatacagcgagttggttgtggcatgtgtaccttcacttcagagggagcttgaaggaggcacactttgaaccttgagcctagaggtatgcaatgttgttaatactcttttttttaccacagggaagtgtgttatcctatcttagtataaagttatcccccactaactccttaaacttaacatgtaaagatgtcacatcatcatccactaacaagatgccacatcatcatccactaacaagatgctacatcatcatccactaatccactaattaacaagatgtcacatcatcattcactaacaaccatcacatttaaacatcatacaaacatgctatatctctatagtttttataatttaagaacttttcaaatacaaacatgttaaattatcatccaacataattcacataacgtttcaatgtatatttttattatgttttatgatatcctatatacttatatatttcatccttacttagtgcttaaatggttaatctatggtccaaattatctttcttcttttttttctctcattaaggcatatcatatcaattgtttttagcctttagatgattaatctacggtccaaactatctccctactttttaagtcatatcacatcaagtgtttttagcctttagatgattaatctacggtccaaactatctccctacttttcttcttccataaagtcataccaccttactttttacatttggatcaccattctacatactatttaaatttaaattatcataaaccacattaatttacttaatctgatgttatctagctatcttacacgttattttgttattgttatcatactaaattcccgcagcaatgcgcggggtttcacctagttatatatatcacaaacactttgggagtaataattaaagaagaagttagcatacataattgatagagaagaaaatgatgagaaaacctgtgctcaagaggatttgagcttaggccaatgcattactgctagcagctgcctatcagttgagctaggcaccgttctcaacagagttatactaaacggatcatactaccagaaacttgttaatccgtaacggattcttggtgatggattcataaaccgtcgctgacagcggcaatccgtgacgataatcttttttccgtcatggacgtgcaccagtggttattcttggcccgctaactcatgatggttttatccagatcgtcacagtgtgtgattttaaaatcttcacagtgtgaagataatcaaaaggcatttcaaaacttgttttgcttgaaaaggatttgaatttgaggttcaaatgaattttttaaaaaatgaaaaactacactctctcttgggccatttctggctgtcctgcagccccacatggccacacccacactctctccttctcttgggctcggcccagcctccctcttacgctttcccccttcagctgggcccggcccattttccgcatgggctagccgcaggccacctgcgccttgtaaaaaaaaagagacaaaattgtgtagctctttaggggattcgaacaccctcaaccaaaagcacaatatccctaaggatccaccactgaaacacaagtgtttggccataggacaagcactttgctttatatatatcaaacgttagcaggtaatggactcctgctcgtgggattcatcataaaattcacaagaaaaccagcaggttttttcttttcaatcgctggctaaaacttgtaggtagtctttctccctcgtactaacttcaaattagattattattttttctaaaattttctaaattaatgatctatcaatttattgtgttattacaactattattttttttcatactttcatgtgactttgttttatcaattgaagatctaaatttcaaaagtgtcaacttcaaacgatattttgaagcagtaaatgatttcatttgaaaaagtcatgaacacaaaagttgtagaactgatcgagatctacaatttttattttggtcatttattcatttgacaaaatgatagtaacattgtttacacaatttacacatctatcttataatttatgaaaccatatgggagatatgtaaaatttatgaacaatgttactattactttgtcggatgaacaaatgaccaaaataaattttgtagatttagatggattatacaactttgttattgattacttttttagttgaagtcattcactaataaaaaattctatttgaattctcaaactttgaatttcaaatttcaaattattcaaatagagtcagatggagaaatgaccaaaataaaaattttgcatctcgatgagttctacaactttggttttggtgacttttccatttgaaatcatttattaacaccaatttttgttcatgtggttatgctagttcaatgaccgcatgttactagaaaatatttttatcaatggtagtaagtatcggtgcatttacatgggctattaatattgtatccatcctaaaatatacggtgtattagttttgtacaatatcttctacattatactttgaatattaatttcttcaataatatattatcaacaactacgaaattaacatcatcataagtatgaaagattatggaaaacaaatataaagatatgacatgcatatgcatatttccttttctgctacttcctatatactatcaatttcatatttgtaaatttagaattcgtaaataaaaggttgtattacgatgaggttttttcttgttctaaccatttggagattatattctaattagcaaattcaaatttgtattctcaattataggttttcatgttttagttgttctgaaatttgaaataagtatcatgttgtacgtacttaactacttatctagtcccagttagtttcttttctattttaatatttctcaaaatcaacataaataattagcaggttataaatgacatggactcataacaaagaaatataaatttatttttcttgataacataatttctaaaattgtgcaaatttataaatataatgttatgctctatgtatgtagagtatcaattttagttttcaaggtttagcaattccaaaaattcagaagtaaaaatactaagttgtacccatcttggattataatctttctcatttaattctgaaatcctaaaataataattagtaggccgtaacttacatcgacgatcctttttatttaggccgttatatttcggtccaccaaaatagatggccagatttattctagttctaacattcaaaactaacaattatcaagttgtaactgtcacattcccctcttaatttaagttattataattcagtcatacaaaggtggattgtcagatttattcactatttatcctgttaacgtgagaattttctcggagtaccctagtatatgtataatcttgagaaatatatccatttatttgtctgcagagctagcatg

SEQ ID NO: 34995 - DNA, 5071 bp, Oryza sativa
tttcccacaaattccaactcatcggggattctttatattgatgcagagctgagaattcctacctcaaactaggctgggtgtgtcatggatcttgttagcatttccatttacatgtgggccatggcagccctttgtaccatcatcactgcaatggtgaccaccaaacttgcaagagtaagaagaccaattaccctcaatccaaagagcaaaagaccacttccaccggtggtgaatgtcattgcccttctagagcacttacctaggctatgtacaaagggtgtaattccggtgtacaaagggagtgtgttcacggtaagtctgtttggactgaaggcaaccttcttggttggaccagaggtctcggctcatttctatcaagggatggattcggagattagccagggcgatctgtatgaattcaccgtacccttgttcggcaaaggggttggctttgacatagataatgctactcgaaccgagcatctccgtttctttattgatgcgataaagacgtcgaagttgcgaaaccatgtcaactccatggtgcaggaagtagaggtaagtcagcaaatatgtccggtataacttttttctataaccttactgcaaaaacatgcctgaaggaacttaagatttttctaaggtactcaaaaaaaatgtctagactgttattttttttaagaaattgaaatactattttcatataaatcacttctatttttttcccagatccgccattgtgcatgctcgtgccttttttttgcttgaatgcatatctcattatatatacattatacatgcaggactattttgcaaaatggggagaaaatggcatagttgatataaaacatgagtttgagaagttactcatgttgatctcaggccattgcctactcgggaaggaggttcgggacaacatgttcgatgaggtcttctcattgttccatgaacttgacagcggggttggcttgggcagtgtcatcttcccatatatcccaattccatcgcacattcgatgcgacaaagcacacgccaaacttgcaaaaatattctccaaaattgtgaggtcgaggagggactccaaccgaccagccgagcaggatgtactccagtacttgatcgattccaaacatagagatggaaactccactaccgaacaagaggtcactgggtggatcatttctatggtttttgccggaaaacacacaagcacaaactccactacctggactggagcatgcctactaactcatgacaagttcttgacagaggcactcgatgagcaaaagcatatgattcaaaaacatggagaccatatagattataatgtgttgttagatatggacatcttgcactgctgcatcaaggaggccctaaggatgcaccctgtggcgccaataatatatcgcaaggcacaaaaatcatttgttgtaaggacgagagaaggcgatgcatatgacattccagaagggcataatttactgagcccaatgatattcaacaacagactaccctacatttataaggatccccatatgtatgacccagataggtttgctcctaaaagagaggaggataaagttggtggcatgttctcttatacatcgtttggtggtgggaggcatatttgcattggtgaggcttatgcttatatgcaaattaaggtgatatggagtcatttactaaggaactttgagttgaaattggagtctcctttccctaagacaaactggagcaaaatcctgctggaaccttggggaaaagtaatggtaagttacaagaggaggaggctccccacagcttagtagagaaattaatatacatggttatccgtatgtcttgtatttttgtcatgtgtcttgtttgtaatacccatgtaacaagaataattccgtatgccaccacatggctaggtgtcgatgtatgtaagggtgtgtttggataatgaaaaatgtggaatgggattaggattgcgaaataaatgaagggttaggattaaatggaagagggataatgaatggttaggatttaaagatgtcttttggtgggtgggaaatcatttccctatcccattagccaaacactacctaaatgtttataattgaaatttgatgtatttcttatgcaattgcaactgctctagtaggaatacatgatattgataatccacaatattataataatggcacacccaaagtaagtgatatggtttctacatatctagtgtcaagaaagagcatccacaatgcacgtggttgtcttgttggtttgaagagaaataatgctctaatgggtgaacacaacttatcaggctccgtttggctaatgagttatgcccatcaggaaatggaaatgatatactggtagaatgaggtggtagattatgtgaagggaaattatattccatgtttgatttgatgaatgggaaatggaagtttctagattaatgaccaaaatacccctcacaataagttgtggtagatgaatcaacagattaaaagggtcaaaatggtgagggcgatttggtaatttctcctagcactctatccaccccctcaatccagcaggattgcatatcccattcccgaactacccaaataacggaaatataaaatttggaaataatgtccatttcccattccctttatccaattttccaaacgtagcctcatagatgaccttttctaggcccgctggcaagggtgagcgagcggctcgattgcacagggccggagactttgaggggcccataggccgtcggagagcagcccattaggcctagttgctgctgcaacactaccttcaggccttcagctgggtagcctgtgaatccctatcgatcgcacatccgtgcacggtgcactaaattggctaggccgagaggcgagacaagagtaagcgccaagttcatcgcctgttcgtcacctagactcccgacgtcgcatgttcgtctcttgtcaagacgtcatgtcgccgccctagtcctcccagtcccaagtaccggcagcaccgctgcagcatcactggatcagcagccgggcacatcaagatgaacaggttctacttatcccaattctgatttattttttaaaactacaatcataaggagtcactacatctcagtccaaatgcgttcatataataatctgttaaatatgaattgtgattattcttcttggccttagaacatgttcatgtcaatccctcaacttttagggccataatttgcattttttttctagggacctaattttgtagagatgaccctgaccttatctaatctaaaaacgcctattaaagatgaggttatgagagatgacccatcacaggtgtagcgtcatctgtgataggtcatacgtcatacttgtgactcgtcatagatacacatgtgacgggtcacagctatagcctgtcacacaatactattgtccaattcatatttaattttttttcttatattatcctcaaccatctttcaatcttttcattcctctcatttaataagttgtacacactagatactccctacatctctaaatataggcacaaccaccttaacctaaagaccaagaaacactcattatcacattctagtttgtatcaccctaataaatatatgcatgcacctaataaattagagatcttaagggtggaggatttaaaataataataatttaataaagaagagatgctaattaattgcatgcatgcatgtaaatcttatattatgaaacatctaaaaaaatagttgtggcttatattatggaatagatggagtatgtattggcaggagttaggcccactaccgatggctaatctatattcagcccaataagtgatccgatgggattacgctgaaattatgcctctgtaacagcggaagcgatgagccccatacttctgctccacatctacgatgaagcagacctacgatgttgtggtgcgaccgtgcaaacgggctttatcttttcgcttatgcttttgtttatcagccaaaatttgaattttcaactttaaatttgaagccgattttaaggttttttatcgaagtttatttttcagcatttgcttttagattgctaagaacacatatataaaagttttatttataaattacttttcatttatgaatatgccgcttggtttattccacaaataagtcaaacgatgaggctaaatttctacgggcctcagcctaaatggatgttagttcgaggtggctactatcgattttccatgtccatcaattattaaaggcacgaaccaacgaatccacacatgatcacctggtcaatccattgaaatttgatgcaaaatcagtccttcatgatcaggtcctctgacgaactgttgatggtagcgttgcttttctgccactgaccaaagaatttgcagccggccggacatgccagtatgtcctcttactcaacgccgcatctccaacagcctcttcacattaaactctccaaacactcgtatagctaactctccatctgatttgactagtcaacctagttactcgttccaacagcctctccatctaccatccccattataaatctatgacaaataggacctatatgtcagcctctgatacccttcttccttctcttccaccccattttccccgcccatacacgaaggcggccacgtccatgagtgcgtccacggcgcaagcaccggagccgcccggcgcaagcaacggacgcagccacctcgagcatggcatggggcggctccggtgcggcaggctcctggaggggctgcgtcgggggcgggcggcggcgacatgccctgccccgggaggtcaacgaccacggtgaggatgccgcggctaggccaagcttgtccacggcgtgggtgacggacgcagccacctcgagcagggcatggggcagctctggtgtggcgggctcctggaggcggaggaggaggatgatggagcagctccggcaggtcggcgaggccatcggcggtgtcaacgccctcctcgcccacgcctacgctctcgccttccacgccgtcgccgccgtcgaggtccgcgcccgccggcgtaggtgatggcggcggc

SEQ ID NO: 34996 - DNA, 2888 bp, Oryza sativa
acggcgttctgcgagcggagggccggctcgtcgtcgctgtcgccgccccgctccagatcccggagggtcgaggggaagacgaagggcggcgccatctcgtcgcggcctcggcggagtcgcgacggcagcaggacgacggcggcggcactgggtggatggggtggcgggcagggaggaagccgagacgggatggggaaagggggagagagagaggagagagggggtgggacccacaccagatggccagccgtcctggctggccaactttggctagtgaggtggggaatttagccagccggatggcttggagagccatttagctagtctgttggagtagatttttttgtccaagttagctaaattttggcttggagagccatttagctaggctcttggaggtgctctcagtgaagtcactttcccgaccattccttctacatgctagaggtctctgtctcaaaatataatataaaatgtaatagaatctaaaatacccgtaagaattggtttggtaatctaaaatacccgtaagaaccaaccgacaggtttggaactcgtttttttggacggaaggagtaaaacaattagaaaatctagaactttgattattgcaaggttgaaaaaaaagaccaggatgtacagtagtgcagtcaagtcagaggagtgttctctagctctagccggcaatgaaatgtgttccgagtcatagcagtaatttgctccgaaatgggagtacgtagatcggaataaaatagctaggaatatcatttgttccttcgtgaaaatcttgagcaaaattaagtccatggcggcgaccacgcttgcttgctgtttctcttcctccatggatctctcctgcagcgcacggctgatgccgttgaggatacgatcacggcgagccggccgctatcaggcaaccagaagttggtatctcggggtgaaaagttcgcgctaggattcttccggtcaggtaagctaattaacactgaaacgctgcgcgttactgcagaagtttagtactccagaagtaagtaataagtagacataatgagtaagatagatatatggtagtataagtttacatgagttgatatggtttatgttaatttaaatagtatagagaataatgatttaaatgtaaaaataaggtgatgtgattgtataagataaaaaaaggtgaaagataatttgaaccatagattatctaagagataaaaacaattgaggtgatatggttcagtgagagaagaaaataaggaagaaaatttggaccatatattaatcatcgaagagttaaaaacaattgatatggtattgcttaatggggaacatgaggaagacaatttggattataaattaatcatttaagagataaaaacaattgatgtgatatggcttaacgagagaagagagaaataacatcaactaagtgaggatgcactatatatgtatcaatataggatattataaaaaatagagtgatatattaaaatattatgtgaattatgtgagatgatgtaacatgctagtattttaaagctttaaaatttaataaattgtagaattaatagataatatagcatgttgcatgatgtttaagatgcatgctataaaagtgtttcaattaggaatataattataatatatttttttcatttgaaatataattatatgatatcttattgtgaaaatttaattgcagcggatacaatgatacaatcaaatcatgtatctaataaatagtttagaagaaaatatattataaaatttgcttacaactttgttaattagatgtagaaaaaaaatacaaaatacatagtacattgttagagcacgtgcactacgtgagggaaacagcacgtcagcacatccatttttcttttgtcatccatcgaatgtccgacttgtagccatccccatgaacttgcattcaacgggccaaggcctaacccatgctggttctttctttttttttaatatgtccgcttgttgtcccctaactttacgtcgagtttgtttaacatcctttatcgccaataccaaaaatcttcacctctaaactattcaaaatcatgcgatttagatcccatagtagtatggatgcctggtttcgctaatgtggtgtcctagttcaaaaaaaatgtgggactcacatttaagtaaaaaatagggggctcgcgtatcagtgtcctcttcttcattctcttttcttcccaagcttagaagggagggggaggtggctgatgggagattgagagggaggggcagttggtgagcctggaaggaaggaggaggcggccggcggaagagcggggctctgcgtccctagaagcctgcaagtccaccagctctacgtcctcggccattgcgcctttgtcatccctgagcgggaacagcaggtccgtgatccggagtttcctcacaagtgccgaagttcggccgaagctggtgcgccacagcgtcggagacggcatcgctgactccgcgagacacggcggcaaggggaggagccacctgctgggaagagctaccaccaacatcacccacaagctggtctcagctattgaggatctcgaagacgcgagcgatgttgtaccactagggctcgccgccgttcgtgttgtgcccccggcaatgtccactgcggttgttgttgtggtggcggcgcttggttaggatgagatggaacaaggtaggaaggggttgctgtaactgaactccacctcacggtcggcaccgcgcaagtcatagacagcgagcactgggtcgaaagcacggcacaagaacggtgggggaaacgcttgatgcagcctccccctccctcccaggctcgctagccgcctctcccccatcccccatctcccgtcggtctcttccccctccccaat

SEQ ID NO: 34997 - DNA, 3682 bp, Oryza sativa
ggtttctgtcaaggttatggataccacatacctaataatagttgactaattctcggcaggacccaccacataccatgtcttatacggaaacaactttcagatatagaaggagttctgcataaggaaggatgaatagagttttacatggaaacgacaaggactactcggattgtatccatattggtttccctagtcctacttggacaaggggacatatgggtataaatacaaggccccctaggaggagaggggacacgaaacaatagatcaagacacaagatccacatacaagccaacatgcgccaagacaagaagccggatatcgacttcagagataggcatggctaatcccctacggtgtctccggatactgtcaggagagacatagcgttgtctctgatctcatcgggcacggattcgaggaggaagactaccctgtcgtcgactacgagtcagaccttcagaccgccatgtcgacaaccgttagataggctaccctaaatattgtactggtgtgattatggtgaataagagcaacgaccggcttcggccaacaggatgtagggctattacctgacaattcaggagcccgaacctgtataaaaatcctcgccctcatctcttttactacaatctcgcatatatcctagtactaacgatccccatactatgcaaataccggaatcgcgacatcaaacgtcgacaatttcaaattcatattaaattaataaagcgatgaaacaactccatatctattaattccaatttttgtaacaactagatatttttaagagagggattttacggtccttggggaggtacaaggaggtactgcattttctactgtaaaatttggcacctcttggtatctctcaaattaagacggtatttttttatttaagacgatggaattcattatggattttatttcagagaagttaaagccaattcttacaaagaaactaataagaaaaaccatcttaaagacaaatctccctctatggttggtcatagtgcccataactattttttttctattttaagatgatggaattcattctggattttatttcagagaagttaaagccaattcttacaaagaaactaataagaaaaaccatcttaaaagacaaatctccctctagggttggtcatagtgccctgtccataactattgtttttatcaactgatattaagttgtacgtagtccttgccttcctcaaaatagaaaaaaaaatctaaaatcaacggtagatcttttgtcgatcgaattccgctcacattactgttggcaaatggcgtcgaaccaaagaaaaacatcggagataaatcaactaaatataaagaatccatggaatatgtttcatttaacacgaaatctgaatgtgtaatttacatattcacttatcaaatggtatatatttttaagttcatgtaagagctcactcgaagtgctcaattaatatagctataaatagataagatcctcgcaaaccaaactttcataaaataaatgtgaaaagttcttttaaaaagtatcattcatatcacaatttctagctacgcccttttgcaattcaagatatttgtgaatatgtatttttttcaaatatttttgttctacggcactaaacaaaatcactcctttctgtcgtactccctccatcctataatataagggattttgagtttttgtttgcattgtttgaccactcgtctttgttgaggggtgaccctctctagcgggaggctgtgaggccctcctttgagagttcggccaggggcagcgggtgagattcgaggatttggtgagcgaaactgtgtgtgatcttgatctcggaggcccctccaagacgatgagacaaaagaggtttatataggttcgggccgctatgaagcgtaataccctactcctgtgtgtatgattcttctgtgcttagaaagtccctgaatccctggtatgcaagctagggttagacaagctttggctcagggatcctcagtccgatcccccttcctcgctaggcatggtcctccttttatactctaaggggataccacatgtgctgcgagtgctacctagggagaagggaaaatattctctatattaattacatgtcttgtgccttagcccagaagctatccgcggttgctgcgcggggcccatcaaatcaatgcagagcgcccttgtcattcgccatttaatggatgaggactttcgggttctcgttcacaccagaaaacgggaacccgggtcagttcagagtggttggaccagctctgaccggggtaagaggctgtgaagcccctcatcattatgatgggacgggatggagcacgccgctcgccgcctgacacactgacagggcaggggtacacagtcgccatcccatcggtcattcaaccggtcagatgcgcagcacgccgcattaaatgcggcctggcgcggttgcatagactgctttaaatgcagttaggtgggcattaggcgcgcccacctaaccctgtacacgtgggctgatatgtggagggggtcggggcagctcgaccccaagcgagggtggcctcctccctctagcttggagggggcagccaccgcgccaccccgggctcgacccccctcggggggagccacgtgggtttgggggcggcccaaccccaagctgggagggggcagccgccgcaacaccccgggctcgacccccctcggggagagccacgtgagtttgagggcggcctcctccctctagctgggagggggtagctgccgcgccaccccgggctcgacccccctcggggggagccacgtgggtttgggggcggcccaaccccaagctgggagggggcagccgccacaacaccccgggctcgacctccctcggggagagccacgtgggtttaagggcggcctcctccctctagctgggtgggggtagccaccgctccaccccgggcttgatcccccctcgcggggagccacgtgggtttgagggcgacctcctccctctagacgtgatacccccgggcccatatcaccgacagtcttattcaaaaaatttgtgcaaatataaaaaatgaaaagttgtgcttaaagtactttggataataaagtaagtaaaaatttataaataataatttcaaaaatttttgaataagacgagtggttaaacagtataagtaaaaattcaaaatctcttatattataagacggagggagtattagacaagatcgacacagtctctatttaaggtaatgaaaatattttaacactcccatcctccacccacattaatggtttgtacatgattgattcaaaaatatgggatcgagtgccccgggcggcatctcgcaataacctgagatatttctttctgctgacgacatgctttcagcagcggcaggatgcgcattgccgagtctaatccggccatcagcaatgcaacagcaagaaacgagtgtaatcattgcgtccacaaacaaagatgtccaactaactacacacgatcagtggcaaatctgtattacaaatggacagtgaagagcgcacgctttcacttcgtcgtccctaacctttttctcttcccgcttttccccgcgttagctaagctagctatagctcctttgttgctgctgccatgtccgcggattcgcttcgtgccaggcatgtgcgtgcacaggac

SEQ ID NO: 34998 - DNA, 2275 bp, Oryza sativa
  unsure (1)..(2275): unsure at all n locations
aggcgcccgtggcgagcgtgatcgcgaacatgacgaggaatgccgcgtccgagctcgccgccgcgctcttgaggtcgaacaccctgagggacggcgccaccatgacggtgacgaacagcggcacgacggcattgaggaggaggtacgtcttcgtcttggagttggccagccccgggaacgtctcggccaggctggtgtacaccttggcgctgaggccgaggtagctggtggcgaggctcaccgcgacgcggctgttcgacgcgaagttgttgatgcagaggaggtaggagacggtgttgatccagcagatgccattcccggccagcgcggtgagcaggaagagatgccagtaccggaggccggagctgtccaagaacatgtactggatgccatagccgacgagcccgaacgcggcgccgacgaacgcgacgacccaaagtggcaggtacagcgccgccaccccggagaaccatccgaagagcttgcccgcgtcggacgcgaaggcgaggaagttgagctgcacctggctgatgctcttgagctccttgagctgcgacgagtacaccgggaagtcggagttggggccgttgatggtctggagccagatacttcctaccaagctcagccaatgggccgaggaaggggaagacattgttgctggtggtggtgcgcacttgcttgagctgtaatggcctctgtctgctaggtatttatgcaattccggcggttaattaaccggcaataaattgtccgatggagatgactgtggctgcaaagctagcttatgtggtttgttgttagccagtatggactaattagtagatcagcaattaggccataagttttagcctaaacagcaaccagcccaactgagggcacaagtgctatggcccaagacgtaactctcagcaggtgtgaccagaattcagaaacggaggctgagatttcagactgcgggttgcttgcaagatattcagtactggtacatcatgacatctgttgctattgtttgctattaaccggggagcaatgaatggcatcaatggctgtatctaattcctggtccggaattatcggagcttgtcatggccaccttgcagccacgacggatcaattgcagggctcaccggagctggccggtgctgacttgcctgcccctctcgtagacgtcactgtgattttgcccggcattacaagctaattcgaaatcaaacacttggtattcggcaacaaataattagggccagattagctagccctactgttttctgaagtattcggcaacaaatcttacaagctagctccccaactggtaatgctttcgaatgctttgcatatataggccaaggtttcttggcctgatcattccggtgtcctaatccgaatatgcatgaaacacttaaacatgaactgagcagtactcctaatcggatttaacttcagaagagagatcctacaaatagtaatcctaatcggattcaatttctgatgttcagcttgcagcagcactttctgacagtgcagcaagagataccatttcccatacacaattcagatctgatcagctcagctagtcagctgtcgactaaaagctcttcccgccattcggttcaatttccgcgccatgtctttcaatacattgaaccaacggtgtcactgttctctggatctgcacaagcacggttcaccaccactcaccggccggcctccgccctccggcggtcacgatcaggccgctctctcgccatgaattgtcgccacgccaccgctgccatttgccgggagcagtgacgtcacggctagttaactcctccctcgccggctgctcctccgtgtctggccgcgctcgctgctgcggttactttcagctcacctcgacgccattaaaaaccgaagaccagatcaacatggccccgcgggaaaggaaacggtgataatcccggccgcgtagaggcgatccgaggcaatgaaatcgtgtaatgatttctagccatgtctgcagcatctgaatctagcactcgcattcatgctatagaccgccttcagcctgaagctgaattgaattaccgttgtcataaggtcatggtgagatcagacgcacggcacaggagagcgtgagttctgtggctcctgtacggagtggagttcagcctgactgcctgaccatacctgagacataatttcttctgaattcagagttcagaccaccataagttagaaacttgaatcgccattctnnnnnnnnnnnnnnnnnnnnnnnnnnnnnnnnnnnnnn

SEQ ID NO: 34999 - DNA, 2049 bp, Oryza sativa
  unsure (1)..(2049): unsure at all n locations
ctttttgggatagaaggtgtacaagtataaaagtgggagtaatatacacctgttcctctgtaattgataaagcttgatggaagtttaataatttttaaaaatggtttatgttaaaaaagagggtttatttttttacgtggaagtgtgttttttctccttgtttctacataaagattaaactgtactaaagaatatcacattttaatgcacatatcctcctcatcagcatttatgcttgcagagatttgatcattaattgccagttcatggagtggactaattaaagtggagtggcggcattgcagatttgcagttgtcgctttgcgctccgcgcgcgacgagaaagaaacgtgacttttagatcctgcgtaccaacaaacacaagaacgacgaaacaactcaaatgtgtgtcaactcggcgctaaaagattatcatttccatggtacaaatataccttctgttcctgtgcatatcaactgcaaagtttaagtttaggggatcttctagagtcgacctacaggcatgcaagtcggcgctaagagattatcatttccatggtacaaatataccttctgttcctgtgcatatcaactgcaaagtttaagtttaagcttattttaactatacatctactaaatgtgtgtcaactcggcgctaaaagattatcatttccatggtacaaatataccttctgttcctgtgcatatcaactgcaaagtttaagtttaagcttattttaactatacatctacttgacaatggaagtagttgacagttaagtaattttttttaggaataaacagtgaagtaatggtaagtagttttgtttgatccatcagtcggagacccagtgtatttgagttctatacctggtacgtgcacaattgtcacgacctggcctttaattcacgggctcatcatagcctacaccccatgcttgggcctcatcatgaaccgctggaatgccttcccttcgcaccggaggcaggcgtacaaacccacaattacaacaaagccaaaacgagaccaaatcctgggcattaccaacgcaccgaaattactactccctccgtcctataatataaaagatttttggagagatgtgacactttctaggactacgacctatccaaattcgtagtcctagaaaatatcatcgctctaaaatcccttatattatgggctagaggaagtaataactatataagagaactttccttgagatcaacagaaccataaaatatgctggagaataacaacgcacgaacaggatttaatatcctggacgaacacgatttcatgcgtgtgctcaataatgagaagccaaacatatcaaaatatgagtcgcgaagtaaaaacaaggcaatgcgcaactcatcatttatgtacagtaataatggtataccatctctactcgactgaacagtcagcagccatgaaatgaaccaatgtaaccaaacatgtaaatggggcaagggagatatacatgaaatgtacaccaaactgagtgatcagaattcctaacgttcaccacggcaccaccaaccaattagagaaacctacttctttccaccaatcgtaggttgaccaccatttgcactacccatgctagtgggtacgcccatcttatttccaccactgagacccttcaagtcaatcaaatcactgaataaattgtcaggtatgtaataaggtttgcttgctgccgctgaagaacctggcggttgttgattcccattcatttgagcttgtgttgcacttagtccattacttgtagtagaaccattccatatcggcaatgaggctgaaggtggcacatatgccattgaaggggaagtatatgatgctgagggagctgaataggttgaggaaacagaaccaacaggtgggggttgttcttggtaagtagctgactggaaaggattagaattgacacttggaggtgcagcccatggtggtgctggataatattgaccactttgtgcccaaggtnnnnnnnnnnnnnnnnnnnnnnnnnnnnnnnnnnnnnnnnnnnnnnnnnnnnnnnn

SEQ ID NO: 35000 - DNA, 1307 bp, Oryza sativa
acgcgcgagctgttcggcaccaagaacttcggcgtcatccacaacgtcgtggtggccaacatccccgtcggctccttgtgcttcggctacttcgccgcgttcctctaccagcgggaggccggcgcccgcggcacgctcacctgctccggcgccggctgctaccgcgagacgttcgccatctggggcacgacgtgcgccgtcgggacgctgctctgcgccgcgctctacgcgcggtcccgcaattttgccgggaggctacctgtaaggataccgtcctgcctcgcccgcttagctaaccttgtgtagggtgctagaactttcttacacctctcagaggaggcctcttcttaatttaacgaccatacacgaaagcatcagccattaggcgatgtaattaattaggttttgtttctttccaccacctttttctttctttctttctttcctttggttttcttgactgattatcccacggggggatacagacaaaaggttggagcctgatcagtagatattgtgcaggctgatcaccttgttttctctgcatatattatatatgcaatcatatacgagtggttaaggggaattcaggtcttgatcatattggctaagttggccatgctactggtactagcatgttcatttttctttttgggtttcgatttattagctagtagtatttgatagcactgtagtgctactatgaggagtactacgtactgacgtacgtggagctggaaattcgcatttatgcgtgtgcaactacgggcaactactgccatttacatgagtggtccactgaagtctgtagcatgtagttccacgttattcaattgaaagccaggtatatgatagtactaacagtttcgaatacttgctgttcattccaccgtagcctgatagttgcagttatatggaacactcgtaggcagatagatttatacgtttacagacgaaattgtcaggtaccaaacctagtgcttgatcattaagtcaaaccagatccacgtcaataactgtccataacaattctgttagtatctcttcgtaccgtatatatagtcaattcgtagccgtaggtctaggacaaggcagggaaagcatgtaggcgttttaaacttttaatcctctcctggtgaaagttggacaaccgtgttaatcctcttctcagcaggcggtatcatcagacgtttaactgaaagttacactatggcccatacatgtgtgaaagatcaaatgaagaaatgttcaacactatcctggccacctttaatttctggataatgtcagatgcatcactgctactc

SEQ ID NO: 35001 - DNA, 1022 bp, Oryza sativa
  unsure (1)..(1022): unsure at all n locations
cctccccccccccccccaccgggcggccggctcgccgtaccacgatgtaatggacttaaatttttagggaaaattttttgcgaaatattttaagtcatgctcttctcgattcttcctttcagtaatttcacttttgatcttttctttgacttgagtataaactatatttgctaagttnnnnnnnnnnnnnnnnnnnnnnnnnnnnnnnnnnnnnnnnnnnntaaggggaattcaggtcttgatcatattggctaagttggccatgctactggtactagcatgttcatttttctttttgggtttcgatttattagctagtagtatttgatagcactgtagtgctactatgaggagtactacgtactgacgtacgtggagctggaaattcgcatttatgcgtgtgcaactacgggcaactactgccatttacatgagtggtccactgaagtctgtagcatgtagttccacgttattcaattgaaagccaggtatatgatagtactaacagtttcgaatacttgctgttcattccaccgtagcctgatagttgcagttatatggaacactcgtaggcagatagatttatacgtttacagacgaaattgtcaggtaccaaacctagtgcttgatcattaagtcaaaccagatccacgtcaataactgtccataacaattctgttagtatctcttcgtaccgtatatatagtcaattcgtagccgtaggtctaggacaaggcagggaaagcatgtaggcgttttaaacttttaatcctctcctggtgaaagttggacaaccgtgttaatcctcttctcagcaggcggtatcatcagacgtttaactgaaaggtacactatggcccatacatgtgtgaaagatcaaatgaagaaatgttcaacactatcctggccacctttaattctggatatgttcagatgcatcactgctactccctccgttccacaatgtaaatcattctcacatcgtggaacggaggaagtagtacttatctttcgctcatttg

SEQ ID NO: 35002 - DNA, 569 bp, Oryza sativa
gagtagtacgctgaaaagtaggacctgcattttttaacccgaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccgtccgcacggcgagacggtgctcaatcacctccctggggaccccgggcatgtcagctggtctccatgcgaagacgtcagcgtttgcccgcaggaaggagacgagcgcgtcttcctattgcccatgcagaagaccaccgatc

SEQ ID NO: 35003 - DNA, 3524 bp, Oryza sativa
  unsure (1)..(3524): unsure at all n locations
ggcgcaagtcctgcagagcgggggggacatgtcggagcattccgtcgggggcatgtccggcacagcggcgacgcccgagaactcgtcggcgtcgttcggtgacgacgagatcagagttggctcccctcgggccgggaacggcggcggcgacgagttcgacgacgacgagccggattccaagagatggtgagtgccctgttcccaaacctcttcgcgccaaattatgtttgttgagataaaacagtgaactgaacatgttcaccataatatcaggaggaaagacggtgacggcgaggggatctccatggctggcaaccggacggtgcgggaaccgagggtggtcgtccaaaccatgagcgacatcgacatcctcgacgacggctaccgctggagaaagtacggccagaaggtggtgaagggcaacccgaacccaaggtaaataaagaacccaaaaagtccatttttcagttcgtctactggtgtgatcgcgcgtgtgtatctctcgtacttgtacttatcgtgcgtgctgctttcgtgtctgcaggagctactacaagtgcaccacggccggttgccccgtgcggaagcacgtggagcgcgcgtcccacgacctgcgcgccgtgatcaccacctacgaggggaaacacaaccacgacgtgcccgccgcgcgggggagcgccgcgctctaccgccccgcgccgccggcggcggccgccaccagcagccacccgtacctgccgaaccagccgccgcccatgtcctaccagcccacggggccacagccgtacgcgctgaggcccgacgggttcggcggccagggaccgttcggcggcgtggtcggcgggagcagcttcggcggcttctccgggttcgacgacgccaggggctcgtacatgagccagcaccagcagcagcagaggcagaacgacgcgatgcacgcctcgagagccaaggaagagcccggagacgacatgttcttccagaactcgctctactgactgaaagaatcgtcgtcgtaggaatctcaaagacatgacacgacggaaattgtagtttaggggggttttgtacttgtacgtacctaggatatactgtagtctttgatacatttgtttatttgtttggagggcccaggaatgcagatggctgcagaaaagggtaccgtcccttaacactggagatgggaggaaaggatgtactcctgtaggatacacagcaaattttgctctgtaatttttttcacatagaaaaatgttgtatacaattttaattttttacatcatcaaagattcatatcctctaaatgtaatttactagggggaaataaatatatatgtgtgtatttaagcaataccagaccgatcagtgctgcaactgtacatactgattgaatcaaatcggtttccggcagcccttcctaaaaaggactgagtaagcacaatcaaatttcttcctgtcgggctctgacgtgttcagtttcatcagcatagcctggaaaactttcaagcctccttgcgtggctacacgccaacagttcaaaacacctcatcagatactcgcgttgccgagagacgacagatgtgcacgactactactaatggacagggaacagcaaaactgagttagaactagtcagcaaagaaaagcaatcgagtttagcagccacacagcgcaagtatttggccgtggatcttgaccatggttctcacatacctaacgagctgaacgtcatttgaccgtgtccccgaaaccaaatgaaacggcagaggtccaaagtccaaaccacgcagagcaagtcagctcccgcgccatcgggtacagcagtaataaaccaagcgcgaattaccccgttcgtgttacgtaaccgaggccaaacacatgcccgcccgccaccacacgagctgagcacgtaaaacccaggccaatctaccagacgtccacgagcccgaacgcggtaaaagacacacaattgtgtgcgtgtttgcccgcatcgctcgtgttacgcgggatggctcgcgtcagcgagagcgagctcgcggaaggatcgcggacgagatggttttggccgagcaagagagaaggccgggccgcgctcttgtggatgagatggcagcagcagcgggacggcacggcgcgcgggaccgaatcaaacggaggcaggggtcgctgcacctctccccatcgggcatcggcgcggcgtcttttgcactttttttgtctttgcgcctccagatggacgcggaccacttccgggcgacgttgatgcgttcaggttcggggccgggcgaggcggatggatatggtcatatggatatggatgcaccggcacgaagatggctacttgccaaattggtgtcgggtgttcgcgttggagctcagctgctgagatagagcaaatgagcgatggacgtgtcttacagtggactttactggtgggcaatctaaattaaggcgcagttcacggtggaggctatgccaactttatggagaattggagatcatgaatattacataatcacgcttgcttatttgactagagatagataatgggtcggatctgcctacacaacatttgacagattttctagggtcctatcatgcagatttttggtcctttagatctacatctaacagcagacaaaaatatacagaaacaacactaaaaaatctggaatttttttttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgaatttatactgtgctttatattttttataaatatcaatagttatcaattttttttatattgaaaattatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatcttaaatctagattacgtattaccaatgaataggcttcaatcgaaatcaaacacaagtgctattcaaattaccaaaatattggtagggcatgtttttggtagcaatccaaataggcccttagtcttacgcatacaaaaaatcaccgccataattaaacattgtaatgataagatagataagaagggccatcgatacannnnnnnnnnnnnnnnnnnnnnnnnnnnnnnnnnnnnnnnnnnnnnnnnnnnnnnnnnnnnnnnnnnnnn

SEQ ID NO: 35004 - DNA, 5512 bp, Oryza sativa
tctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacggatcgagcccttctggtcgcgtcacatcggggctatacccgtcgccaaatgggaagactcgtcgcgtttcgagtagctctgccccatgccatgtgtcgcaacagttgcacagcgcagcgcggagcagtgcagatcagcgtacggggttaagtactgaacggtaactgcgtgtactcctacgtaccacgaggtccacgacgctggacgggtggagtagtagtaacacggagtaaacaaggattctccatcggttaacacaagtaaagtacgccgcatgtgatccagtctcacgatttcatggtgagttaaattatttacacgatgacgggcagattttgttgttcatcgtaggggggaaattaaatattttttaaaaataatctacatagaacaattgatccaaacagtacaatagacgataaataaaatccaattgatccaagcagtacaatagacgataaataaaatcttgagaaaacatactgtgtttgtattaaaaaggataaacatccaacgctccacaatgaaagataccacttaaaaagtatttgagtattgttataacttatagttatttaggtaggaagggtaaaaatattttttttttgaaatggagaagggtataattgtctaaatattagctctagttacataggtaccgcattggtattttatcttctatgatcctttattgtgtcatttacgtgttttttgtgatatatatttggtatctaataacatgggagtccttgggagttggttggacccaaccgagaagaaacagtgccctaacactgttcatcttcttcttctcgtccaagcttgggcaaatgggaggaggaggctaagggcgttgaggttctggtggtggttgtatgatgatggtgatggcggtaagacatgtcccgtggcacaacgcacccccgggaagtgaaggcaggcacaaaggacaacctaagggcatgagtcagggaaagaaagaatggcatgtagcaagcttcagttggtatttgcgggcacctaagcgcatcaccacgcgtcccaactgatagggattccgttttcctgaacttattgacgaaagtggtgcgggagtggttggaagcattggagcttgatggcaggatggaagcatgaccatggacaagaacgaagcggtggaggagaacaaatgatacatcaatcttgttttttttccccatgcagatcaattcaatccactaaatttgcggaaaatttactttatttctatcaaacaatacaatccactaaatctttgaagatttagtttgcttcctaatgaacgatactaatcacatggagctaactattctcgactcacagaaaataccatatttgactagttatttccccactgctatcgtttacgataattttattttatatcttgcatctctcttaatcaacggtatacattatcctatctcttagtatttcgaagtaccttataaacaccgtaaaagctcggagccattaatcggccgctgcaataatccaatgaaatggaaaagagtccggctgcacgttgcgatatgtacggactccagaaaaaaaaaaaggacaatacaacagaccatctgcccatctgcaaattaaaatatccgctgtttcgaccaatcgatctcttcgtagtaaatctttcgtaaatgcatttgttgagatctatcgccagactaaaagtactaattttgtgcagtgggttgcagtcgcatacagtagtcgtgggcacggtgcacgtgcactgaggttaatgtggaatgtcacgaagcgaggatggagactggtagccggccggtgtagttctcaattggacttttttttttttttttacaactcatggttggagttcagagcagcatattttccatacgaaagagacttgaaagaccgggaaatgaaaaggttaggggactaccaattgagggcgccaaacgtggtcgcgttcactgctgctgcgaaacataccaatcaccagcttgggttagctagtatacctcagctccaaacacgtcaaaattgatcgacggaatgtttgatcaactgtcgttacgggtgctacatttgcgaaggaactggaggtctggagtacaaatctttcgtgccaacgccgcaacgcgggaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaattttttttatattgaaaattatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatcttaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacagggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatccctgcacccacactttggacgctcggaccatttatgtaaccctaatggattgttcctccagtctaagcttgcaatttccacccgacgttcgtactccatccaagtatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggtacggacaacccgtcctgcctgtacaggtgtgacctctggctgctcctgagtgtgcgcctctggagctcctccaagctgagaggagcctagtacgtcgtggtgatgtgcaccgtgcaagtcgtcgtcgtagaactggctagtaggaccagtcctaccggcgtgagacgaagaggccccagtaccgaagatcccggctgcaaatcctactggacaaggaccatcagtttcatacatgtatttaatagtattaataaaaagtaaagtaccttgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaaccgaggtaaattatatggctcgatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgtagcgacggcctcttctgtgtacggctcccagatgacgtcgctcggctggagacggtcaaactcgaacacgaagt

SEQ ID NO: 35005 - DNA, 483 bp, Oryza sativa
ccttggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaagcctttgcatagcttatggtgtacttgaatttattctcgatgtgcctaataattgattttggttcaaagccaatgttaccaacaacactgctgtacatctcacttaccacaaaagctgaagtgatgtttcggtgatacttctccaccccttgtaagtagcacttgtgctcggtcacaatgctaactttccaataatcattccatttacccttatatgca

SEQ ID NO: 35006 - DNA, 3683 bp, Oryza sativa
gttgatcatcttttgtcactagtttaacagggtgattaaaaggatcatacacaataatctgattagtacgcttggtattttctgtgataaattaattttattttcccatatggtctcagatatgtttggagatgtagcaaaggaaatgtttgatgtgttcgcttcggtttatcggagatgtgatcagtacggtacggttaaagattcttaattagctacaggccctagattgaaagaccaagaacggctatagagggggtgaatatagcaattcaaaattcacccttgaaaatactcatcaaaacgattttctcaaaattcttactagaatcgcagctattagaaaagccggacctagaaaagaagagagaaggaattcccgaaactagaagagagatgagaggaagatagcaaatctcatcattgcaaagttcaaatcgcaagcagaatttaaattgtagaatttaaatggacaaggcaaaaataaaatctttcaaatcatctcattcataggtgttgcaaaataaccgctcaattaggagcaaacatacaccttcatagaaacattaattcaaacttaaaaacctctcgggcaaacacactccaaactcacaccgaaactctctcaccgagcatcttaaaaggattacaaaaggagcaacctccacccttacatccatctctctatttatagcctaataccccctaagacattgtctcaaatacctcatacctctagggcgaaacccaccctggactcaatctcagccacttgcttttccttctcctcaaaggaatagctccagatcgctgccacgtagtcaatccgaactcctccacgctgcactcccttgcacgatccgcgtgctcctgctccaggccagtaacacgccgccacgttgcgcctcagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagacttatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtatcgatcaagaaccagatcaggtgctgatcacactagtttggtttatgggctgatcaggtgctgag

SEQ ID NO: 35007 - DNA, 9519 bp, Oryza sativa
  unsure (1)..(9519): unsure at all n locations
caagactcaaccaaagactgttaagaacagaatacaggagaacctagggtataaaggcctagcaccagaagtaagatggaggaggaactgaacagaacaacaatctactcaaaccttgatgctcacaaatcccaccgcgatatccagccttcgatccatcaagagccaccggagccgagttttcatatgtccgaccaacatctcgttaaaattcctagcaagactagcacataggcttaggataggcacatatatcaataaaagtaataggcctacccaaaccaataggacgtagggttattatttcgagtaggccctaaacttgtataaaaatgccacgcgtcggactaccatacctcacacaagaaataagacacacaaacaagattcaggtcttataagtttctattgtcaggatttttatcaacaacagcttgagccacggtcaagctaggtttgcacaacataatctagcttagttagcatttgtttctccaaccaagcctagcaacttagtttgcaaaagtttaactaggtgtgctttttaaccatcgattcatctgttggcctacatcatgatgctatagctagtcataaaaaaatgtataaatcatctcctctttcctcctcatcgctccctcccgagctcagctgatgtggcagcgacggcagagttggcgctagagaagagaggagaggaggcagcggcaccaaatctagtgcagtgttggcgctcatgacttggcaggagacaagggctaccaggtgcagcctttggggaggaaatgagagacgacggagttgcattggggttcaagttcgacatggggagacccaacaagaagttggcaacccatggtgctcttcttctagaggatgaatacgtgattgtatggtggcttcttccgaaccgcgttggttggcaagaaggatgaagtagcaagcgacttttggcccgatacctatatatggccagcgtggttgggcgagacacaagtgctacaatgacgaggagctggataccagttgcattagagatagttatgtggctttgcctcttcaaattttacattttggagtgagatgcaagtccattgaagattgcctatgaatgcaattgacataatcaacctactgcagtaaaaagacactgctctattaatttgagaggcaaaataagcatcaacctatcgtcgtcctggctactatctagatctatatataaattgcacagtgaaagtttgttcgaagtataaaggtctacgaagctacttcctccatccaaaataaaaacatttctgaagttagacataggcatgaagaaagtatgtgtaaatgattaaaataaggttataattagttgagaaataaaaataagtgaggaaaataaatggagaatagttatggttggttgagatgaggggtgtagatggagaaatagttttattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctcctttaattaactcagacaactcgaccaactcacgtgaccctccgatagtaaagacaaagcgacgactctggttagggatttagatcaggctagggagggaggtagtgggtttagaaaagccaagtgatggaggctataggagagccgagagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattggggtttgcatctggtccctttcctgaatccatgcaagaaaccctaaaaaccttcttcgcccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgtttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgttttttgtcctcggatgccatctcatttctttcatgtcatctaaataattacaaaaagttttgaattttgttacaacatatattaaaacctactagatcggtccacaaatatacaagtttaaatcaacttttacaagttattaacaataataacatatataactacgaatatgtgtatatatactagttagagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaattaaactcatccaactcggcagagtttataaaaaaaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaanaatgaggaatgcaaccttgttgcatganaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttcaggtggtgtttggatcagggatttaactttagtctctgtatttagacattaatttagagtattaaatatagactacttacaaaactaattacataaataaaagctaatttgcgagacaaattttttaagcctaattaatcaataattagagaatatttattgtagcatcgcatatgctaattatggattaattaggctcaatagattcgtctcgtaaattagtccaaaattatagatgagttttattaatagtttacgtttaatattaataattagtgtctaaatattcgatgtgataaagacttaaaagttttagtcccatctaaacagggtcttattcggccataccttggttaaccaagatgactgaattgctattttatttgtcctaatatataacaacttagtattaaagtattaagtattagataacctagcattacttcattcatagtgctnnnnnnnnnnnnnnnnnnnnnnnnnnnnnnnnnnnnnnnnnnnnnnnnnnnnnnnnnnnnnnnn

SEQ ID NO: 35008 - DNA, 801 bp, Oryza sativa
cctttaatttgctgtgacctgtgactaattgcagattcactgaagttcacatcagccgtgtccatcctactggcagtggtgttcatgttcatcagcctgggcatcccggtgtacgccctcttcacccgcacagcgaagatgccgcggatgctgccggatttctcgcgcctctcctctcggttcgagctcttcaccgccgtccccatagtggtggtcgccttccccttccacttcaacggtatcacatcgatcgcgccattgttaacactacaccatctttttctcgagactgaattatctgccttgcatctggcagtgcacccgatccgaacggagctaagcaagacgtcgaacatgaagggggccgtgcgcatctccctcgtgctctgcgcggccatctacgcggcggtggggttcttcggcttcctcctcttcggcgacgccaccatggcggacgtgctcgccaacttcgaccgcagctccggcgccggggtcccgcaggcgctgaacgacgcggcgcgcctcagctacgcgctgcacctcgtgctcgtcttcccgctgctccacttctcgctccgcgtcaacgtcgacgagctcctgttcccggggcggcggccgctggccacgaacacgcgccggttcgtggcgctcacggccgtgctcatggcggtgctctacgcgctcgccatcgccatccccagcatctggacgctcttcgagtactccgggtcaacattcgccgtctgcatctcgttgatcttccccggcaccaaagttatcaggcacgccatcagatcacca

SEQ ID NO: 35009 - DNA, 3160 bp, Oryza sativa
acaccgtggagactcacgatcctagcgaagtagagctccgctagtttattccctccataggtggtcttcacaggaatgaatcgagccaccttggttaatcgatccactattacccatatagaatcatatccaccttgggtttttggaagtccggtgatgaaatccatcccaatttcatcccatttccattctggcacttggagaggttggaggagtccggccggtcgctggtgttctgccttgacacgctggcacacatcacatagagccacaaactctgcgatttcccgcttcatgctgacccaccagtatttctccttcaagtctaagtacatcttggtactgcccgggtgaatggaataaggactttcgtgagcttcccgaagtatcagctgtttaagttctctgctatctggaacgcatacccgctttccgttccatagagttccgtgttcatcctctgtgaaaccagcggctttaccttgtttcatattcttgaggagtccatgcatgtccggatcattcttctgagcctcgcggatttgatcgagcaaggtgggctttgcttctaacgcggccaagaatccgcgaccaactatgcttaggttcagggcttccatctgttgattaagctcgggcggaatgcctcggacgttgagagtgttgcaatggctctttcgacttagagcgtcggcaaccacgttggccttaccaggatgatagtgtattcccacatcataatccttgatgagttctaaccatctcctttgccgaaggttcagatctgactgagtgaagatgtatttcaagctcttgtgatcagtatatatttcacagcggttcccaatgagatagtgccgccagatttttagagcatgaaccaccgctgcttactccaagtcatgtgtagggtagttgccttcatgaggtcgtagctggcgtgaagcataggctaccacatgaccgtcctgcatgagcacgcaccccaatcctggcgcgaagcatcacagtacaccatgaaatccttgcgagtatccggcaagattaacactggcgaggaaaccagcttttctttgagagtttggaacgccttctcgcattgcgggctccacacgaacttctcttctttcttcaacaactgtgtcatgggtcgagcgattttggagaagttctcgatgaatctccgatagtatcctgccaaacccaagaaactgcgaatctgagtgactgtcttgggttgcttccaatcggtgacggcggtcactgtttcgggatccacagcaactcctttagcagatatcacgtgccccaagaatttgacttcggacaaccagaactcacacttgctaagcttggcatacaattgatgttcccgcaactttcccaacaccagacggagatggtgctgatggtcttcttctgattgtgagtatatcagaatgtcatcgataaaaaccacaacaaacttgtccaagtattccatgaacactttattcattaagttcatgaagaaggcaggagcattggtcaaaccgaacgacatcaccgtgaattcatacagtccatatcgcgtagtgaatgcggtcttcggaatatcttcttcacgaatacgtagttggtgatatccggaacgaagatcaatcttggagaatacggtggcacctttaagctgatcgaacagatcatcgatccggggaagagggtacttgtttttgatggtgacttcattgagagctctgtagtcaacgcacatccttttcgttttgtctttcttctctacaaaaatcacaggagcaccccatggggaagtactcggacgtatataccccttttctttcaattcttccaactgtttcttaacttcggctagctcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagacctacctgatgcagttctgaacttctgacagaggttggaggtgcaaagaaaacaaccggctgttccggtcctcggtacagagtgacagtgcgcctcgcgcaatccactactccttggaattgtgccaaccaattcatcccaagaatcacatccaagttctttgtgtctaacagaatcagatccgagggaaaaggaattccctgaatttctataggaacggcagggctataatactttgctgtcataacccctccaggggtggtgatgagcagagggtttctaagcctttctacccccaactgatttttccccacgaatggcacagatataaacgagtgggaggctccagagtcgaacaaaattgtagcagggatggaatgaacgaggaacgtaccaacgatgacgtctggagttgtcagcacgtcctcggccgtcacgtgattcacgcgaccacggatgacgtccttgccaccgttgttggagcggggaggcgcttggccttgctgacgccttggctttgggcatttatccgcaaagtgcccaggctcgaaacagttgaagcacagacgctgctgaccttgagcgtccctgcgaccttgaacaggctgcacagttggcgtaggaggacgtggcgcacgagtcccttgctgattctgctgctgttgctgctgtgggacgcgcaccacgaattgaggtcggggcgcggagcgaggttgctgctgctgctgctgttgcgaggaggatccccctgggtagggattggtgtagcggaccctctggttagcaccctgctgattgcggaaattcgccaagcggcgcttgtgcgactccagttccttgtgcttggcttccaagcggatgctcttgtccaccagccgttgaaaatccgggtagtccccagagactagacgaacagacagctcagggtccattcctgccaagaacttctcttgcttctcctcatcttcccgcacatgctccggggcataacgggctagattgttgaactcatgcaaatactccatcacggagcggttgccttgcttaactcccggaattcccttttcttaagagccacgactccagcgggcacatgggttcttcggaaagcggcggtgaagcgagcccaagtaatc

SEQ ID NO: 35010 - DNA, 1906 bp, Oryza sativa
  unsure (1)..(1906): unsure at all n locations
nnnnnnnnnnnnnnnnnnnnnnnnnnnnnnnnnnnnnnnnnnnnnnnnnnnnnnnnnnnnnnnnnnnttccaagcggatgctcttgtccaccagccgttgaaaatccgggtagtccccagagactagacgaacagacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttcttcggaaagcggcggtgaagcgagcccaagtaatcggttgcccctctggctgcgtagcctggaagtggtcccaccatagagatgcgggcccctgcagctggtgggcggcgaagatgactttctcttcgtcgctgcactgcaccgtgtctagcttcttccccacggcatgcaaccaatccaacgcatccacagggttgttggagctagagaaggtgggtggacggatgcggaggaattcggcgagtttggagtgttggggaggtggtgggggagcattctgctgtggcagattttggaggtggtggaggaaagcattcatcatgttggcttgctgggcgaggatttgggtgagaatggcgttggtgtctggtggtggtggtggtggaggtgggttgccttgggggttggggttgctgccttcgggttggttgccttctccggtgttaacatttctcctggtcgacaccatctgaaaaccccacacagaaccagcaaacagagaaggagagctgacgattaaaactaaccacccacgactaccattattcttaaatttatcactgctattaaattggttcattaaggttcaagttgcttaggcaaacaaaataagacaggctccgacatagttacaccacacaccggtgtaaccatgccccacacaactcaagaaaaaaaacgaagaaaaacacacgcgcaggcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgaccttgagctgatgcagctgcgcctccaacgcgtcgaggtccttcttgagctgcagattctcttggcgcagctccaggatcttcaggttgttctccaccatgccacgacgcaccatctgatggaagtcgatacgagccgcgtcgtacgcctccaccatgcgtgccagatgcacgacggtagcgtcatcctccgagctggcgtctcggaaggtggcgtggtcgctggctcctccgcgacgggggtggtagcggtagggcgagtgctgcaactcgtccgggtagcgctggtgaagagtgccgatggcgaggagagcggcgttctggcaagcggcggggaaggaatctccacccgcagtgactgccagcgaagtccactcaggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctnnnnnnnnnnnnnnnnnnnnnnnnnnnnnnnnnnnnnnnnnnnnnnnnnnnnnnnn

SEQ ID NO: 35011 - DNA, 1948 bp, Oryza sativa
caagccaaaaagagaatagcgggttttcacaaataataaagaattttaatttttgaaaatattgttaaggcttgggatctacggctcgtcctagggtcaaggaaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacatgggcaacgaaggcccagcacactcaaagacaacgaaaaacagcggaagactagggcgacgaccacaggcacttgacggcaggcacgagctagacaccgaagccttcatcttcagggaactcctcatctgggcttgggaaaattaagcaagactgagtacaaccaccgtactcaacaagacacacccacaaatgcaaaataaatgcaagggagtacaagggaattataacataaggggttagagttgcagtaaacagcatttaaaggaatttagttgctcaaagctagttgtaaacacgatcctagaactaaacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgtaaccacgtgccacataccaccacggtatacagacgaaagacgtgacatagtttccaacccatcctagccttagacaagagtaccgacccaattccgcctacggccgggacccccgggacaggcagacggaactgagcccctggcattgggcaccaaccctccgccgtatgacatctcgactaccgggccgcagctcgtgtagccttcatttgccctggagaatgtccatcgacccccgacttcatccatctccaatctgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctagagttgtaaaaccacctaatgttgcctaattaacttgcgaagcatctacctagaattatactagtggtactatgagtagagagtgtccactagttggggttttgtttgtctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttcaacgaagagcggatcttccgaagctgcagcgtctacacgaccgacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttgggtaccgagctcgaattcgccctatag

SEQ ID NO: 35012 - DNA, 2039 bp, Oryza sativa
gtcgatttgggacgcgacagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctgaggggtcgggtcgcgccgacggctgggtaagcctttcttcaaaggcgcccggtggggtctgggctcgcgaggacgcgagccttgagagttcgtcggctatcatgttgtcccttctgggtacatgccgaagctctatcccgtcgaaatggcgctccatacgccgcacttggcgtacgtaggcgtccatctgtgggtcagagcaccggtactccttgcagacctggttaacgactagctgggagtcgcctaataccaagaggcggcggatccccagtccagccgccactctgagtccggcaaggagtccctcgtactctgccatattgttagtcgctcggaagtcgagacggaccaaatatctgaggacgtctccgttcggagagatcaacgtgacccctgcaccggcgccctgaagagacagagaaccgtcgaactgcatcacccagtgggcggtttgaggcagctgtgaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgttgcacctttcggcggggccgatcctcctcgctaggggccgtacccccggggcgttcttcgtccaagtggcccctcggggcacactcgtcttccgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcccgggtcgagtcagcacagggttagcctcggggccaaagggctttaagtgcagccttccctcagtggcctcggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagcttgaattttctcggggttggcctcaatgcctcgggcagagaccaagaacccgagaagcttgcccgcaggtacaccaaacacacacttatcggggttcagttttatgcgggcggagcggagattctcaaaagtttccgctagatctgaaagtaaggtctcttggttgcgcgtttttacaaccaagtcatcg

SEQ ID NO: 35013 - DNA, 1033 bp, Oryza sativa
ttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcatgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgtttcatagccttgaagctccggcgagagacgtgagcacacgctcctccatcgacggtggcaatggtggccccaggttcttggaaacctaggtcatcatcaccatcattgatgtcaacagcgggggccttctgcttggcctcacctcgccgtttgccggatggaaccaccggggacttgccctcacggcgttcctgcctcttgtcctcctcccacttcctcgttcgctcagccaggtttttgactgcacgacagtccgcgagatcgtggagggaggtgttgtggacggagcaccacctgccggcggagcgctccctgccgggagttccggcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaggggatcccggagtcgagttccaggctccacgcttcctccttacgagccactcggtccgcgagctgaaaaagctccgcggtagtctggggctctttggaagcgatctttt

SEQ ID NO: 35014 - DNA, 699 bp, Oryza sativa
agttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggttcagtggagcaaccacgccgaagaagaagctacttgggagcgcgaagacgagctgaaggcagcccatcccggtctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataat

SEQ ID NO: 35015 - DNA, 797 bp, Oryza sativa
  unsure (1)..(797): unsure at all n locations
tgttcccaaggcgtcctatagatgcaccaccgatatttacacccccggcgacacatacttctcaaagctatggttcacccagatatgaggcaggaagtctgaatgagataatgtcttccgatgttgagacactaaggttgctttcttggcatatcggattcatttggtttggtcagctatcacccaactacttcaatttatgtttgtaacatttttttctctttttctattacagtttgggtgacctgaataacattcgaaatgtgacagaactactatgtgatatggtgcatgctttgaatccatctgatcacatggtagtgaaaaatgttcctgcctaaaaactgttacttttgaccatatggactaaatgccagcagattttgatctagctcttgacttgaacaacctccctttttttttaacccaggctgtcaaagatgaaattatcacagatcttgtgagccaatgtcgctcaaaccaacaaaagctcatgcagtttgtcagctcaacagggtaatgttatcaatatttgttgctgccccttgtattttgaattttgtaatgtagtgatttcagggttctcctttgtttctcttcatagcatttcataggcagagcaaagaagtttgcacaaaatgtgatatgatatctgaattcatttatctgttgtttaggaatgaacagttactgaagcaaggtttggagataaatgatcggctacaaaatattatttcaaaannnnnnnnnnnnnnnnnnnnnnnnnnnnnnnnnnnnnnnnnnnnnnnnnnnnnnnn

SEQ ID NO: 35016 - DNA, 5174 bp, Oryza sativa
tttaaccaaagacaaatttattatgaaaatatatttaattattgatttgatgaaactaatttagtattataaatattattatatttgtctgtaaacttagttaaatttaaaacagtttgactttgatccaagttaaaatattttataacctgaaatggagtacaaaatttctattgcctgatggcttccccttcctgctagcctcttcgttgtgtttccgtgaaagttgaaactccaaacaatcgacaaggtccgcaatcagcactaaatttaaatttttaaaacttaattttgatatattttcatcgaatttaaatttagaacttgacgttgatgtatttttaatctaagtgttttcagcattaccattaatcattaagaacatatatatatgaaagttactcacaaattattatttttcctaataagccatacagtttataatcagcctacgctgcttagataagtaagtaatcttcgtttctatattaacaaactatatttaggctgcgtttgagcgcagcagaaagagagaaagatagttttgtttttcacgcgtacgcttcccgaactactaaatggtgtgttttttgcaaaaaaaatttctatagaaaagttgctttaaaaaatcatattaatccatttttgaagtttaaaataattaatacttaattaatcatgtgctaatgactcacctcacacccttactagagtcaatgtgaagcaatcgtccaaaaatgccccgtatggggccggctattatacactctgttctgcagtgacagcctttccttggggagagccgagaacatggacacgcggcgaaccatttccagttaaactgacgaagggataaaaggatcattttgctctcaaaaagtcaaacattgtctgttcgtaaaatgtggacgactttagttatacaaaatcctcaattgtcacaaggcccttcgctctcaagccattttcaaggggttgtttggcaaaataatcacctcgaatcgggggagaaattgaactagtattcccctcaatcgcctttgattggaggggattaagtatggtttataacgtgcggacaacttacagttatacaaaaccttcttcatataatgtcaaaggttggaacttttcacacagattactctattagctattcatctgccacaagcatgccgctccacagtatatggcctatcacacacacacacacacacatagagagagagagagacaaatattaccagtccatctagatttgcagtacttaacattaatgtagagggaatctctttaggacaggggagtaacacacataaaataaacataactggtttggaacatctggcattgcattacaaaaagcatatagcattgcacacagcaaaagctcttgcaaatcgtaacaccatgcaccgtgctctgtaattagtaccatctaatgactccttactgagtgttgatgtttgtgcagtgtcaattaatggactcttaacttgcataatattccgacagcagataaattacaagaactcgagaagctcagcgatacaagctatcaaaagatacttcatggcttgagatacttgtcctgaatgacagtaaggcaatatgccatattcattgtgtagtaatcttcaagatgagatcttaattaatgtcctttgggaactctcccatccaaggtgtgcacagaaaagactcttcaatgaatggttggatacccatacatcctccataatattttgggccaagattgcccaagtcttgaatcttgccaaagcctctaaacttcatggtatttaagtggtatgccagtcctcggctcaatgagtgacttgagaaaacaacttccttgtaagggtgaaatcctagaaaagtaattctaccgtagcgcaaatttctttcgtctgtagtgttgataaaattatcattgtcagagtcccaatcaaagttttgttcctctattgcctcactgttgtcatgtccgtacgcatcaggatattcatgatagttatatcttgtaaggtccagggcccatcagtttgctgaaatgcatgtatgaccagacagctaatagcgttcttctgcacccactccatttttccgtacgattcatcaagaatataaattatgtctggatcatcaaagaatgtacagtacaccctcttctgtgatagtcccatataaatatttgactcctcgtaccgttcaatctctactggtggtttaattattcgatacttgccatctgacaaagatattctgcaaatattggaaaacttagaaatattaaaacatgataaaattgagtgatactatttgttaataaagaaataaattataatacttatcagtgagactacctcattacaaagttggtttgacagcgtacataaagtactccccgacagtagacagcattgtgcagaaaatttggaaaatctcgtcgtatgatagccaaagatcctgcagcctccccttctcgaacaaatgatctctcctcccattgccttgtccttgttgagaaaacatgcagaacgcatgttgacggtggccattctattccctctattgcaggattcaactcagagcgatggcggaagacatcaacataggggatttgaaatacctcaaagtgtgacgacaaggtggggtcaaaggcaaggtacaaattgtctaagtgcatgatcccaatatcaggccttggaggtggaggcaattgcacccactgtcttgtagccgggttaaccacataaaactgcttcatgccgggacgactgatatggctgtaaagcaagaggagcccattgcagtggcccctaactatggatgtgagaggcaaatagttgatgttgccagatattgtggggcctgtcgaggggcgggcgaagaattctgacaagcctagatcatgaaagttgatgaatatgccgcctactgagtgtgggaggaggtccacacgcagcatgcgatgagtgtcgatgatggtgcaccagagtttgcagacacagcgagacatggcaaggtcatgtggcgcaagacaacggaggatgattgtaagcacatcgtcaggcagaagctttgccatggactcctgcttttctgacatactaaggtgatatgtttactgcaatccacccaatcaacacaaccccaccagcatgtatgtgcacaattgaaagaaactaagtaagcttggctaaacagaatggaagaaacaactaacaagagatgcccaggagtttgggtgagactgacttttggatggattcaaattgtattgcgctcttgtctggcgagttaaacggcgttctgttcattgtttgccaatatacgagcactacaaattggcagttattcatgcagttgcagcaactggtaatgttctaggacataatttatcagtcccgggtactagcacatttccagaccagaccccgctcagaaacagtagcaccatgatataccagaccagaccagactagaccagaccagtaaagtaatgaataatctgtatgtataaagcagtccccctaacaatacagtaatatgtgtgccgtttataaaattagttgatatgtcgagaatatctgatctcgtgaagtcatgaactactagtaataacaatcgatcatatgaactgatcaagtacgcgtaaaacaaacccacttagatcatgatccttcctaggtatgcaccttgatatcgggataatgccctggatcagaaccccaatgattctgttgttggcagacaggaggggagggagagggacaacgggggaggaagagagagaagggaagttcacctcagtgtcacctggttcacgggatgacgccgcgacggagcaattcgcgggggtcgcgatgaccgtcgccgtacggatcgaagatagggtcgtgattggcgacccctttccgctgctccgcaactctcccccctctcgtctgctctctcgtctgccttctgagaaccagatccaggggggcggtgagccagagtgagtaaaggcggcgcgaggagaaggagaaccaagacccctatgcaacttaaaaaaaagttactacttacatgtgtgccacaaaaaagtttagagtcacctgtatgtcatgagaaaaactttcgttgacccgtgtgccattccgtccaccttctgttagaacttaacagttccatagctctgacatgtggggaaaatgactaatttgcccctgaaggattttcagctctattcctcctttaatcctcctcttcatctcttctttcttcttgcacacagggagaaggagagagggcgtgagcagaggagagggaggagccccggcggctggtgcttgtcggtgacagcggccggaggtcgacgccgggaatggaacggcggcggccggggaggcaaaagagggaggcggccgggaggaagagagagagagagagagagagacgacggcgggcggtggcacggcgtcgtgcggcggcggtggaagcaatgggagacggcggcaaagcggcgggcgacgacggctatgcaacggcggcggctaaaatggcggcggcggtgtttgctccgggggtgccacgatgcgcccccggtttgtacggcgatggcatggtagcgatgtgttgctggggcgtcgcggcgtggaaggcagcaccgggattgccggatctccgccgccgccgccgcagaagagacggccggggaggaggaggaggatcgggtgcggcggggcacgacggagcgcggcgagcagcctcgccacggatcgcatcgcgggaggctgcgggtcaccggaggaggaggacgaggggctcgccgccggcgatttcccgggtgaggaaaagtggtggctccgatgggttattgtacacaaggacaaaactgtctttacacagcccctaacacctcgttatgtctccatccatccaaaatggcacacgggtcaacgaaagttgggctcatggcatacatgtgactctaaacttttttgtggcacacagataagcagcaactttttaacggcataggggtaaaagactcggagaccaaagaagcgggcgctgtgccgcgcgggaccccccgcgggggggggggggggggttgtacatatcggtcgtccaaaacaaatctaacgattgattaagtatctgtcaaattcaacagtcaccaccag

SEQ ID NO: 35017 - DNA, 4449 bp, Oryza sativa
cccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaagtgacgaagggaggactcaggcgaggatgcaaagatatggtaaatagagggagtacgttgctagtgccactgttctttctcgctgatgtattaaacccgatcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaagcgatttgcgcgagggtggcgcacggtggccggtgggcgtgccgggccgaggtactagcacagtacagcagtgcactgctgcccgatcgaagcggccgtcgcgcatggggccgtttcattattgcgatgcgggccgggagcacagtggcagtgtggactgttgccgcgcccgcgcgcgaatcgggtggaggcgcgcgtgatgatggcctactgggctgctgggctctggaatttgcgcggccctaccacgaggagcggtggcatggggttgtacggcgcgtgctgcaaagggaagcgagaaggggagcacgaggcagttgctcgctgcacgtgtccaggcaatctgttgatatgttttggttcttcctccttgtccatttggatttggatcttcgaaatcccatttgtatctttgtgagaaatgatagtcgttataggccatttatgttaaatttcagcattattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcaggggagcaggccgcaacatcggcacgccctcggcctcggcggcgggttcttcgtcgacctcctccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctccagcctcgcccaagaagagaagaaaggagaagaaagaaaaaagaagagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacgaaagcgtaggaggctaggagccgttccgccactgaaagagcacggatgacgcactaaccggcggcggggcagacgtgacgctcgtatagcgacccggcacgcggcgccttcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcct

SEQ ID NO: 35018 - DNA, 5908 bp, Oryza sativa
atgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatttattttgttctggagtatgctaaaggtggtgagcttttcaacaaaattgctaaggagggaaagctcagtgaggattctgcgaggagatatttccaccaattgatcaatgcagttgactattgccatagtcgaggtgtttatcatcgtgacttaaagcctgaaaatctgctcctggatgagaatgaaaaccttaaagtctcagattttggtttaagtgccctggctgagtccaagaggcaagatggtctcctgcatactacatgtggaactccagcttatgttgctcctgaagttcttagcaggaaaggctatgatggtgcaaaggcagatgtatggtcttgtggagtaattttgtttgtgcttgtggctggttaccttcctttccatgatccaaatttgatagagatgtacagaaagatttgcagagcagacttcagatgccctcgttacttttctgctgagctgaaggatcttatacataaaatccttgattcagatccaagtactaggatttctatcccaaggataaagagaagtacttggtacagaaaaccagttgaaataaatgctaaaaacagtgaggcagccacaacaaacagcatctcttcaggtgtagctacaacctcaggttctgcagagtgcagcacttctgaggaaaatcaagggtccttaagcctcccaaacctgaatgcatttgacataatttctctctcaacagggtttaatctatctgggttttttgaggatacgcatggtcaccaggaagaacggtttaccactaggcagcctgtgacaacagtacttggaaagctgaaggaattggccaaacgcctgaaactaaaagttaagaagaaggataatggagttttgagattggcagcaccaaaggaaggaaagaagggctttcttgaacttgatgcagagatttttgaggtcaccccttcattcctcttagttgagttgaaaaagaccaacggggatactatggagtatcgaaagctggtcaaagaagatataaggccagcactcaaggatattgtttgggtgtggcaaggtgatgagcacctgaactcacaatctatcctgcaaggagagcaacagcagtccccattgccaccagagctaccacaggatcagttgcaaccatcattgccacaacaggagaagcaggacatgcctgaaccaccgttgttgccacaagtaccacaagaagaagtgcaaacatctatccccgcagaacaaacaaagaattagttttaacagccaactggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactgagccgttgtatgtaaggattatgaatccctaattgttggcatctcctgtcgatttcttgcactgtccgcagttgcgcatcgtctcaactcgctagtctaatgccttgctgaagttggttgaagacttgaatggattgccctttgttgatgtgctgactttccatgcattcccgtactgtttgcagcccccagattctgtaccaagtacaggaagagacgaggaagaagggtcgtcgcaccatggaaatggctcaggcgcagccagagagaacccagagaacccattgccggacctggcgctggcgaaatccgagtcagaccggataaaagccttttaccagacggtcctctcggccattgtcgtgttcatcgtggcggcgctgtcaggatacaaggacatgaagccgctctactcgaccacaaatcacaagaaagttcacctcagcaacctccttgtcatcgaggggttctgcatgattgctaccttcatatgcgcggctgttttgatgatgtacgagttctacacgtaccaccatgagatcgcccgcgaggtcgtcgcaggtgcagggacctcaccgtcctcatcgcggtcgccggagcgatgctggttgcgacggacacgatcctcgtcgtcatcgccaacagggacaacgcggtgttcgccgttcttttcgtgccggtgctgctgttagtcggcatggctgtgtacaccgaagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcatgctcgcctctctggcgctgatggcggtggttgtctccgtcgagttcttggacggcttcgtcgtgctctccgtctggccgtagcccgtcgcgctggtgctgtactacgcggcacagctctgctcggggcggcagcccgggggaggagtcgggagccggccatggatcgaatttgtcttccggattgtcgcaccgccgggttcacgctcatggccgggctgtacgcggcgttcctcgggaccaaccactacagcgtgtacctcaaggcccccatgctcgtgctcctgatggcagttctctcgagcctcagccgtctggcgaacccggtttacatgcccgagatcgacggagctctccttgagttctgcgtcgccggcgtggcgctcgccttccccgccgtgtcgcttctggttgcttgtcctttggtgcttaaggtcttcgttgacctatatattcatcatagttctctttgaaccaaggaggtgggtggaaccatggtactccctccagcccataatataaaggattttgagtttttgtttgaactgtttgaccgctcgtcttattcaaaaaattttagatttattatttattttttgtgacttactttattatccagagtattttaagcacaatttttcgggttttatatttacataaattttttaaataagatgagtggtcaaagagtgcaataaaaaactcaaaatcattatattatgggacggagggattaggttactaggtttggtgaggccgtgaggtttcccatctgcttgctgttcggacatagagcaaggataacattagcaagacatactccctccgtctcaaaatataataacttttagctctccggatttgtcccaaaatataacaacttttctagcaatattctcttcccagtcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaattaattatataggaagaagagcctagagtctatatagtaatacaatttacaaacaatgaaatttccgaattaaaaataagaaatattggaagacgagtctataatccatatgggatacaattta

SEQ ID NO: 35019 - DNA, 1213 bp, Oryza sativa
  unsure (1)..(1213): unsure at all n locations
tnnnnnnnnnnnnnnnnnnnnnnnnnnnnnnnnnnnnnnnnnnnnnnnnnnnnnnnnnnnnnnccccaggcccccgccactcttaacttttttttcttgttctttcttctaaggccttcatgcctcttttttgtacaatctgacttaatctgcaatgagaaatgatgaaaaatttttgtgttaattttattttgctatatatatgagttgaggatgatctgtgccatggtccttttgcgccttagcttgaaataagggctcacgcccaagtcccggtcctcgaatggctcgggtcggggctagtgcctggggagatccgcatgtcgagactggccaggccgggaacgtggtgaccgatgggtatgggtgacccgattgtgggtttttgccgatccccccccggagttcaccacgccccggggcacggctcggttctgggccccgtttggcgattttagctgaccgaaccgagcccccgaggacaaggttgagcacgagtgacattatttcaagtcaagattcttcaaaaggaaaaaacggcacagacacaacctttaggaaattgaaactgcttctattgaaatgctgaaaggaatatatgtgcatgtgtggtagcccccggctaaccctgcacacccgaggggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacatcggtgagagtttgctcaatccagcacgcgtttggacgcggcgtatgacgaggtcgtcgacgcaaagtgatcgggcccggacgtggcgctgatggtagcgccgcaggctctgctggtagcgcgcagctcggagggccgcgcgccgccttcgctcttccaagtagtcgaggtcatctctacaaagctgatcttgatcagcctcgcaatacatggtggcccgaggagacctcaaggtgagctcagatgggagaaccgcttctgcgccgtagacgaggaagaaaggcgtttccccggtcgctcggcttggtgtgggtcggctcgcccagagcaccgctggcaactcctcgatccatgaatcgccgtgcttcttgagaatattgaaggtcttggttttaa

SEQ ID NO: 35020 - DNA, 921 bp, Oryza sativa
  unsure (1)..(921): unsure at all n locations
ctgccagatgcaaggcagataattcagtctcgagaaaaagatggtgtagtgttaacaatggcgcgatcgatgtgataccgttgaagtggaaggtgaaggcgacgacgactatggggacggcggtgaagagctcgaacggagaggagaggcgcgagaaatccggcagcatccgcggcatcttcgctgtgccggtgaagagggcgtacaccgcgatgcccaggctgatgaacatgaacaccactgccagtaggatggacacggctgatgtgaacttcagtgaatctgcaattagtcacaggtcacagcaaattaaagggtatgacttcagggactacggtattcaggtatttttcaaatgtcgtagctcctcccaaattcataaggcattctaaccttgcaaaattcatatactactatacgacaccgtccagttttgccaaatcgtagtggaaattggtccggaaatgggaatttagaattcgaccaaatgactgaaaatgcggtttagtttggggcactggatctagagtctgctcgtcggtcctaatgagaaacaacaatcatcgcgggctcccttacgtaccgacacgcttccggagcacaagagggaggaggagcaccgggggtgccaccagcaccgncttccgccctgtccaccattgctgcccggaccactccgtcagcaccccgtcgtgcaccttcccgtcgctcgtcgtgccggacatcacgtcgcctgcaggaacactcacaccaaaatccccggaaatatcactcgtctgcacgcggcgaccagcgctgcaggttcgctgggtgtacggctcgggggagatatgctgtggtgcgttaccgatgatgatgaggtacacggtgagggttccgatggcgttgaaggcgacgaaaacgttgagcagcgcggccccg

SEQ ID NO: 35021 - DNA, 5994 bp, Oryza sativa
ttttctactataaagataaagttagagcatgtaaatgagaaagccattagcacatagttacttgacttttaattattataaatttaaaaataggtttatttaatttttttaattaaataacctctacataaatttttttcacaaaatatacaatttggtcaatttttttaaataaaatataccgtttagtcatggtaatgggaatcgggggaaaatcaccaccattatgtgctgtttccgtagttcgacaaattggatttttgttaaagcgtttagaggactcaatcggtagctgagataaaccctgtgcacgagcgcaatccgacgtccacaatgagccactccatctccatgtcccaaataattcgggtggctcaactactcgtgtcgaacaccgctcgagaactcaaatttacaactcagcactagcttaattactttctatgtcataagtttttggctttataaaaaaatatatagtagcatctttaacattaaacaaatatattatcaaaatatattcaataacactaatttgatgttttagatattgtcaaatttgttctatagattttattaaacttaataaagtttgaataaaaatattcttagtttagtatgaaacggatgaagtacgtttagagtagcaattaaactaatcaagctattttagagtagcaattaataaatactaattaagtgcatcaggttgtattcgagagcaactcaccgacgcggcggcggagcacgagcgggagcagaacgacgatggccgtgaccagtatgacgagctccctcgccgtccaccactgcgctccgaacagctcctgcagaacaccggcgtgctcgtctcctgctcctgcgctcccagacagcacatcccctgcgacggcgaccaagatgctcgacgcggttaattcaatattttctccccgcatgcaattcggatgtatcccagagctgcagagcagcgcgtcctcgacggcgtgggctcaccgatgatgatgaggtagacgacgagggtgcccgtggtggtgaaggcgatgcagacattgagcgccttggcgccggcgcggccgaacgcgtcgcccatgatcccggcgtacgacggcgggccgctgtcccagcccgtgtaccgcagcatgaattccacggaggcgtcggacagcgcggcgacggtggcgatgaggaggagcgcggggagcacaccgagcacccgcattgccgccgggattgacatgattccggcgccgatgatgctcgtcgacacgttgaacaccgcgccggagaccgacgccccatgcccgccgccagagaactccggcagcagcggctcctccacctcgccggcggcggcgccggtgcacttgcccgtgctcgccggcggcgtcattttcggtggggatttcaggcgtgtggatggcgctcgttggcaccacctaaattagtaccacttgaacctatgcttccttaatccggtgaaaattacgcccatatccttacgcgctaatgatgatcgctgtagaagcagcagctggtaacggggcctaatatggtaattccgcgtgggaggcgtactacgcgacagaaaggactgatgtgattacagagcggagagaggaagctagtgtttcaggtgctgtacttggacgggaacacggccccgattcctgattttgcgatgatacaatgaagcgggaccctttttagcagcggcgtgctgatttgctatgcccaacgattggccagtcggccagcctaacggatccataccactggcttgcttgctggaatctagcaacatgacaggcgccggacacaatatccgccgttgaatccatggatccatggggtcgacgtagatgtttgcttttcctttctaaactctccaaagtgagaagacaaacttattttttttacaccgagatgacaaacctggtaaatctaccgcatccctttctccacaaactacgcaccccctttctccacaaactacagcatggacgaacaatttgcctactgagggcccctttgatttggaaaaaaaaatatagcaattttagaggattttaatcctatagaaaaattttctatgaagtcctttgaaacaaatgattgaattctatccaatcctttgaaattcctatggaatggataatcctatagagattttagaggaaatttagcaagagttttaacctcttgctaactttcctttgagtctatctctctcatccaattcctgtgtttttcctgtggttcaatcaaacggtaattcctgtgtttgcaatcctctgttttatacttacattcctatcaaaatcatacgtttttcttattcctacgttttctcaatcctatgattaaaggggccctaagtgggtcaattaagaccaattgggctttacaattcggcaagagaacaagcctgagagttcgcctgcttgggcctttatttaggctgagtggtttacatggagttgggcctacttctagacccatggtaaactaatctacccctggaaagtagtactactactagtgaaaacctttccgtcttcctcccgttcgcctctcctttgcggtttggctctccactggggaaaccctcgaggccgcaagtccgacgccacgtcgcctcgtcggccgacgagatccgcggccggcggagtatattgttggagagcagagctgcggggctgcgcgtgccttcaggccaaaccctctctagtctttctccgtttcttccatctccgtcaacctaccggcgtattcggaaggtttcttttttctcctttttttttgttgaaaaaatccacggaacctatcgtcatggagagacactgccggctgccctctccccaccgtggtcaatcccgttgtgctgcactgctgcttgcccgcctctcgcggaggcttcaaagagacccagcgaggacgacgacctggtttgagaattcaacgctcgccgccttcatctgaccaaggaaaaccgcttgatttatgatttattgatggcatcgcgtatacacgagtacactgacatgcctccaagcttgactgctttggtactctatggatcccggggcacaggcgcacagcataacatcaattcagatttctgatgtgtgaactgtgatccctgcttgctttgttcgtgcacacgacttcgatgcagctcaacttcgtgcacacgacttcgatgcagctctgctacaacttgggaagatgacaaggctgtatttagttggcgcccaagtcaaatgtcctggcaagcgaaagtcgtgagattttaaagaatcgaagtgcagtttagcagactgctactttcccctacctcaagagttctccacatctccagttcttcagaagtttgagcctgtttggaggaattgagctgcttttcgcccgattgacttgtcctgtacatctgtgaggtatgttcacttgtgacttattatgtcttcggtcccagttcatgcataaccctgttctttggctttgggggataaatttgtgactgttggatttggcgatttgggggcgaattcttaagttatgtgtgccttctgctttttaggctgaagaagaaatacctgtttgttcagagtttcagttaaacagagaaaaatggttcagaattttcctgaagacgacatggcaggcacaccttactctgatcaaacctcaccaattttgactgaatatcatatcacagttcctgctcttcatgatggatcaatgcaaggatctgttcatcacgagaggagactcctggattgcctcagagccactccctcggtggagtggctaaagaatatcaacctctgttctccactgacgaatttccggctgccatctaccggcgtccgccggtacctccatgtcgaggttcacttcgtcagaagaatcaactggagctcggtgttcagcttctgcaagaactggctcaagcaccctctgaacattgctctcctggcatggctgctctgcgtcgctgcagctggtggcatgttgatcctgctcctgctaggattgctgaacagggccttcccttccaagccattgaggcatcactggatagagatcgacaaccagatccttaacgcgctcttcacgctcatgagcatataccagcatcccagcctgatccaccacctcgttcttctctgccgatggcggccggaggacgccgcggagctccggaaggtgtactgcaagaatggcgaccgccgtcccggcgaacgggcgcacatgtccgtcgtggtggctctcctccatgtcacttgcatttctcagtacgtggtttgcaacctctactgggcttaccgcagcagatcgcgatccgaattcgccgacaatttcttcttcgtcctcggcgtcgtcgcgcccgtcgtcgccggagcgtacacggtgtacagccctctaggcagggacacagacgacgatgcctccggcgaggaagccaagcagcagcagcagcacatgatcgaagccgagctgcccggaacgagaacggtggtcgtcgaccccgtgtgggcgggcggcctactcgactgcggcgaggaccccgcggcgtgctgactctcggcgctgtgcaccttctgcgtgttcggctggaacatggagcggctcgggttcggcaacatgtacgtccacaccgccatgttcctgctgctctgcgtcgcgcccttctgggtattcaacatcacggcgctccacatccacgactacgacctgagcgacgccgtgggcgccgcggggatcgcgctgtgcttcctcggcctgctgtacggcgggttctggagggtccagatgcggaagaggttcgcgctgccggggagccggtggtgctgcggctcggcgtcgctgacggactacgcgcggtggctcttctgctggccgtgcgcgctcgcgcaggaggtgcgcacggggaacctgtacgacgtcgaggacggcggcggcgtcttctacgagaaggcgatggacggcggcgatgtggagggcggcgcggcatcgacggctgcgacgggagtagtgccggtatcggtgggtggaggagagggggatggcgttgtcggtgacataaaactcggtatggacggtgagatgatcccacccgcgcaggcagtgatggagaccagtggcgatacgcaaggcagtggtgcagacgttgcggcaaatggtgacaacgagctcagtagctaaacccaagggtgattatctgattgatgttatggtgtgcagaagctgcgggggaatcaatcttgttttttggggattggcaccatctttccagcattgtgctcttgctttgtcatgttctgctcagctactgttttcgtgtggcaaggtttagggcaggtaccatagcagaatataaaccaactataaatatattttaaagagataaaagaggaaataaaagagcagcaggctacagatctgtagccagttacagcacgaagatattaatacttcctccgtcccataatataagggattttgagttttttcttacactgtttgaccactcatcttattaattttttttggaattattatttatttattttacttattttattatccaaagtactttaaacacaactttttgttttttatatttgcacaaatttttttttgaataagacgagtgatcaaacaatgcaaataaaaattcaaaatcccatatattatgggatggagggagtagtatagtaagaccattcctaacccaagacattagacatagtttccataaactccacatcatcaagaaactagtattaggcaccactcttccaatataaacaccactattacatacttaaatttaatgtgacttatctcacatgatgtcttgaatgtggggccggctaatgggcgggtgaccgccataggcgatcacccccctatctcccctatacacttctctacttacttcatcctctccttctcttcctactacaccataaattttaaaaaaataaa

SEQ ID NO: 35022 - DNA, 1453 bp, Oryza sativa
  unsure (1)..(1453): unsure at all n locations
nnnnnnnnnnnnnnnnnnnnnnnnnnnnnnnnnnnnnnnnnnnnnnnnnnnnnnnnnnnnnnnnnnagcattcgttccactgaatctgtcatttttatacgctacaaaacatgtacttgtatggttgcatgatcaaccgtgcttcttctgtaaaaattaacagatatggagagttatcagctagagacagagataaacaaggtcaccgtgacaggaaatgttaccccagatgaagtcgtcaaggctctgcagaagattgggaagacggcaactaactggggtgaagactgaagtgttcatctttagctagtagtatatatcagctgatgacttgatgtccttagtccttagtcctttctatggttactttgagctgtttatactgcagatatacagtagtactaaggaacataaagtgggtaaactcggcattgcttactctccctcagtagttgattaatgcaatggattatgcgttgccctgttggattaccttacctcctttgatgtgtacctgatttgtttgcaaaatcttccggatgatgagacaaacttttctacgttttcatggaggatatgcatgatatgtctttattcagaacaaaattatccatcctttccttcaaaatctgaatcagctttcgcttgcactcctatagaccatcttctcgaaaaaagaaaaagaaaaaccctgtcaatggttggattttgttcttccaaaaggataaaaaatgttggagcttgggggcctgaaatcatgtttttctcttctgctgctgcttgcagttcataaaggctgcaaaattggttcttcttttgcttccaaccaattcgtacctgtgaatgttacagtgtttaggcattgtttatggaacagacagaaatccgatgcaacacacgaagttatgtgagatttgtttaactccaatacatatcctaaattgggattcaaagcgtgtcagttagtttgatcctgcaactaacaagaatgatagaaataatcaaactaatcaaccgatattgctatagtgtggtagatgtaggtccaatggttaaagtatacatcggctggatatccgatgcaggtagattcgcatgtatatcggctaaccaactgatacatctaatacctgaagctcataataatgataacttatcggttaaaaccctgatgaaacgttgcatcatattgacttagtagatcaaacttattagcagcaatttaatagatcaaacctaaccgagacaatataagattgaagataaaaagaaaaacatatttagctgatagatctacacaaccgtgatggatatattggatcaatctaaaacaacaatatgattagagaaataccaactgtcgacgtttgaggtcacaactacagtatttgcatggtatggggatcattgataccaggtaaaagatacagagacaatgatttttatacaggtt

SEQ ID NO: 35023 - DNA, 803 bp, Oryza sativa
ccatcccagatggcggcgaaaatgacgtggcagacggccgttcgctctcgggcgacggctgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaaacgaaagagagagaggagagggcagcagaaggggagcggcgaagccctgctggttcgctcacttcatcacaggtttgctcccatatatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgtggagaaaacatttcagtcaatttatagttgg

SEQ ID NO: 35024 - DNA, 839 bp, Oryza sativa
ggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtactgccgtcgccgtagacgaggaggcgatgctccccg

SEQ ID NO: 35025 - DNA, 401 bp, Oryza sativa
  unsure (1)..(401): unsure at all n locations
agttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtnnnnnnnnnnnnnnnnnnnnnnnnnnnnnnnnnnnnnnnnnnnnnnnnnnnnnnnnnnnnnnnn

SEQ ID NO: 35026 - DNA, 732 bp, Oryza sativa
ggacttcctgagaaaagtttttggaggaaaaacagcatgattgctgcacattttgtattaagaagaggaatagttaaatccagacgccatagagtaagttggaacaaaggggggcagaaacctgttcagagagctaagacaggacatctatgctttacagatctctctgagaaattggctgtttggccttgttttaggcccttgtgatgattcagtgacctgtagcctcaataacctgcatttgaatctcagaactatctgcaaactgtggatctcctgattttaacagttcatttggcagttctgaataatcttcgtttcctgccagtaatgcttcacttgatttctcttcaattgactcattacgacatgttgcgttagaagtagcagataccagtgcttcatccttgagctgtgcaaattgtggatccgaatcttcaactgaactcccgtcaatgaaatgtgtcccggtcccagagtctgaagataatggttcactcaattcatcttcaagtttaactgtcaagggttgactgatactggactctgagatggattgcactagtacttcctccatacggcacttaaacaatgagttaaattcatcaatggagtctgcttcaacaatatgtgcctcccaattatttaccttgtaaggagagaacaatattaattgctcaatacctgcatgacatcaggggatctctagagtcgaccgcaggcatcaagctt

SEQ ID NO: 35027 - DNA, 846 bp, Oryza sativa
  unsure (1)..(846): unsure at all n locations
nnnnnnnnnnnnnnnnnnnnnnnnnnnnnnnnnnnnnnnnnnnnnnnnnnnnnnnnnnnnnnnnnntgcattctacaagggattggtatgcaatcaatttgcacttttttttaaaaaatccagctcaatctagtattcgctatattcatgtaattgtatgggcagttggaagcaatagttcatgaagctggaaatgatgggagcataacaaatatcgatgctcttaacacacggattgagaaccaggtatctcgtattaatacccaatcactatgagagcttttgtttctgtttaagcaaatgttttatatttttattgttgcaaacttttatggtagtgtgacaaatgaaagaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcataagatcatttcttgatctccgaagttggttacgtagtaatgatatcccatcatgtgaggtctgcaatgaagcttgtataaaggtgcagatatgtcattatgaattacgattctacatttgcatttatcttgtacccatggtcatatacttcactaatgtcattccatgtatttttattacttatatttaaaacaggcatcatgttgtcctaatgaggaatgcaatgtaaggattcatgggtactgtttgaagaagaaattttcgcagagaaaggaagtaacaaatttttaattccactttacacatatgaacaggag

SEQ ID NO: 35028 - DNA, 650 bp, Oryza sativa
  unsure (1)..(650): unsure at all n locations
cctccccctcgcgacaagctaatcccccgaagaaacttgtgcttcttgcccggccaagatcgaaccaatcctggcgcagaaaaaatcccccaaaaaaagcgagaaaatcaggaatttggaagtgagagattgaagcttccgaaggttttgggagggagagtggcgtgtaccccggtggcgagctcgtcagcttgaattcgccgccggtgagcgagggaaggggccgccaagcccggggcggccggggaaggacaagacgagagggtttggttttctttttttttcccctttccgtgctgcgtgtgttcgctgcaagcctcttgggttcaagagggcagagggtttttcacatcagaacatgagagggtgaaaaaagaaactgaggataatgttattggattataattttatcaaagatagctataaaaatgaattaaatagataatactattggttttattcttgtgagatttgaaaactcgtatacaaatatgctatacattttttctattaatatacatacgttaaagcgtgttatttgtttagcgtacaatgcgggctatattgaatatagccatagcatttatcacttgnnnnnnnnnnnnnnnnnnnnnnnnnnnnnnnnnnnnnnnnnnnnnnnnnnnnnnnnn

SEQ ID NO: 35029 - DNA, 665 bp, Oryza sativa
actataaagttgtagatcgcgtcgagggctataagtttgatataaagtttgtcttcattagaattcacatgaaaaagttatgaattatttttaaatataaagtctttagaccgtcctatttgacccagatgatatttaaatccaagtttagggactagggtgacataactgaacaaattggaggacctaaacgagtgacctgtaagtttagggatcgggatgacacagtcgaacaagtttgaggacttgaacggtcgatttgcgagtttagggaccgggatgacacaacggtaaagtttagagaccggtgatggactttactcaataattaggtacagtatgaggcaccttgagaaaaatcagtgctagaatggaacgttctctttcagatgattacaacctacggagtagcttgtacctaattccgtagtaaacccccataatatttgactctttcattcacattcatcatcgaacccacgctagccatttccttgatcaaattatcacacctactcctgcaggacatagtaaataaagtagcacgttgtcttaaaataatactactccaccttttaatctcataaatgaataaacggagaaatagaaaaaaaatcaggattctgatagaaatgccagtgcaaagcaggtgattgaaaacacag

SEQ ID NO: 35030 - DNA, 256 bp, Oryza sativa
gtagtttacatggaaatcatataaatcagcaggatggtcaagtggacttgatgaagcatcacaatttgaaatcatttgaatgtctggataggcctcccttatagcattataaaacttgaggtaatcacctgtataatggataagagaatatcatgcatgtacctaaaatgagaattcaacagttgttctccacacaattcaagtcaaacatgtgccttatcattggagattatgatcaaatataaatgatttacat

SEQ ID NO: 35031 - DNA, 307 bp, Oryza sativa
ggcgtcatctattaaaaaatggagggagtatataattagaaagaagattgctttggttggctatgcaagcatgccaacgagagagcagaccagcacgtcagagcttgggctttggatatgggctcaacagggaagcgatccgtttcatcgctaaaaaaccgttagaggtcaggagagaaacgtttcatcgtacaaacatcgtacaaaaacaatcgtacgtatagcagtgctgatagcagaaagcatattcacaaatcttgaagcacaaaggaggtaaacaaatattatttggctctgtgacaataat

SEQ ID NO: 35032 - DNA, 435 bp, Oryza sativa
  unsure (1)..(435): unsure at all n locations
nnnnnnnnnnnnnnnnnnnnnnnnnnnnnnnnnnncctcgccctcgcgctcgccacccattcgatcaaattcctcggcgcccatgccgcctcctgcgaccgcgtcctcggtgccgcgctgctcgacgtcttcgcccgctgcggcaggatcgcctcgtgccggaaggtgttcgaccggatcgctaaccccgacctgccggcctggaacgcgctgctctccgcctacgcgcgccttcgtgccagggatgtggcctgcgcctcctctgcggcggatgctatcctcgagatgtttgtgcggatgctatccttagccatcaaacccaacgagatcacgctcgtcgccgtcatcggcgcgtgtggcgagcttggnnnnnnnnnnnnnnnnnnnnnnnnnnnnnnnnnnnnnnnnnnnnnnnnnnnnnnnnnnnnnnnnnnn

SEQ ID NO: 35033 - DNA, 731 bp, Oryza sativa
ggcgaattcgagctcggtacccattgtaatggttttgtcttcctaagaggtctcaaatacttcactccagcaacataattgaagtgacttggccctttttcatcatcaacatcattaacaaggcacacaggtaggtgttcaacctttgatgataaatccaacaatatagccttttctcttgtggcaggatttgctttccacttctcagtcatcttccaaagtgaaattccatcaggctgtcctgggtcccttctcagcttgtacttgaaaacattaaatccgttctttgccgtgtctgtccaagtgtcttcgatacgataaagcccatcataaatatatattttgcctgagttacagaaggggtcttgtgcgctgcgcacaaccctgatctgattcttcttgctcttgctgttcatgagagcaaggttacctctctcaagcttctgatcgtgcttctccttgtgacgactgttgcctccctgtcctgtgtacaccaaaatgtcagtgtcatcatcgtcattctcatagcctccagatgaaatgatgcagacagccagagtctcatctttgttcttagaagagatgtaatcaatgccacccatggctggtgcatgtaaaccaacaatgcacatctcaatcctaaagaagaaaatgtcaccgacttcaacaccaggcacatgccctatcatcttatgattgttgattctgaggttggtctgcatcatgagagt

SEQ ID NO: 35034 - DNA, 728 bp, Oryza sativa
  unsure (1)..(728): unsure at all n locations
tggcgtacaccatccaccgttggataatctcgagatacgtgcctctggaatatccgataactaattaattgtggctacttaaacacgaactagaacgccggtgatgtgtagtttatctgagtaaaaaagaacagtggtatagttcagtcttgagtctttcatggcagaacactggaggtgttgaatttctgatcattattgcatcagctggttgaactcatttcacttcaacacacacctcattctctcccaagacagtacaccccagtaacacattttctgctccaggctatgagcttgtctctgattcttttcaggtcaaaagtagtcaaagtacagtagcgcttttaatctccttgcaagagcaaaacttgcaatcgtttcactgagaacgtatagcaggaaaaacaccaaaactgataaaatgcagcaaaaagcaagtgatgcctctctagtttctagcatcaactattatagattctacattctcgacgcagaaaagacctatgcgaattttcacctagggctgctaactcgttgcacgatgagcatcttcagttcgaaaaagcgtttcgcgcagttggacagacacgaggcttcgctgttgctgaagctgcttccaatgctcccagtgatgcatttgtcccagcaaacatcagtcagcttnnnnnnnnnnnnnnnnnnnnnnnnnnnnnnnnnnnnnnnnnnnnnnnnnnnnnnnnnnnnnn

SEQ ID NO: 35035 - DNA, 895 bp, Oryza sativa
cctgtataatgaataagagaatatcatgcatgtacctaaaatgagattccaaaagttgttctccacacaattcaagtcaaacatgtgccttatcattggagattatgatcaaatataaatgatttacatcccaaattttctaaaaatgaaaataatcacattttagtatgtttgctaccaggaattgtttttatgtgttactaatcctagtttatttgcaacaacaaaaaaatagaacatatattactacaagtaccattggcttggcgaagtacagcagaggaaaaggagaacatagggcataaaaaaagtaatattatatgcagattaaaatagtgaaaacaaatgtctccctgtaaggttttgctatggagatttatgtgactaaattaatgaaccacttctaaggaaacaggtacaactgcataaagaagttgcggcctttatttacagagtgagttgagtgactaccttcataaaaaaaattacaggattagcatggtccatgtacatatcttttattcgatcatacaccttaatttattccagacaaggctcttcaatttatgcagttatatggtgaagtgataaaataagaaagtaattgaggaatgcaccgcggtaaaattttttcccacaatcttcatttccaattgcgacgtatttgacagggaatggttcggggtgccccattgcagctctaacaaaaccccatgttgaatctgcattcccccttgcaaattctagactgtccaatacgttctgtagagagacaacaagagatgttcccaaacaaaaaactggtgttaccacaagtaacatagctttaattcaagaaaagaatttagtattttcttggtaggtacattggtatctgtaagtataccagaatgca

SEQ ID NO: 35036 - DNA, 1293 bp, Oryza sativa
  unsure (1)..(1293): unsure at all n locations
gtcacgttgtgcatcgacgcgctcagctccaacaacggaagcagcaacgtcggcagctacaaggagttcgcggtgatcgccgtcgacctcctcacggccaacgcgacgagcaccaagtccgagatagacgccatgctccggagcagcggcggcggcggcgacgccacgacgcggtgcctcaagtcatgccaggcggtgtacggcgggatactgcaagttcaggccgccgtcggcgccgccgtgaagggcggcaggttccaggaggcgatttcatcgctggagaaatcggcgagcgcggtgaaggagtgccgggacgggttcggcaagagcaatgtgacgtcgccgctctctgtggagaacgacgacaccttccagcttgcggagctcatcgttttgctcatccgtgacgaaccatgatagagatgatgtttatacgtagtcgttttttactcaaagcatatttagccatttgttatttatctcattttcaaataaacaacgatcaggggatgggttttgcaattcagagagaatgaacatgcgcacaatgcagatttggctgggtttgggaggaggggttggggcacgcaaaacgaagctcgtattattgtatgattaattaagtattaactttttttaaatgaattatatgatttttttaaataactttcatatagaaagtttttacataaatcattacatttagcagtttgaaaagcgtgtgcgtggaaaacgagagaggtgggttgggaaaatgaagggtagaacacagcctatttttcttcagaacatttttacaagaagcccttttaaaaaacattccaaaaataagccctgtcgtgcaacgcaaacggcacgacgcgtgtgacatgagcggagaagaggagcgggctggcgcggcgcatgtgtggtcgagtgagcagacgtgtgagcagatgtgtgtgagagagcgtgccagtcgtggggacgtacgtagcgggcgggtgggtccatgtccgcgtggaggcgtggagtcgtggagagagcgtctgtatgtacaatgctgctcactgatatgtaggcccaatagatccttgagcccacatgtcagtgtgtatttagggtttactaaaccgttagggtgggttattgtcaccccacgttttaacggttaccgtgataaccacacagttaccgcaaggtatactagagtttcaaaagctgagaatgttaccgtacgtgataatcacgataatctacgtnnnnnnnnnnnnnnnnnnnnnnnnnnnnnnnnnnnnnnnnnnnnnnnnnnnn

SEQ ID NO: 35037 - DNA, 1396 bp, Oryza sativa
cacgacaaccatatacatacccattatcttctaactccatcggggggatcatgcttctatttattagctcgttgaagtacccttccccaagctcaaataatcctatccccgttgcatgttcattctggataaaaccttcagctatccacttccatatcaaaagatttttctcgatcccatattcttcccgaaatagactcagatacagcatgcaagcctttagatgtgaaggaaggtcatagtaactaaaagacagtattcttcgagtattctctacaatgtcattgcctctttcaccaaaaccaatagaattgtacacattagaccagtcctcccctgatttacttgccaacaaactagctattgtgatgatagctaatggcacaccaccacattttttcaaaattttatcacatgcctcagttgaaagactgtctaggaatctgtcttcaccatcatttattctagaatataataatatttcagagtcatcacgagaaagggtttgcattttgtaaatatcaccgatatgcgtggcgacttcaaaaatacgagtagttaccactactctacctccacaattactatgttgcagagcacatctgatcaattcccatgatttcttatcccatatgtcatcaataacaaacaaaaacctatgcatccacatcacagtacaataacataagttagtaaccatgcctagtgggaagaatgtaaaaaacaagaataacaccaaggtggcaccgtggcaaccatttgaaagaacacacgaaaatgccactataaatcaacaatttgtagaaagtcgatctagtgtgaataaatcaaatattataaagttacaagttgtatacaactttttttaaacaatgttgatggaagaaactctttataatagccatactgtatatcagcttagaaagcatatgccgcatatcatccacgatctatcagataaaacgaactagaccttaatctataactataatagatatcaatcatattctcaatgttcttgtccaatcaacttgactgtgcctcagttacctttggatgcattttgctttatagcctaatatgtcatacccaaatgattttctcaaacaattgttcatgaccatgcgcattgacaacataaataatatgctataatgcaccagcccattaatattcttatttcagctcatctgctcatgtgtacattcaagtttaggctgtgcgtgacccaattattctattgtagtggcagtcctgcctcggtaaaattagatatgtttgtgctaccttacaatgctttatgatataattgtagcactttgggttaactttttctacacgaatcttggtcaaaagcaagcataagcatttgtgctttctgtatacaaacatgccc

SEQ ID NO: 35038 - DNA, 948 bp, Oryza sativa
  unsure (1)..(948): unsure at all n locations
nnnnnnnnnnnnnnnnnnnnnnnnnnnnnnnnnnnnnnnnnnnnnnnnnnnnnnnnnnnnttaggacgtgataagaaaatgaaaggcaggaataatgtcaagtaaactagtacctggagaaattcataatatccaaggccatcatcagtccagtaatgccaaacatccccaaagtgtccaggcctctcttcccatggaccaatagattccctccacctgaatgcgttccttaaccattccccctccacaaagcaacctcctacaattgtttgaatgtaaatcaagtcaattatcccagacatgtctggcatatatgtacatatcaagaacttgattttcaatgggaaaatatagctcataccagggaatctcaagaatcgtggttttaagtccaacatcatagatataagttctgtgcgaaaaccatgtccctgtatgtgtaaaagaaatgttggaagcacttgaaaaagcccatgaagacttaaagtgttatcatacactatacatagatagcataaaaagcccatggcatcgttttccttttccagtaatgaagtttgacaacaaaatataatgtaccttgtaagtgtctgcaggcatgagcgatacttgatcaaaccatacaactcccttcttgttagttgttatttgaagccttgaggttctatttgttccttgagcaaccaacttctgcttcagttttgtccaattcgatgcaccagaaaccctgcaacaatataatcctttcaaaactaatgggaatgggcaaacattcttgttctcctgttccagtattgagagaaaaggcactaacggtatggtaggtgagcccaattttgcgacccatcaaaacttgttaaggaaactgtcaacttcacaggttctggtgattaacatacattactaaattgtagatctttccatcttctatggtctgcgggttgatat

SEQ ID NO: 35039 - DNA, 743 bp, Oryza sativa
  unsure (1)..(743): unsure at all n locations
nnnnnnnnnnnnnnnnnnnnnnnnnnnnnnnnnnnnnnnnnnnnnnnnnatctgtcgttgtcacacgtaacaaatatatttctctgtcttctcttttttatgtaagtaaaatcatattattaataacttagagaacatgctattaattgttattatacatgccttagccatatttggtcagagatttacggggaatcaataattgactctacggatctactctatctaatcattaactagagacacgatctattcgtttttaacaccatgcaaaacatgtccatatatagttcacacgcaaggccacaaaggtattcatccaaaaaaactattcgacatcatcttgcagatcgatcgaggtttcacaatggtctcctcccatggcgtcatcaatccctcttcctcttcgccattgtcctcgtcgcggcgtctcaagttcaactcgccatcaacactgaccctttcatgtccggcgcatgcaagaccgttgctggcagcaacggtggcgtcatcagtgtcacgttctgcatggacgcgctcggttccgacagccggagcctcaacgccaaccactacagtgaccttcgcatcgtcggcatcgacctcctgacatccaacgcgacgagcgccattgccaagatagacagcattctcaaggatgatggcggcggcatgaaacccgacgatgccacaacagtgagccttcagatgtggcacgcggaatacccaagcgtgtgtaggaa

SEQ ID NO: 35040 - DNA, 758 bp, Oryza sativa
catatgcacataatcaataaagatcaaataggaagctaacacaatattttggatccacaagagagaccaagttagaatatgtgaagtttaatacatacctctcatcatttttacttccatatccaaatgagactagtcaaagaaaggctcataaaaacataagtctcatataattagatttgtcattaatcaccgaaaccaaattaaggcacttgaacttacaatctccccctttttggtgattgatgacaaatccattaacaataaccacatttggatatgaaggatataaaccaacattatattgaagcttgacaattgatttatatccatacatgtcaatgagtaaatagaagtgaaatatatgccaatgacatgcttatgcatatgatgcatatgaaggatataaacgttagtctcatactgtcatatgaagtggaagttaaggggaagcacacatgaattgtgtccaatccaataaccagatctcaactactttaaaataagtcagaattgaagtaagagtaaacaaataagctactacctccgttccaaaatataacaacttttgtctataaatctggacacacaactaaaaatgtttatattttagaacggagggagtactatttttgttcgttttaattttttttctaagtcaaatgatcaagtttataaaaaatataataatatttagtacataaaatagatgtattatcagtttaatgaaactaattaaatattacgaatattgctag

SEQ ID NO: 35041 - DNA, 11749 bp, Oryza sativa
  unsure (1)..(11749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatagtgttagagctcaggagggaatcgaagctatagcatctttaaataggcgtgcgatgctcatgctatgaacaagacaagtgtgagctgagctacatcataacgtgacatctgtagcctgagccacggacgcaataatgcaagcgcctctactgagtatgtgcaccgttggatcttgatcgagcggttggaaaggcagaacgggcaaccgcttgatcggcaattcagttgcttctcgggctagacatgtcctgttgcgacaagcaactgaacaggatcgacaaaagaggacagcatttccaatttccatgtacaaattaacacaaagcaaatcatgcaagtttttttttttttactatgcgtgcattgaattattggtcctatttatgtaaataaaatatcttcatcgaatgaatttcactggcaagcacgcaaacacacggcaagaagcaagagagggaagaggggaagatactgaccacaaagacataaatctcatgaagtcggaaattggacagtagtagtatttccgtatatgtacttgcacaaatcgaatcaagttcttgtctgtttaccatgtctagcttgaattattaattgtgcctagttatttaattttttttttacatggatgaatttcggtggcatgcaattattgaacactgcaaaaggacaagaggggaagaaaaagatgcaagtacgtgaccacataaacattaattatacactcagaaatggcaagacattcttaatgtatgcatactctatttgcctatattaagtgcatccaacgatggcttagcccatgtctcactttttctctcttcattttgtttgttctcttgatgtaccagctagaggatttccgtttgcaagtaatcacatatgtgtacctgtaagtacattatattatttgttcccttccatacataatctgctgaattttacaaaatgacagaaatgcacacattgttgtaacaaacaatataatgcgataaagaaaaatgtacaaacaaatgtactaatgcatattacatcacacctgacaaaagcaataaataataaaatttaaagtggatgatgaggtgacacacttggatattgagatttagtagttattaagcattaactttatagtaaaatatgatatacatcacgcatgcttgtaatcatcatggaccgacatctctgaaacaagtgaaattttacgatccttgagaagatatctcggtacctaaattttacacctttttcttatctcgagatacttagtatatagaggaattagattttaactagaaaagtttacactaataactagaggtatctcgagatacttaggctgtgttcggaacttctagttcccaacccctctctctcgttttccacgcgcacgcttttcaaactgctaaacagtgtgatttttgcaaaaagtttatatacgaaagttgcttaaaaagatcaaattaatccatttttgaaaaaaaattactaaatacttaattaatcatgtcctaatggaccgttccgttttccgtgtaaaggagatgggttcctaaccctaatgagcgaacacagccttagtatctaaaggtatcaaattttatctcgagatacatagtaagcgtcatgagtctcgtggtgtttgctacccgagcgcaacacaacggcttgccggaggcgtttggtagtatggagtgtcagaggcgcggcaagcgccgcgacggcttagtgggaggtcacaccaggtcggagaataattctccaaaccccctccccaagttgggttcacacaatcaaaccattggattgagaatgtgcgacgatgtgagggaaagaagggtcggaggcgtcacgaatgtttttttttcacacgtaacacaacactaaaaatctgtcgttgtcacacgtaacaaatatatttctctgtcttctcttttttatgtaagtaaaatcatattattaataacttagagaacatgctattaattgttattatacatgccttagccatatttggtcagagatttacggggaatcaataattgactctacggatctactctatctaatcattaactagagacacgatctattcgtttttaacaccatgcaaaacatgtccatatatagttcacacgcaaggccacaaaggtattcatccaaaaaaactattcgacatcatcttgcagatcgatcgaggtttcacaatggtctcctcccatggcgtcatcaatccctcttcctcttcgccattgtcctcgtcgcggcgtctcaagttcaactcgccatcaacactgaccctttcatgtccggcgcatgcaagaccgttgctggcagcaacggtggcgtcatcagtgtcacgttctgcatggacgcgctcggttccgacagccggagcctcaacgccaaccactacagtgacctcgccatcgtcgccatcgacctcctgacatccaacgcgacgagcgccaatgccaagatagacagcatcctcaaggatgatggcggcggcatgaaacccgacgatgccacaacagtgagcctccagatgtgccaggcggcatacgcaggcgtgtgtaggatcaagcaggccgactagaggggggtgaatagacggttttaaaacttaatggcacttaaacaaaactaacctaagttgctagacaaggtgaggtgcaaggttaactaagcaactaagttaagttttgcaaacctaactgatatgggctcaaatatgtctctatgaatgtaaatagcacaaatataaatgcagcaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacagagaggactacccaagcctcgatcactcggggtagttcttccttcactccgaaggtggtgaactccaaaccactcacaaacggtgccgggcctcctccacaatctcctcggagaggtcaccgggcaacacctccacaagacgtctaggaggcggcaacctccaagagtaacaagtctaggatgcttgccgagtatgatcaagtgccacactagctataacaatgaagcaacgcacttggattggcttaactcactctctaacacctcactagataaactaagtgcacaagggtgtgagagctcttgcaagggttcaagataatgcaatggagtgccaaaaccttacccttgctgctgaggagtgggtatatatacccccaaccaccaaaactagccgttggaaccgaaatccccaactttgtgctctgccggtcagaccgccgttgtgaggccggtcagaccggactactttgtaacggctagaaaactagccgttacagggcaatcattgagcccactcaacctggccggtctaactgcagtgtagtggccggtcagaccgtccacggctcggtcagaccgccgtcggctcggtctgaccggttgcggctctggcggctctgtatcgccaccaaaaaccagaccagtgcaacagaccagtggagccggttagaccggccttaccacgccggtcagaccggctaacagacccggtcagaccggcctaaggcccacggtcagaccgcaggtcacttttcagctcaaccaaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatagcacaagatcatccacaagctcgcttcatagacccctcttgatagtacggcgcctatctagcaaatctagtctacaccaaacaccaagaccgggaaaagactaagaaaacattcttagctacattatacctttgccttgcgccatccatcttggggtcaagcttgagccgagatcaacacttgtgaccattcggttgaaccatgtttatgccgaggtcttgtccatcctttgtcaagactttattctcatcaaaagcttgacttcattcttgccaacatgacgatgtccttgacttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccaatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacatataccttcatgatctccatgttctcaatgtaaatgagactaaataagataacattcgagtaaatattagtctcacacttatatatcaataacatggaaatcatatatatgaacctatcaaaaagtaggagataagaagtggtacatatcgttttatctccatgcatttcatcctagtcatgattaaggtccatcaaaaaagaatgcatgtcttccacatctcattatcgggaaataacctagtagacaacttatgcaaaagagaggttaatcccataaacatcggtttatcatctatcactaaagtaacaattacacaaattgtttaatccaagatctttcaatcttttctctctttggtgatgagataaaaaatgatttcaaatcaagatagaaatcttataataaacaaaatataggataagctctccctcaagatgtgcatacatatggatatgaaggaacgcatatgcacataatcaataaagatcaaataggaagctaacacaatattttggatccacaagagagaccaagttagaatatgtgaagtttaatacatacctctcatcatttttacttccatatccaaatgagactagtcaaagaaaggctcataaaaacataagtctcatataattagatttgtcattaatcaccgaaaccaaattaaggcacttgaacttacaatctccccctttttggtgattgatgacaaatccattaacaataaccacatttggatatgaaggatataaaccaacattatattgaagcttgacaattgatttatatccatacatgtcaatgagtaaatagaagtgaaatatatgccaatgacatgcttatgcatatgatgcatatgaaggatataaacgttagtctcatactgtcatatgaagtggaagttaaggggaagcacacatgaattgtgtccaatccaataaccagatctcaactactttaaaataagtcagaattgaagtaagagtaaacaaataagctactacctccgttccaaaatataacaacttttgtctataaatctggacacacaactaaaaatgtttatattttagaacggagggagtactatttttgttcgttttaattttttttctaagtcaaatgatcaagtttataaaaaatataataatatttagtacataaaatagatgtattatcagtttaatgaaactaattaaatattacgaatattgctagttatttttataaagttgatcaaacttatttaagtttcgctaaaagaaaaagtccaaaatggaagtaataaacactagtgttggacgaaattacaagcaggatgccagcgttccccatccgcaccgggctcaggccgagtcgcgcatcccctcggcttctctcgcgacgacagaaaggaggcgcctgactcagtcctctctcggctagggcgccgcgcggaggtttgggctgcgcacggcggtgacggaggcgcacaacggcggcggcataggagatctggtgcaaggtatccataaactcaaaggctaaaatcctggactttctccctcaaatctggtttatttcttgggggattcattgcttggttgccagttaaattttcaccgtctgtatgtctattattacttgattattagtcagtatacttcaaccatattctcaatatacttgtcaacttaggatgtgtttggttttccggaccgcacctagctcacacctagtcagcagggttgtgttcgtttagatgcctgcacttggctcagagccaggttcgatggatgcaaaaaggcccgcggagccaggctgagttgcggcctggctcgcctcatgccgcgaggctgcatccacgcgtgcaccgcttgcacccgcgcgtgcagaacccatggatagggtcaccaccatccctcctcatttgttccaaaccagtggaaagctagggtttcgccgactcgcgagtggagggcgctgctcgtcgcgccgtcctcgccggcgggagggccggtcgtccgtcagcatcctctcttccgttgatcatcctccctctctttcgctagccgccatcgctctcttccactggttcgctctctccgtcaagccgtttggtttcgccggctctctgctacgcccctctctttcgtcgactctctccgttgagctctctggtaagggctaggttgggcatctccttccttttctcacctcctccagttttcttctcctctcttcctttgatttcagccgatttgtttggattagaccgtgtccccttcataaatatgctagatctactaaaagctgatatctttcttagttgatttcgatggaatgaaatgtctagtggcttgcttttttgttctaagatggccaatgatgactaatgttgctgatttgtgatgcttatgaatagatttttcctacacttattcctatttcctgttgatttgtgttatgccattgtatctttgcctacaaatagaagttactgataaggcaagaaatagtgcgttcttttaaattgatactgacagatacacacttgattaatagtgcttatttgtgatgcataagaacagatatgcctgcacttgaccttattcgataaggtcaggccaccaaacatgccctttctaagtttctgtctttctgtgatctttctcagtattttatacttcagatgatcttagcagaactgaggccacctctacacttgaattgagcagaatttataagagtacatgaacagatttttctacacttgttcttttttcttgctgttaggctgggaaagatggccaatgatgatatatgctgctgtttgtgatgcatgtgaataaatttttgctctacacttgttctcattttcttgtggttttttttcctacatttggtcttattttccttttccttataccttttcttttgctacatttgatagatactggtaagaacagataccaatgatagtagctaattcacattcttcatatatctgaggccattgttctgcatttatttacctgctggaaatgaggctcaatgatgtcaaatttctgcacatttgctacattttcgagttattgatgtcaggcaaatactatcaagttccttgttcatgttttgatatcaacagatgtactcatttttttttggtaaccacacttgattttgacatgatcaagtttttatatgaaaccgatacactctgcacttgctcttttggtaaagataatactactattaagtgttgatgttcttgcgacctgatctctgcaactctgatcctgtactgtttcaaaggtacaggttatcctgtttacttttactatgtttcaggaaaatgtgataatggaaaaacttgtgagatcaagtgtagatatactaaggttgatgagtttgaagcaatctgtacaaaagcttgcaggcagaacatagctgaaacagatggtttagttttgtatgcggttacagatttgtttatcaaattggttacttgtaaaaaacttgccatgagcacgtatatttgtatgtttgttttgaattgtcaaatgtaccagtgtcgtcaataaaattatgtagttgatttttgctagaataatcactcttgcgtgttcatccaggccatttcgttacatttgttaaaaaaaaaattatcatcagtgctgctcattggttttaaaaaatgacatcagtaaaacatacatgcacagtacatcgattctctaagacaaaaatgagcttaggaatattagtaggtgtgcacacacccagagtaacataatttaatctataacctctacgacggattaaacttatcacacataaatagattagggacttggaaaaaatcttgtttcacaaactttatgggggtaacctcaccacccacaagaataggtattttacacacaatatgtatctatccaaccaaacaacatctcctgcatgctaccattccatccgccccttgctgcaaccaaccaaacaacatctcatcatatccaggttcatctcatccaagcaaccaaatgcctgcatgtgtatcccctaaaccaggctcagcttagcctggatgagggagatgagccaggctagagggatacgagcaaccaaacacacccttagatttcttgaaagatttggtcagcaaaatttagtactaacttagattggatacttgtattatcgatctgtagttatagtttacatgagatgcacatcacatcagaaatgttttcatgacaccttccgttccaactgcctgtatgtttcacatttgctctcgagaaactagtccctttgtatcactgctattagttatgttgttcttttctgtatggttcactatggctgtgtggatgttgttcttttctgtacatataaatgtcaacttgtagactctgttcagaatcaatcatctcaattttcaacctatgatgtatgttggtattgaaaaaggattggtgtgagtgagtggatgacaggcatggctcaaaatgtgtctttgaagggtgttaaaatgcccatagattctgctgattggaatgactacaacactagagttgtctgtgagatttttggctatcttgcagcaacttgaaagtatcaatcttttggagtaccaattttgaattacttttagaaccttacatacttaccatgttgaaattattaaggaaaaggaacgattaataatcaccatgttaaaattattagatgtgtcttgtttagtccatattttcaggttgttatcctgtagaatagagtgctcattttagccttagttcgtgcagatgattgtagatgatcaaagctttaatatgcatcttgatgcataaggttttattttatatgtgcaacaacctagagaaactcaaatctgtctggtatgccatcttgttcttgtctttgattctgttctttgagttcatttcaaattatgtatcgcattacagaaaattttatcttatatttttctaatcattctataaaaactaatagttcttctctgagaatgattcacatgaaatttgtgatgtccatgtcacatgcagtccattaaggcccttggcatggcacatgcgacgacaaccacaaccttagttttgtttgtcatatcatctctgttactgtttggtgcaccttttttttcaaaccttgtaattttggattatcattaacagcaacagtgtattttaatttttctttgtcagttgaactcttagatcttactgtgtattaccatgccattttctacctgtattttacagtatgtgtttcaaatgcaggcactgcactatggcgtctagacgcaatgttggggggtatgctcctcttcctacagaggacagggatgacagcaaccttactgatgatgtagaccttcggttcacttacaccccaaaatccctcagaaaaatcccgtggaaatcaattgccctggcactattcctcctcctcctaggatgttctcttctcttcctgtcatattttatattcacaggtcacatggagggggataactctcaggcatatggtctcttgttcctgggcatccttgccttccttcctggtatgttaatgtacactggtttaccttacattttcacgtaacgttatcatggaatttttttcatcttctcaatgaaatttttcccccaattatttattgatcatttgccatgacttccttcaaaagtatttattttagtgtagtttgatggaaatattgctacatttttctataaacttggtcaaatttgaagaagtttgacttaggacaaacccaaaacaccttataatgtggaatggagggagtgccatactggaaacagaatggtcatactctttggatatgaaatctatttaagtgtgcatcagtgtaaaattatgtcctttgttattgttgtagatagtagacagctctactattgtatccatttagcgagatggattatattgttctgacattgttttgtaggtttttatgagactcgagttgcttactattcctcgagaggggcaccaggatacacctttgcatctattccagattattaaccttccattgtctcaccaagggacagtgacgatagaacatggacaaaaacttgaatcttcaatcaggatgcaggaatcaaatgagctcttattttattaccactaaactgttaacatctaaatgaagtcagctgctgactgctgtgttcacctgatggcattgctcaccaggtgtcacttatctgtgctttgcagacaaagtaaactcgtggtcatactcgtctgttgctacatactccagatgtagatggctgtttgtcaccaggagtagatggctgttttaaagttaccgcatatttttgttccacaattccattgtattttgtgttgatgtcattaaggttttattttggctgcagaaatagtataaccatactttcatctatatattcaagttcttatagcagctgatggcaatgtgttttttgtactgcttttctccatcatgatatttgtacggataaattccttctgtgctactgaaagtaaatctattccgacagctcggctcctcggtggattctaatgtgatcgatttatacatttgaatagaggtcaggggctactgttattgtcctaaatatgggatactctatacttgtgtactaaacttggttgggcccaccatcaaataattgttctaaaaatgttcatgactattcgtgtatttattttttataaaacgaggaacatcatgaaaacatccatatgatggcatatatacggggcaaaactttgtaacagcatctttttcatagnnnnnnnnnnnnnnnnnnnnnnnnnnnnnnnnnnnnnnnnnnnnnnnnnnnnnnnnnnnnnn

SEQ ID NO: 35042 - DNA, 1165 bp, Oryza sativa
gtctgttgctacatactccagatgtagatggctgtttgtcaccaggagtagatggctgttttaaagttaccgcatatttttgttccacaattccattgtattttgtgttgatgtcattaaggttttattttggctgcagaaatagtataaccatactttcatctatatattcaagttcttatagcagctgatggcaatgtgttttttgtactgcttttctccatcatgatatttgtacggataaattccttctgtgctactgaaagtaaatctattccgacagctcggctcctcggtggattctaatgtgatcgatttatacatttgaatagaggtcaggggctactgttattgtcctaaatatgggatactctatacttgtgtactaaacttggttgggcccaccatcaaataattgttctaaaaatgttcatgactattcgtgtatttattttttataaaacgaggaacatcatgaaaacatccatatgatggcatatatacggggcaaaactttgtaacagcatctttttcatagaccataaactctgaaaaggaatctcttttttttcatctaattaaaaaaaccataaattccctcatggcaataaaggacgatgcatcatttaatggggagagaaattaacggaaaatcaataatcgattctacaaatccacgatataatcattgattcgagacgatcgatcaggtcattaaatgccatgcaaaattttgtgcttatataattgacacgcaatggcgtcaagaaaaccatctgtttcaacattatcttacagacttgcagaaggtttccacaatggcctcctccaacaatggcgtacagcgctctcttctcttggctgttctcctaattgctgcgtctcaactcgccgccggcatcaactcggccgtgtacggtgcgtgcaagaccatcgccggcggcagcgggctcatcggcgtcacgttctgcatcgacgcgctcagctccgacaaccggagcagcaacgtcggcagctacaaggagttcgcggtgatcgccgtcgacctcctcacggccaacgcgacgagcaccaagtccgagatagacgccatgctccggagcagcggcggcggcggcgacgccacgacgcggtgcctcaagtcatgccaggcggtgtacggcgg

SEQ ID NO: 35043 - DNA, 1042 bp, Oryza sativa
  unsure (1)..(1042): unsure at all n locations
nnnnnnnnnnnnnnnnnnnnnnnnnnnnnnnnnnnnnntggaagcgatcagagcaaaggcaatggcgagcctctcgctgtggtaggacagtgcatccgccttgtcctcctcctcgacatcaaacaacgcagatgaggtgctcgaccggtgtccgcactcgcttaatctggtctcaatatcctcaaccatggcgtatatctcctttgaggcaggatgcgtcttgtcacccaccaagaactcatggagaactccattgatgtctacaaagcttgatccagggctcttgtcaatgcccatggacttcatctccttcctcgccttcttagcgtcgtcccatcggttcgttgttgcgtagaagttggaaatcaggacatggtttccactgtcatccggttcaagtcgcatcaattctgcgatcatcttcttgccgagttccagcttgccatgaatgccacaggcccggatcagagacctgtatatcgcagcatttggcacgatgggcattccgtggatcagcttctcggcatcgttaagtcgaccagcccggctcagcatgtcaaccatgcatccgtaatgctcaatacttggctcaatcccgaattcgatctccattctgtcaaagtagtccagaccttcatccaccaatccagcatgggcacaagcacacatcacggacagcacagtgacgccatccaccggcacgccctcaccgtgcattctgtcgaacagggagagggcagcacggccatggccatggactgccaagccatggagcatcgcattgtagcagcgtgtgtccctgtccgaagcggctgcaaagacctgctcggccaggtccagcctcccgcacccggcgtacatctccacaagcgcggtggccacaatgcagttgacggcgagccggcgtttcacggcataggtgtgcgcccacaccccatggctgacagcgccaagctcgccacacgcgccgatgacggcgacgagcgtgatctcgttgggtttgatggctaaggatagcatccgcacaaacatctcgaggata

SEQ ID NO: 35044 - DNA, 11133 bp, Oryza sativa
  unsure (1)..(11133): unsure at all n locations
taaaacaaattgacacgataaatcaatatatgttataccatttcataaatatataaattaaaatttggcatctataagttgagagagggggttgtcttaaaaaacgaagagagtggactatggcatcgatgatgtctggcgatgcgtgatggcaatgaacagcggcgcgagctcctttgacgtaaagtccgagggacgtgggtccctgatgataggcgaggcccactttcataggcccacacgtcaatagccatgtccctctgactttacgtgaagcctcgtccgtgaacagcgggatggacggagtggcatataatggaagaactcgcattctcgatgataaattccccaaggcatataaattaggagaaaacagacgatatgccactctctaagatgggttcggataaaatgccactcaatataatgcaccagataaaatgccactcaatacattgtttaccggatgaaatgccactttggagacttttatgcccaaaatgtccgtgtagcacaggatgactcgccaggcggcggtggcggtggcggcgacggaccgcggggacgacagggggaggaggacagggtggcgaggacgacagggcggaggaagaggccacgctgatggagccttagacggacctgtcgacggctgtcgtccccgtcgccgcccgaccactgttgcttgcgacgccgtcctcctcccgcataaactttttctcctcctcccccacgtcgcctcctcgtcctcccccggtggcgagtgcgcgtgggtgccactgccgccgccgtcctccttccccacatcagcgccctcgccctatggagccggcgctgtcctcccctcgatggcccctccccgatggagccggcgctgtccttcccccttcagcggggccctcctcctccccttcttgctgcccacccccgcgcgctcgctgcccaccggcgacgagcacggccgccgtcgtttctctctccctttctctctctccacggtgagggcattttggtctcaaaactgctcaaagtggtaaagtatactgagtggcattttatcctttgcaatctaatgggtgacattttttcctttgcaatattgtggagtgacattttatattaggcagtaaatttcgaaaggattgtaaatttggatggtacataattaattttttcgttttgatggcaaaatcaatagaatgaaatttacgcatgtatcaattcgcggcaggcagtcataattggagggagaaattaactgggaagaatatatcaataattgattctacatatccacataatcactaattaactgggaatttaaagccatgcaaaatttgtgcatatataactcacccgcaagggagttcagaaaaccatccaattcaacaaatcatcttacataggttgatcgaagatcaaatccaccagtatacgtaggaaactgaaaatgtcctccattaatggcgtcagtatcctcttcctcctcgccgtcctccttccggcgtctcagctcgccgccggcatcgactcggccctgtacggtgcatgcaagaccgtcgccggcaacagcggggtggtcagcgtcacgttctgcatctacgcactcagctccgacaaccggagccacgacgccgccggcttcaaggactacgccgtcgtcaccgtcgacctcatcacggccaacgcgacgagcaccaagtccaagatagacggcatcctccagaacggcggcggcggcggcgccggcgacgccaagaggcggtgcctccagtcgtgccaggcggcgtacgccggcgtgctgcgagctcagcctggcatcgtcgccgacgtgcagggcggccggttgccggaggcgatttcagcgctggagaagtcggccagcggtgcaggaatgcgagaatggtttcggcaagagcaacgtgacgtcaccggtcaccgcggatgacgacgactccttcggccttgccaagcctgccgctgagtttcttcgttgggaattgaaatcctgaaagagagatcgattatctaatctgttttttctcaacataattagctatttatttccctctatggccatatctccttctcaaataaacaaagataaagggaggttgaaatggatttgcaatttagagaaaattagcatgcacgcaagtggagtatcttaaacatgttttttttattttacatgctgctaatggtatttatgtattccctaatttatcttctctaatgtttccacaattagaagacatatggatcctacaggcctactcctagtatgcctagaataggagacatagtaggcctatgcctagaataggagacatagtaatttacttttgactactgtctcggttccttttcgcgctcgatttttcagcatatccggatctatcgtgcttgacactgtatttctgattttttttaccgtgattgattagtaagtttaattaaactttttaacagaaggtttaattttaaattgaaaattttgagtaaattttaattcaaatttaaaaacttttaactcatgaaaactgtaaagtcaaattttaagaaacttcacgaattttgaaaactttcaagtcaaatattgaaagctattaactcgaatttttaaaaaattttaactcaaatttgaaaaattttaactcgagtttgaaaactttcaactcgaatattaaaaactttcaactcaaattttgaaaactttcaactcaaattttgaaaactttcaaaccaaatttaaaactttcaattaaaaattttcaactcaaattttaaaaactttcagctacaaatttaaaattttaactaaattatttatgtatttctttaacataatggtataagcactgtcatcagagatgagcactacagtgagaaagtttattaacgaataggagcaaactcaaggtcattgatatgctttagaagagagtcgaggtgctccaaagtgaaacaacagcaagattatatagtccaaaatgaagacattggtttaagggtggtccaaagcgaaacatcctaataaaaggtggtctaaagtgaaattactcaacaacaaattaaactctaaatagtttacgtatattcatagttaaatttgtttgtttttgttacaacttatggaagccaaattataacttgtagtttgtggagtgatatattacatgttaaaccatattgtcaaattttttttgaaacatttttataaccatttagttgacatgcaataaacgagtggatgtctacacgggtgattacaatccctctctgttctgccaggcttgctgattctgtcagcaaaattaaaaaagaggtggttcatactaaaatcaaatttgttgtacatactaaagttcaaataaagccctcactataaaaaaaaaagaagttgcataaatattaagacattacatcattcccagtcccaatataccaccctgcaacttgtgttctaaaacatagccagatcaaatgaggtcaatgagaatggaaggagtaagaactgcatctcttgcccagcattgggtaactcccttgtaactggcacaacctgcaacaatctagtatgttagacaaactcgcgatgcctgataatttcttgtgttccactgaaattaattcactgcatacaactcctttagaaagatgatgaaataattccagacacgaccaaataaacaggttccgtaaaagcttacgaagaaaactaaaaggaagaacagagaagatagatctacaaagggtatatgcttatgtaccacacaccactactttgagtactacaaataggagacatacagctcccacagttttacttcaaaaataagggcatatgtcctaacagactataatgttgtaatggaaaagctgtcctctgctaaatttcagtgcataattatgaaacaaatagtgatcaaataacgactatcttaccttgtttggttcactaaatgaattctcatccagtaagttgctggatgtgagaacagtcacagttgattttgccgcatttacaccagcttgaagtccacttgaagatattgtaaggttcacagcacttggcccaaagtttactatctgcagatagaatcagtatgttctaatatatatgagcatattactccagcagtagaacaaataagacagatgttacgcaagtaaccggtgcttcaatcaattttatattgttgaaactacattattctaaacactaaggcgcttgtcgatcaatgatttcaagcaatggtatacaagtttggagaaactggaatggttggtttacctttaccctcagaaagatatcctcattgtcctgccaggtgattgcagatgctgccagtaaatcaaagtagctggagctgatagtgactggatgaatcacagaaccacttgattcacggaaatatgtttgcatccaataactaggagttccatactgttgccaggagttgaagacaattgcatctgggttccagctggtttttagatttacacattaattgtcaaagagagaacagatgctagaatcctaaacaaagtaaagtactaaaccatgaatactaacgtgcgatcattttcattcacgaagagtggtgcatagcttgccatctgaatgacatcgctgcaaagaagcaagcaaagtccaattcagtgtaaatatttgtttttttaataaagcttcctcttccccgcaaaaagaaatatttacaaattagaaatttatacatactagttttcctataatttctgaaatagttattttccttctgtggtgaagtagaagaatgagataataattgtagagacaaattaaccatttgtctaggaatcccttcaaagatcttttatgttcatgcataatctggagacaacattatatgcatgattttatatttcctctgtgtaaacgagagggattggcgaaataagatgaataattattgtattaagcttcaagggctgtttatatagcatgcatggcttggaggttaagaaactatcttcgagataagaaaagcctcttagggataagtcagtatcgggatgacaaatactaaacttccaaatacagagatatgccaaattgccaatatactctaatgctctaaacccaagataaaggagagagtatcctgagaggaactaaagggatcacctgtttttctctaaaccagtgaggaaagcagcttctgccaacgatgcaaggaggcttccattgccagcatcaccccctttgtcattattaacagcatactcgcttacaaatacctggagtgaaacaatagcataatcaatggttattttgactgtctgagaaaacagtaagacataattttaaaacagggagaatgatacaaccaaattagcttcggttagtattttacatggaagtcatacagatcagcaggatgatcaagtggcctagacgagccatcacagttcgaaattatttgaatgtcaggataagcctctcgtatagcattgtagaacttggggtaattttctgttcagcataattatatggttatatgatatcacaggaaaattaggatattggtgatagcagtagagcattgaagtgtactgaaacaacattaattataattgatagtcaatttagctttgttcacatgcaactagtaaagtgtgtctgtttcaaaacataacaacaggctagacaattaacctattttcatttgtttttcctagaatacttccattatagtactcagagtcaaaagagttgcaggtaaatgaaatagcgcttttgttgcagatcaatagagaacagaataatgaattttggtaattatcacagcattgacatgaaggaccataaacatactattttgttttagtcaaaatttaccttggtatgtcggcttgaatatttcacaatcttcattcccgagtgcaacatacttcagtgggaatggttcagggtgtcccatcgcggctctaacagagccccatgttgattctttactccctcttgcaaactcaagactgtctattgcatcctgtagcaagaaaatcaaagtatttcgaaataataaacatgggatgacaataaatgcaatgccttatgtaatattcacaagttataactgttttctgttacatcatgagaagccaatcttcatctcaaccatacttcaaaaaattgtagggtatcgaaaacatacctttacaaaaggtgtaagcatagttccattaactacatcactgtgactcatccctaaatcacaagataaaaactccgagcaggtcattggtatgcgaggagaaaagattaaaaaaaaagtaaaacaagacaaagtagatgcagaatatttaccaatgttgagcacccgactggagcagcacccaagtcttcagcaagatttatgaagacatgaacagttcgaagtaaacaaatgatcagatatgatgagaccaagagagaactcatttgacattaatcaatccatacctggagaaagtcataatacccaaggccatcatcggtccagtagtgccaaacatctccatagtgcccaggtctctcttcccatggaccaatagtttccttccacctgaacgcattttttaaccaattgccttcaacaaagcaaccccctgccaaatgtaatgccagcgattaaattacagggcaaccaaaattgattaccagttggaaaacaatcataataccaggaaaccgtagaaaccgtggttttaagtccaaaagcatgtacatgagttcctggcgaaaaccatggccctgcatacatggaagaaaaatgcctatcaacaactcctgtgaactaatagtaagcatggctagattaaggaacaataagttgatctcacatctctacaggactaccgattacagataagttaattttttttttttgtcagatagaaatgagaacaactgaccatttttatgatgacttttttcgaatattcttgaaaaatgtcaaatagcatacatgatttgaagagggtgcccattgaacctggcatgcttatactagtgactaaatctttggggtcagtacatgaatattattctccattcttcataagatgatagcagattccggatcaagctatgatgacaatagcaataagaagataaaaggcaatgcaccttgtatgtttctgaaggcatgagtgacacctgatcaagccatatcactccccttctcctagttgtcagttcaagtcttgaagttctgcatgtcccatgagctagtaactgcagctctatctttgtccaatttaacaaatcagtttctctgaaaaatttgatgtacaatcctatgagttagctagcgaacaagagagagagagagagagagagagagagagcgagaaattgagaaagctttttcttaatctcagtgctaaggaaaaaaaatatataccgaacaaaatttgatgccagattttgcgatccatttgagcatgtgagtgaagccgtcaactccaccgattctaatgatctgatatgcatgactagattatatgtcttcctttcttctacattctgaaaattgaaatgatcataatcacattaaaatatcagaaggtaaaagtgaaaatggtttgacgaaaagctataacactgattacactttccaagcaagtgatgcacggcaataagatagaaaaccagcattatgcgatcaatgcaaattgaaagcaaacaaaaaataggttagcttagttatctgttagcttcagtattttgataagaataataactttgctataattaccttcggtggcagcaccgtatactttaaactatcatcagaaaaaagattctttcgattacaagatctattttgcatattcatatgggaatgagctgctatatgctgagagagaacttataccatgccccagaatcctggattgtatattccaacaccaccagctggacaatcgtcacagacaacctctatccttacagcaaccggattttgactgaaacaggatgagcgatcagttgtgacgtgcacagaggattcatctccaatgatggaccatgggtcaatgtttgatgtgttggctccagcttcaaaacctaaagcaagaaattagacaaaagttcagttaaagttaaacttcaaatattattatttatttatttatttattgagggggaaaatgttttcttattcaacattgctatacatgaggtgattgatttctccccaaatattcttggcagtaagatcacaattcacaaatccaaccatccatgttgcttcttcaacctccagccttctcgcacacagacacacaccacccccaaccaaaacgaggtcgccggtgaatctcgagcatccctgcgccgatgagcctcctcctcctcctcctccttttggctttcctccccggcgcgacagagggcgaatggattagggtattgtgttggggtggggccgtggagtggatctggcggggtagggggtttgtggagggaggagcagttcatcggggctgcgtattcagggaggggaggccttgggcggtagggcaaggcggtggggtggcgcccccggttgcggtgggtgagaaggcggcggatccggccgcgagagacgccggagatggtgcaggtgcaggtgcaggtgcggggagggaggaggcaggagggaatcgttcacaagagatgaaaagaaagaagagaggagagagagagagagagagagagagagagcgtagccatgagctggaggttgaagacgatctatcaaccgttggatgggcatccaacggctgacagcactccactgctatctcctcctctaatttaagactgaattgtactttgtgcgtaaacgtttcactttgcatcaccctatacacaattttttttactttggactagataattttatctttattacataatggacaccctaactctctttgttagccatgtctatcatttccttcggcaaagatatagcatgcatataagtatgaaagttcatcagcatgtcgttaacgatttgctcaaaatcattgaagtgctgaagatgtggttttgagtaatccattatacaacaaagataaagttatttaaaatgaaaaaattgaacataggatgatccaaaaaccaaaatgaaattttaaaaataaaacatgatccaaataaaattaactctttaatttaatgctcaacttcacaagagaagagctctagaaaaacaaaaaggagaagagagacaaatcgtgtctatgagctggaggttgaagacgatcaatcagcctggatgggcatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgacatggagagacgccgtctccaacgtctcggcttcgcatctgctgccgccgccgacgaagaaaagaacgaggaagacgacgacgacgacaatggcttgccgggacagcatgctcctcgtcgccggcggccacactctcatcattctctctgcgaccacaatgatcaatggattgggtacgttgttacttgcgagagggaggcttgattattcgaggttgctccatatctactgctggaaattgctctagttagatagagtaagtcacttgctaaaattgccaacaagttagttcattcacatatatgggttccagtaaaaatgtacagccagagcccatattttcttcatttttcctcttctttatctgctcatcttgattcattccacagaaattcctctgccaagggaggcttgagttagtgtgacatgaactacactacttgagttacacgaaacgatccaaaatgattatttgaggttgcacgatctactgctggtaaatgctttagttagagagagtcagtcacttgctaaaattgccaacaagttactagttcacttcacaagttcacatgggttccagccaaaatgtacagccagcccatgcatattttcttcctttttcctcttctttatcttctcatcttgattcattcgacagaaacatatcgaggaagacgaatgagcacaagcatttctattgctaaccccgtgcacgttgcagctgcacatctctgccaccagcaccactttgtttggaccggcccagatcaagaacgaatgaggagcaagtgcatatgctcctgcatcgaagctgtggcttgagatggccaaaaccaccaattataccacacattgacttgtgcattacatccagagataaaagtagaaaacagttgcttaccttatccggggttactgaaacagttctcatcaatgcaaaagacacaaagtttccctctccaatcttttctcccatcatgattttatcaaccaccagttgaatttgttctctactcagcttcccacaatgtaaatgactagtcagtatacctatatggggaacatgccatatttacagtgaaacataaccacaaagaatcaacagccatcctaatatggattggactccatttggatctgctcaatcctaaattcaaattctcagtccataatctgagccttaattttctcaagtttaaatgccaacttcagttcaagttcaaatccttaatcaaattctgatattctctacaaatctgttatccttggaccaaattattttctctttcccaggccaaagagctcatatttgttatccttggaacaaagcaacacggtggcaatgcgccatctagtctcatccgatataaatatggagaaagcaaaaaaaaaagaaaagaaaagaaaagaaacgaaaagaaggaagtaannnnnnnnnnnnnnnnnnnnnnnnnnnnnnnnnnnnnnnnnnnnnnnnnnnnnnnnnnnnnnnnn

SEQ ID NO: 35045 - DNA, 3010 bp, Oryza sativa
  unsure (1)..(3010): unsure at all n locations
cagagataaaagtagaaaacagttgcttaccttatccggggttactgaaacagttctcatcaatgcaaaagacacaaagtttccctctccaatcttttctcccatcatgattttatcaaccaccagttgaatttgttctctactcagcttcccacaatgtaaatgactagtcagtatacctatatggggaacatgccatatttacagtgaaacataaccacaaagaatcaacagccatcctaatatggattggactccatttggatctgctcaatcctaaattcaaattctcagtccataatctgagccttaattttctcaagtttaaatgccaacttcagttcaagttcaaatccttaatcaaattctgatattctctacaaatctgttatccttggaccaaattattttctctttcccaggccaaagagctcatatttgttatccttggaacaaagcaacacggtggcaatgcgccatctagtctcatccgatataaatatggagaaagcaaaaaaaaaagaaaagaaaagaaaagaaacgaaaagaaggaagtaagccaggagtgaattttattcatcattccctgtgtattacactatacagtagtgcttcaagatacatgcacatatatggacagcattctggtattcgcatatcacatctcgtgtatttcttgtgtttctgtcgctaaccttgtgttgctgcttcacatctctgccacgagtttggactgggcaagcgcaagatcgaatgaggagaaagagtgaggagcaagcgtgacttgcatctgctctgctgcattggaaagctggcttttgacaggaacaacctgcattggttgtcatgagcaaagctttggcttcagatgaccaaaaccacaaactctactagacattgatatgtgcattacatccagtaagaagtcagaaatgtttgcttaccttattcgggttactaaaagagttctcatccatcacattactggatgtgagaacagtggcagttgatcccagtgcattaacacgggcctgaagcccagttgcagagatcgtgaggctcactggatcagacccaaagtttataatctgcacaggagatttcaagatcaattcatgaggtacgcaatctcctacagatgtagagtaggtttagaacaaaatttcttacctttactcttaagaagctattttcagaatcctgccaagtaattgcagatgctgccagagaaccagagtagctggaagtgattgtaactggatgaaacatagcaccgctagattcaccgaaaagagtctgcatccagtaactaggagttccatattgttgccaggagttaaatacaatggcgtctgggttccacctgattgtttgattgaagcattattacagtacttgttaaataaacaaaaacacaaataaagaaaccatggagtcatcaaaactaacgtttgatcattgttgttcacgaagagtggtgcataacttgccatctgaacaacatcactgcaaagaaccaacaagaagttacaatgaatatcttgttgcatttgttagtagatcttaataaagccctacccagaggaaagctcaaatgtgatctgtcacaagacccagaaagaaaagattgtttcaaggaaagatcacctattcttctccagtccagtaaggaaagctgcctctgccaatgaagcaagtagacttcctctacctgcatcacttctccaaacagcatattcactgacaaaagcctgcaaccaaaacatatatgaagaaagatagaagtgaataagcaagagatgcaatgaggttccaagattatccaaaacatgtaaacatcatcacacatgacatagatgaactgtggacattactgaattattgttgagaaatagatgaccaaggtcatcctacaaatatacgagagatgtcatgaaatcctggattattaatgtaaaatattagatgaagatgggagatttcacagtgctattctacaagcatatccacaaatgaaaaaaggtccacgacaatggaagtccgggcatacaacgtaccttgggcccattacgagatgatctatcaaatgtattcttcattgaaaacaaagtcttagaatcagtatagacctagaaaaaaggaattgtttcaatttaataaatgggaaaagccttgacatttgtgacaaagaatgagaagtgctggagaacacaactcaagaggatgagtagtttacatggaaatcatataaatcagcaggatggtcaagtggacttgatgaagcatcacaatttgaaatcatttgaatgtctggataggcctcccttatagcattataaaacttgaggtaattacctgtataatggataagagaatatcatgcatgtacctaaaatgagaattcaacagttgttctccacacaattcaagtcaaacatgtgccttatcattggagattatgatcaaatataaatgatttacatcccaaattttctaaaaatgaaaataatcacattttagtatgtttgctaccaggaattgtttttatgtgttactaatcctagtttatttgcaacaacaaaaaaatagaacatatattactacaagtaccattggcttggcgaagtacagcagaggaaaaggagaacatagggcataaaaaaagtaatattatatgcagattaaaatagtgaaaacaaatgtctccctgtaaggttttgctatggagatttatgtgactaaattaatgaaccacttctaaggaaacaggtacaactgcataaagaagttgcggcctttatttacagagtgagttgagtgactaccttcataaaaaaaattacaggattagcatggtccatgtacatatcttttattcgatcatacaccttaatttattccagacaaggctcttcaatttatgcagttatatggtgaannnnnnnnnnnnnnnnnnnnnnnnnnnnnnnnnnnnnnnnnnnnnnnnnnnnnnnnnnnnnnnnnnnnnnnn

SEQ ID NO: 35046 - DNA, 7595 bp, Oryza sativa
  unsure (1)..(7595): unsure at all n locations
nnnnnnnnnnnnnnnnnnnnnnnnnnnnnnnnnnnnnnnnnnnnnnnnnnnnnnnnnnnnnnnnnnnnnnnnnnataaaaaaagtaatattatatgcagattaaaatagtgaaaacaaatgtctccctgtaaggttttgctatggagatttatgtgactaaattaatgaaccacttctaaggaaacaggtacaactgcataaagaagttgcggcctttatttacagagtgagttgagtgactaccttcataaaaaaaattacaggattagcatggtccatgtacatatcttttattcgatcatacaccttaatttattccagacaaggctcttcaatttatgcagttatatggtgaagtgataaaataagaaagtaattgaggaatgcaccgcggtaaaattttttcccacaatcttcatttccaattgcgacgtatttgacagggaatggttcggggtgccccattgcagctctaacagaaccccatgttgaatctgcattcccccttgcaaattctagactgtccaatacgtcctgtagagagacaacaagagatgttcccaaacaaaaaactggtgttacgacaagtaacatagcttcaattcaagaaaagatatttagtattttcttggtaggtacattgttatctgtaagtataccagaatgcaaattcaggttaaacatcatcactccttgtgaacattgtgaattaatttttttgaaaagaactttgagaactaatagagtaaaagaacaagcccaaaaccatctccttttttacacaaataatcagctctatttcaatagtgagaaaataaggcaagagttttagcatcattcaatgagacacatcatatgcagttacattcttaggatctttaatatttagatatgcaaagataaaagatggaacactactatgatggcagtaaagatagtatcagttttctcacatgccatatccatggaagtgcagccatagctaggacgttacaggtgaattctaaagtggaaactatttaacaaatcaaggtgcatctgacctgacagaaaataaaatagagagttcagaacatacttttacaaaaggagcaatcgcagcagtatcaacttcatcattatggctgattcctgatatttaaagagtttagtgtcgattcaggaggtcagctgtggtgatcaagatataaaaaatatggcaattattaccattgttgaacacccagattggggcagcacccagatcctcagaaagctttgatgtggagttcaaagttttcattagaaaaatatagaactcaaaggcaatatatgattaggacgtgataagaaaatgaaaggcaggaataatgtcaagtaaactagtacctggagaaattcataatatccaaggccatcatcagtccagtaatgccaaacatccccaaagtgtccaggcctctcttcccatggaccaatagattccctccacctgaatgcgttccttaaccattccccctccacaaagcaacctcctacaattgtttgaatgtaaatcaagtcaattatcccagacatgtctggcatatatgtacatatcaagaacttgattttcaatgggaaaatatagctcataccagggaatctcaagaatcgtggttttaagtccaacatcatagatataagttctgtgcgaaaaccatgtccctgtatgtgtaaaagaaatgttggaagcacttgaaaaagcccatgaagacttaaagtgttatcatacactatacatagatagcataaaaagcccatggcatcgttttccttttccagtaatgaagtttgacaacaaaatataatgtaccttgtaagtgtctgcaggcatgagcgatacttgatcaaaccatacaactcccttcttgttagttgttatttgaagccttgaggttctatttgttccttgagcaaccaacttctgctccagttttgtccaattcgatgcaccagaaaccctgcaacaatataatcctttcaaaactaatgggaatgggcaaacatccttgttctcctgtcccagtattgagagaaaaggcactaacggtatggtagttgaagccaaattttgcgacccatcagaacttgttaaggaaactgtcaactccacagtttctggtgatttaacatacatcactaaattgtagatctttccatcttctatgttctgcgggttgatatgacaattacgggtgatcagagtattggaaaagaagcattgcaaaagttaggaaagcaaatgtttactaacacaagtgcacaaaagagctatcactacatgaaaaatcgaaacagaacatgtggaggtccatgatttacttgttaattttatgagaaaaggaaagaaaatggcagcaatactgtgaggaaaacaaactaaagaacaacgatatataagcccataccatgccccagaaccctgggttataaatgccaacaccaccagctgggcaattatcacagagaacctccatccttagagcaacagtattccgactaaaacatgacgttcgatcagtcgccacaaatatggaagagtcatcaccaattatggaccatggatcaatgtttgatggggtatgagggcctccagcttcaaaacctgtgcataaaactcataagttggttatactaaaccctaaatgtcaatataacttcaaaaaaagggcatattattttccatcgagtttatgctcttaatcaaagttttgtgtgtcaagtttacagtactaaaaagataactatgtttaaagtttatggggaaaacataatttagttaatcagatagtatggagaattttcgattaaagacaaaataacaaaaggatttttttttcgtaagccatgtttgtgttccagcagactgcagaagaatttattcatgtccattcagaagcaaattatgttttatctggaagatcgatcaaaataagtgcatatattacaacaaaaataactgaagtacctctgttactaacaagttcagcccatattccaccagcccctgcatggttgatttcctacaatattagccaagatcattatcatcaggacatggtggaacatgtataatctacctggattattctgggcatgctaatgcacttgagcatcctaacaaaaaagtgccagaggaaaggatatagtgatacagtgcaattgtgaaaaacagaattactgtatatgtctcacggcttacctcaaaaaatattccaaatagtgtgtcagggatctgtcgagcaagttgcggtgaggcatcaaccttgaggaccgcagtctgggtcgcatgtaagtgtaactctgaagctatacacttgcagccgagggagaacagaagcaagaagaagaaaatggtactcatgaaggattctctggaagccatacttggagctgtaaacactagtgcaggccgtgtgtctgttgaacaaataaagccagaagatgatacagtatgagaagtcaactaaggaagataggcatcggacaagtagatgctattactagatggcatgaaaacagcgataccattagaagaaacgaaaggcaaacatagacaagacagtgatatgtccaaaaccatgcttacaagataaccaaatcatttgctttgtttagaaaatcacaaaagcgttgacgccagacaatttggcaaggattaggaaagctgaggtttcaaatgatctcatcatcagggtaaacaaacacaaaaaccaatcaattgccttctactcggtcatttcatcgaactggtcgtttgcataaccaaagaaacaaaattggaaacaaaagaagtcaagcaggggggagcagtaaacgatttcaccaaaatcgctcaccataaggccaccatccaagacctcagacctcaacaaggaaggaaggaagagaagctgggcgccggcgaggcgttggggggcggacagacacagaccgaggctttggtgttaagtagaggagaggaggagagagagacagtggctttgaagggaagtgtacctcgacctcgtggggaggcacgcaacgcaagcagaggaggtcgcgcggccgcctgatggtgatcggatgccggaggcgcgcggcggcacggacgggggagttgcttgccgcggcggggttcggcgcggcggttgggtgcggcccgcggggcccactgacatacacgtgggattgattatccgtagctacagtatttaatcatcgaatggaatggatcatctgtctatggctctgagacatctctgtgcccccacactgcctggctctatctaggcttagggtgtgtttagtcgcgaaaagaaaatttttaggtgtcacgtttgacgtttgactaaatatcgaaactcgaaaagggttttcagacacgaatgaaagaactaatttcataactcacctagaaaccacgagacgagtttattaagcctaattaatccgtcattagtacatatgggttaatgactcaaaaatttgtctcgcgatttccatacaaacagtacaattagttttttaatttatatttaatgctcctttccaaagattcgatgtgatatttttgaaagaaaaaattgggaactaaacgaggccctaatctatagcatgattggtgtctaaaataaaacaaaaatatctcaacagagtagagcctggattcaaatgcgatatttgtcgtggtccttatcgagctggctgtattcaaccataattggccaaagattaaaaaaaatttgaaactttttaacaaaatttatctgactttcatcggtttttggcaataacgttaacgacgagagttatcaatggaaacgctagggagggatttcagctatcgatcacattttgaaatcataaacagagcacaccaatacaaaagaggatcggttcttcatggttccttgctatcgcaagggatgaggcagttgtgcctccgtcaaagtttgtattagtacttcctcgcaaaaaaaaaaactgtattagtactaccaaagtataaaaaaagaaaaaaaaatcctctaatcaattgatcatttcaacaagactataaaattacaagtagctctctcctaggatttggtcagcagtgtggcagtgaagattgtcatgttcattctacatagttctaggtactaggtaatagcgcatgttctggcatacagaaagaaataaaaaaaaagagtacaatactgttatatttagacattttattaagtttattttacccctcaactattgcacttgcataaaatacccatttaactctaatatgaagtacaaacattgctgttattaatagggtagttcggtaatttaccataccttcatgttttgtctataaagaaaatgctagaatgacgaggagtagtgtgttttgttttacaattccgcggggccgtacctaataatctgagtcccctatacgaatcacaaattggtatttagaaaatgccaagaaacaaaagaataaattagtggtggtattttacctaagtcagaagaattttttttaaagaaataaattttagaaaaagaattgtggtgtgatgtagtgattttttgttatgtggaaaaaatagaatttgtaatgcccgaaacatactccctccgttcatattcaaacccagaattgggtttttttgagacgaagggagtatgttcgtatcattatcaccctctttaaggtggccataattagtagtactacttaccaaagctgaagaaacaaactcattctagttaaatctattatattattaaaagaatagaaaaaggagcttccacgttcgttctcatggcctagaaattctcacattaatcgaagaaaaagaaaaggcagagtccatatagaaatacaatttaaaaatagctgaaattcggaattaaaaataaggaatattagaagtagagaatagagtccatatagaaatacaattaggaaataactgaaattccgaattaaaaataaggaatattagaagtagagtatagaatccatatggaaatacaattagggaataaacataataaaattaaaagtagagtttagagtccgtataaaaatacaatttacaaataactaaaattcgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaaatcagaaataaaaataaataatattagaagaagagcatagagtttatatagaaatacaatttacagaaaattcggaattaaaaaaaaagaaatattaaaagatgagtctagggtccatatatgaatatatataatttacaaataactaaaatttgatattaaaaataattaataactaacacgtatataaaatacaatatgaatattacacattagtagttttgtaaagttattgcaaaatttaaaattatgttgttattttaatatatttgaataatataatgagaaaacatatatgttattatataagagaaaatataatgatgctagccgcgcaatctgcgcgggccaccatgctagttaataaaaagtaagagtacatttttttcaaaaaagaaaaaaagcgagtgaaagatctttaaacatattaaaatgcattggcataaattaagatatgaaaaaaaaatttaggacctctaattagtcatccacttcgtaggtagtccctcatcgacaacgttgcaattctgatcattcatggctagaatgaaattgattaaagaaaagtggtgattagttaagaacctagtaagatgtagccatgcaggacagcaagtgaaacaaatttcccagattatttgccgtcaaattgaggaactatattgaccgggcatgcatgaaaatactcgctcatgcgtgatgattgatggaatattatggcgttgctttgcttgggttgggtctaaacgtgaaggaacatcgatcgatcatacaagcgcgatagcgatgtgactcatttaccactgatctgacctgattctgatcgagagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatctgatgcgctcttgcgtgtccgtttgcactcgagatattgaagaagaagaagttgcattgcttgcaagatatatatgcgacagtaatcgtcacatctgtcctggagaatataatgcacaagtgttcattgcagttccactactcttctatcgatctttaatttcctgtattactattaatctgcccgttctaacgctatggtggtatttaataacgtaattaaacaactaaaaatatatacaatgtatgctttagtgattaagactataatgcacaagatagttttaagatcacacaaaagaaaagaaagagaattagattgtttaaacatcaatctgatatatatacataaataggtcaaa

SEQ ID NO: 35047 - DNA, 1741 bp, Oryza sativa
cgtgacccaattattctattgtagtggtagtcctgcctcggtaaatttagatatgtttgtgctaccttacaatgctttatgatataattgtagcactttgggttaactttttctacacgaatcttggtcaaaagcaagcataagcatttgtgctttctgtatacaaacatgcccctacaaaaagggcgatgcaacattgaaggggaggtcttatatgttcaggtactaaaacaaaattcacatgctgaactgctgatgaatacgtagatgttcatacctcttgttctggatgagtttccgtagttcgttgatgagctgcctttcatccaatatcatcacatttggattcatgtagtcaaaatcaataagaatatccctcaagactttcttcatgtcaggatcccgaccaaccggaacaaaagccccacagtcaaatgccagtttatgtttgtcatatactgctttggaaagagtggttttgccgagtcctccaaatccaacaatagagacaatcttcattttctcgtcggaggcatgaacatcatccccaagggataatatctttacgagcttttcactctgcttttcaatgccaacaagctctgtcgtctttttgtatagcgcctgaaggcgaggatcgatggtaacaggacctgtaaccttggcgataatgttgtccaccatgtacctgtcacgccttgcagccacctcctcgactttcttgttcacgtcttggatagctccagcgatcttatggtgatgcttgcacttgttgaagaaattagccatcttcttccggaagcgcctgagcatgtgtgtgtcaagaggctcaggaccatcgatgtgcaccaagaaagcgtcgacgacgtcctccatgtcgtaggacagctccctgacatcccctgcccagagcttgaccagctcgtcgagctggtctggaggcacctcaccgaccttgaggaggacagcattcatgctctccagctcctgtgagagatgcttgatcttcttcctcacgcctttgtgcaagtcgtactcctccttgagtacctcaaccagcttggggagaaggctccctatcgccccgtccccaactccatgctcgctggctcagtcagttggtggtcttgtttgtgcgcacagattgggcagctagtaggttgatggtatatcgactaaacataggagagcatgcaaaagtttaaaatgcacttcatcttcgatgacgaacactgaacaccaagcatcccaatgccgtgaagatacaaagtagcagtactaatcaagcgtcaaactttgcggccgtgcaacctgatcacatgtttacacgcactcttgacccccctgtcaggctgtcacgcgtgctgcacgcgagtttaccatattttgtccacgacgccctgcaagcaaaaattaccagtgaaataagggagaaaacttaatcaatctgtcctgttaacgaacaatttgcagatgaacacagatatgaaatatgcagtcattgctgaagtctgggatgatgagcttcccagtgagcaaacatatatcaggcaaaacgtgatgtcagcatcgggagcaagcaaaaggccgcggcgggggcgttgtccagtgcaggctggagcggcggaggcgcggagcacagggggctggatctcgacgacgaggggggcccgcctgccggcgccagcggcagcggcagcacctgcagccacaatgccgcatcacctcatcctacacatat

SEQ ID NO: 35048 - DNA, 4041 bp, Oryza sativa
cggaatcggcggagccgcggaggcgtcactggcgagtgctggccaaatgggccggcacggtggaactgtagcagggcccaacacggcacgggcacgaaagcccatgggccgtgccgtgactgggccgccaccttggaactcgctgtgcgcctgtgcttgagcagcatagcaaggtcttttagaaaaaaaaaaaaaactagcaaggtgtgtggaaattgaaagtggaatattacgatcagtaagcctaacaaggacaatcaactagacttatgattcggaaccatatgctctctctctctctctcatcatctgctattcacctgggggaccaagtctttctttcggtaccaatgtgattcaagacttgttctatattctgacagaaacacgaagtacagttgcactactgttgacaacaaaaactagtggattgattgcactacgtttttcgcaaacaaaaatgatacttacaccgttccaacggaatagctgacgttctgataatatcaatatgatatctaggtgttctgataatatcaatatgatatctaggtgatctagtctctacgtgtaccacgtttaatactgaagatatcaaatccgatatatataaatatcatactgacgtcatgctacattagttattttcgttggagcggtataataatgccgttttgtagtctcctcttttataatctaatagctcattcgtacaatggttagctataaaaatatactacactattactacccggtcccgcctctcatacacacataacgtcttgaagtctgtgttgtagccggctataaatatgtagcatgcttttttctctcttggcttttcttctcgatatgtgggtatagctggtttatagcttgctattttagagcaagttcaatagtatagccaagtactagctccaattcatctatagccaatctaatagctcattcatacaatagttacatactacacaattaatacatggtcccatctgtcatacacacaccgtgtcttcgagtccgtgctacagctgactacaaatctgtagcccgctacccttctctcttcttatttatcttcttaaaatatgtttgcagctagcttataacctgctattgtatctgctcttacatgctctaacaaagcaacacggaaaccaagtgcgtgcaaattgtccacgtaatgctagctgctaattaatgatcatgcatgtgtgccatcttgaatggtggagaagtgaaagagatatccgaaccaatcgatcaaaacaggcaggaaccggccatttgactcacgtattagttgactctcttcactagagacagtagcgtgttgtatggtgagctcaggaagacatttttttgcttgatttcaccagttgaatcggtgtgatacacgtacgtacgtggctccgttttcgcttcagatttcagcaggtgtagcactgcagtgcagaccatttgtccttgcacttcctcgcactacacgttcgagatgtttactactaccaactgttgaatttcctctctgaagactgtgtgctagactagagtcaggtatttccataatttttgatcaatgattccagccagtattccaagttgcttggacctcaattttgattagcattacatcatcatcattctagacagacaggacagtactgttgtagcagaaagaacttttaaagtttcagaaaatgcatgcctccagtcaaattttcagaaaaagaaggatcaatctagacagacaagacagaaagaactcttaaggtgtgtttaaataaaaaaaatttggccaaaaatataacatcaaatatttagacatatatatggagcattaaatgtggaaaaaaaaaaccaattacacagtttgcatgtaaattgcgagacaaatcttttgagcctaattgcaccatgatttgataatgtgatactacagtaaatatttgctaattataaattaattaggcttaataaattcagcacaaccgtctgacatgtataccagtgaaagtccagccacaatctcttgcatgcatttggagcatgccgtagcatactgtttcagcacaaccgaatgattcagaacatgcactagctgtggcatatttgctactagtaagactatgttatcgaaattaaacagtccaaaacgatttgaggatactactcacatgtgtgcttgacttgacgatgtaggagtgtagtattgtccaacagcacgagctagtcaaaactcaaaagaggagtcaagcaagccgcaaagccaacagcctacaagtacctgacattgacctggtgatgaaaagtctcagcttacacccaaccattttcacatttgccaacaacataaacaaagcaaagaaatgagcttgccaaacctttcctttgttggtttctgtacaagaaaaatgatggattaatgttacatcatttgatttcgaaatattgatgaaactgaaagcgtccatttcattcgtcttgtgcgcttactctgattcatgccaggtcaagatttaattaggttaattaattgcatgtatgatatggactactacaagttagtactgaccgttatatacaaacacggtcaaaattaacctaattaattaaacagatgaattgggaaaaatatatataatgtaatgaatcaatgtttgaattgagcgaaatatcaccatgtactctgtacgtagtttggaacagggcacgcgattctgatctgacgacacatcaaaactatgggcacgagcgtgcgttagcttgcatgcacgcgagatcacacctagtttaattggtcaattttgattcgcaaattctgtacgtccacgtgtacgtacgtacgtaagcacatgttcttaatttgtttgtattgttcaatggtacatgtgtattctccaatcaaattgtacacagttgatgatccgtccatattgtactatctgaggagcgattagatcgtgtttgaaattccagaaacgattagtataggactagctaggatttcagttcattaataattagtaattattaagttaggtacaaataagcatgtacgtagtactatactatttgtagacaactaagaacacatattatcgatcattctctcttttcactcgttaattatctggtgatatcagacctgaatgcaatcatatcgttgttgtcatgttgtggattagtccaacaacataccaaactcttgtaatatgatcacttgaggttgaagcaaaattaaattacgtttcaacacctagctagctaacatgtacagccactcttgttgattaccatgccacatttaatgaggcaactaaaagatcgttttgcttcagaaaaaaatagtttgatgccaaatccccatctatatatgaatttcttttttaaaagatttttctacaagtaaaatatatgattggtccttaaacttgagcggagttgtcacttaggtcaactaaaatttcaaaattgcatgtttaaattcatcatcttggtttaatgaactacgataggtccaaaactcgtttgacgagagcttactgatgacatggcgctccatgtaggcaacaattttgtatccgctctcttccgcatcatagtgtggccccctcttaccccaaagcacccccaaatgctctaaatctctatctccattgtcttctccccgatggctagagttatgacagcgagggtaatgtcgcacactcacttgccactctccctcgcaatcttcgtattaggggagaatgggactgggagggatttggggggattctgtgtagtttgtatgggaggggtccaaaagcaaaattaccgccacggcgccacgctatgacacggtggagggtggatggaaaattattgcctaaatggagcgccacatcattggtcaactttgttcaaacgaggtttggactgttgtggttcattaaattaagatggtagaactgaacatgcaatttttaagtttaggcacatctgctaaagtttaagtattggcaatgtatttccattttcctagataaggttaaa

SEQ ID NO: 35049 - DNA, 1739 bp, Oryza sativa
aaagatcgttttgcttcagaaaaaaatagtttgatgccaaatccccatctatatatgaatttcttttttaaaagatttttctacaagtaaaatatatgattggtccttaaacttgagcgaagttgtcacttaggtcaactaaaatttcaaaattgcatgtttaaattcatcatcttggtttaatgaactacgataggtccaaaactcgtttgacgagagcttactgatgacatggcgctccatgtaggcaacaattttgtatccgctctcttccgcatcatagtgtggccccctcttaccccaaagcacccccaaatgctctaaatctctatctccattgtcttctccccgatggctagagttatgacagcgagggtaatgtcgcacactcacttgccactctccctcgcaatcttcgtattaggggagaatgggactgggagggatttggggggattctgtgtagtttgtatgggaggggtccaaaagcaaaattaccgccacggcgccacgctatgacacggtggagggtggatggaaaattattgcctaaatggagcgccacatcattggtcaactttgttcaaacgaggtttggactgttgtggttcattaaattaagatggtagaactgaacatgcaatttttaagtttaggcacatctgctaaagtttaagtattggcaatgtatttccattttcctagataaggttaaaccctgataattttaagaaaaagtaaggtttatacatactaatttttctttttacaaaactcttacaaaggaagatctcaaccatttgatctagccgattggtagttaataaaagtcaaaatgaagtcacaatttgccacgtagtttttataaaaagtttgcaagtttttttttacatgtatcattttcatgtaagaaagagtaaagacagatgagttttttttcatgataatcattttttctctgtaattactattattttctaaatttatttgcatatgaaattttgatgacataatttatcattatatttatattattttattgaacactggtatggtatccaaaccatacctaaaagattcatttcctaagaagaaaaatatcaagggttatttctaaatttatttgaaactaataaaaataagaaaaaagttgtccatatataggccacccccctgtctcccctcaaccgtccgtccatcccctgtcaagttcgccgcgcgcaacactcgcagcagagcatccaccgatcgtcgatgctcaccgccgccatgcacatgctcgactcctccacctcctcctccccttggcttcctcccgacctcatgcctcccccgccgtccgccgccactctccaccgccacttccgcggcgccgccgccgccgccagcaccagccgccgcatcgccaagcgccggccgcgcccgtcgcggcgcctgcccaccacctacatcagcgccgatccggccaacttccgccgcatggtgcaccaggtcaccggcgccgacgacctcccgccttcacctccttcatctttctcgccgacgacgacggagctcctccgccacgccgctccagcgggctcgcccgggcctgcaggcgcgctgatgctttccacgctcgacacctcggcgttcctgctcggccgccgcgcggagccgacggccgcggccgggccgtgcgacgtgtcggtggcgttggtaggaggagcaagtaatagttacagcaacaacagcagcag

SEQ ID NO: 35050 - DNA, 1849 bp, Oryza sativa
ggagcatctatctctctgattctctgttcgtgtccttgttaattttaagcttatgcctcatatacacatggacgagtttttttatcagtagtgttattttattgatctaactttaatttggagttccttctcttttaattgaggcgactgttaagttcgttttgctcttccttctgctgtttccagcatcactgcatcagcctcaaggttcttaatttatgcaggatttgattcttgtgaaactcttttgctttgtttgattgattggctcttgcttttccattggttttcagtcttgataaacactccttccaacagtacaactgctccagcaccatctcactgaacatgtggtttctgatcatttggtgaacaaaatgtaacaaaagatgtttttttatattagtacattttagagaggtgcttagtgcattaattcagctttagctatataatcaattaatgcaccaaaccactgtggggggcagtagcatgtaaatgctgcttagacactaagatacgttaggatgaagctaacagttcaattggagcagagcagggttgagaatcagtacttggaaaagattgattgtgagatacaacaataataatatcgtaatcatcgagccaggtttttttttagaaaaataaagtattgcaatcatatatgcacacgcatactaaggttcggcggaagagtaacattttttttttttgaaatctaaggcggaactttgttccacttttatatttagaagaagataattgacccagtttataaagaaaaccggatccgaaaattatacaactgcacggttaattacagaaaaaccgactgaaaaccaccgctacacaactaacaactaactttacattgatctaccagtagcatcgtcagtagaagtgatattaacataattgtactatcaatagttgatgtgatagtataaatagatataattcattgtaaagagtactataaaacacgcagggcggaaaatgaaaggaaaaaaaagaaacaaattgggtgtggaatcaacatgcatgcttaatgggaagaaaaaacaaatttgaagtgtatttgttaaacacatatgtaggcttgatctagagctgagctgtttggtgcttacaagtaaccacctctagattgcccctaaaatacaatgcaaaaagggaagttgacaaggaaaggactatatcaacggagaggaagaatcagaggcacgagctgttgactactgagtctgcgtgtgatttctttctcctcgatttgcagtgtacgtgtgctgtgccatcaacaagtgtggctctggctagcacttagcagcccctggtcctgatgtgatgatggtcaggcagtcggtccaaaccgccaaaagtctgggtccgttcctggacgatgttaacacataggagtacaatacaaaccaacggctgtcctaattacttctcgatgtcgtttaccgtactactaataacttactaataatagtagaattagcatatttttttgtaaattaacaagaaggagaattcatggtccagcatgcagctgccagtcaaaattcgcggctactctaatgagtttgtagttcatagtttcccctccgtcccaaaatacgtacagccatgagtaaccgtgtccaacgtttcaccatccgtcttatttgaaatattttttaaaaaagtcacacataaaatactactatttatattttatcatctaataaaaaggatgaatagccagtttagtccttcaacttttgctcaagggtcgaattagtccttaatgttttataatgtccaaacaagaccctaatgattatcatggagcttaatatagtcc

SEQ ID NO: 35051 - DNA, 4038 bp, Oryza sativa
  unsure (1)..(4038): unsure at all n locations
nnnnnnnnnnnnnnnnnnnnnnnnnnnnnnnnnnnnnnnnnnnnnnnnnnnnnnnnnnnnnnnnnnnacatgccatgtcattcatgcatgtaagacaacatttaaatgtccattttaatcttcaattttctatcaaataaagaaaagaaaaataagaagaagcaatcataaaacaaagaaaaatgtcaatttttttagctatcaatgctacatatttttgccaatggtcaaaaccagacatttaaatattgaatttgaatgatgtggcatatacacatggcatgtttagaggatctaaggactatattaaatcacacaatgaacttaaggtacttgtttggacaatacgaaatgtcaggaactaaattgatccttacgcgaaagttcaaggatcattttaggtattcaccctaataaaaaatattaattataaaattttttaaataagacgaatggttaaacattagatatgaacggtgtaaaagcacacttatttttatggctacgcagtgagagcgacgagggatggatgttggccgctggccggccacgcaggaggggacaccaccattgcacttgcaacgatcgatgcaattgactgcttggtttgcctcctctccggtctccgctgccgtcctcatcaatgtcttctcacttgttgtttgtttggacccagcatgccttacctctacagtgcatgtgattcctcacagcccacctgacctgacctacctcccgcccccgcgcgcgcgcacacacaaatgcttacatcatcattgcgtcatgctcatgtcataaatgaacattgttacacatcgctgcaacatctttagaaaaatagaaggcagaactgtgttgttcatgctaaacacatcactgtcgggtcagctggatcaacagcaacccttgcttacacaacggagacaggaaggatgcaagcccaagagaaaacaggcaccgactgtgtttgccagacagataaacagagtcagctggcgcacacaaccactgatcacaccgcgttggcaggatgaaacagtacaccactgcttcagataatgacagtttgaacctactcacttgacctactacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagctatgctcgccgggcatggacgtggagctcattcgttagcaaactgcagctgcgacaagccactgcgtacttctccgtgtcgccaactatatatccgaatctgcctaaacctagaacgaatgcaaagagcaaaaaatattagtactgataaactgatcaatgataaatctaatcaacgagtgaattagaaatgctggaacatttaaacacaacaagaaaatcagattcaaatccaggctgggggtttattgatttattttactactagctatgtggaattacaagacaaaacagtcttgtttgaccttatccatttcttttgccttcagagacactactggttgttcctcacaagaaacaaaagaacaaatggcacctttagaaccaatcaacatcattttaaattgcaaaaggtacaaaaaggtggtttgtgtggctttggggaggtcaagctacaataattccataacaagtccacatggttgttttcaggggtggcagaaaataagtccgggaataagagacactggcaaagagttattgtgcaaggttacaagaacaagtcaaagtgtctcacatggctggtgaaattgaaaacaacaggaaataaaaggatgctcagagacgtacataatgcctactactacgtgtaatgaaatgtagttgatatcacctagatataaatcaggaaataagttatatatatgcactatcgccaatgtacccttgttggaaaagttattaaatcagacactcgcctcaacaaattaatatgggaacctgaagtaaggatatcatataacatgtccatatatataccatcccagattacctatttcacagtaacttctttgtgagctttaaatgatagaatcacgttccacgcaagggctacaaaattagcagcaagaacctggaaaaattaacagtaaggtgagaacagcattcagtcatgctaaagcagacagaaagaagcaaattcagctccagagtacagtattgcactctaaaatattttatgaaatgaaaatgtgaaagatttcaaagacctgaaatttttgtgggacaaagtaaaaattcaagaactgaaagggtatccacaattgccaattcgcaatcactgatgataaccactcctgtaaaattacaattgaaaattagctagcagtaaatgagtgcacatacatattatcagggagcagtggggattatctgcagtactgctgatacagtagcagatactgacgtatggacccggacccacatgtcagccactgctactgcatcagcagtactgcagaggatctgcgatggaaatgagagaatcaatcagaagaggttcatgtcacctgcttgagctttggaactacaagagaaggctttccctccaaggtgacgagtaaactcataaacactccaatgaaaatgggagagaaaatgacctgaaaggaggagataaaaaaaatgtcaaaaaataaatacataaatgcagaaacaagctagaacagaacaagcagcaacactctctctctgggggcagaagggaaagaggaaaaggacatgcacatacctgatcaagtaagaggcgagcaattgcacctgatgcaccattgatcgtcactaatttactcaagtacaagtacctgcatgtggcaacgagtaatgaaacaaacagcactgggcagagaacacatgctatcctaaacctcaataaacattggttgcgattaccagacatgcaatgttggccccaccaggacaagtcccaaaaatgtgaatacaaacgttctcttcaaatctagctttggcactttatcaattgcaagctggagcagtagcaaacaacaatggtaacagtaaatatcttgtaagaaaccgtaacaagataccacaataacaagaacagatgaaatatcaaatattttgcccaatccatggatgcaacccagtaggaatatacattgttttttaataatggaataggacactgttgctggagtaaaatccgttgaggaatcatatgagttacggattagcataggctaaagactgacacagttgagtaaagacaatatattcagattatggttgacgcaagattggataaaaagatatggacctgaaatttgataagaccataatagcctagccagttaagaatttcacatcatgtcatatttagaaaacaaggaaactaaaagagtgcagctaaggcagaaaagaaccataactcggtaaattgatttccaagtggtattagcaatggataacatttcaatgttgttttgaaggaaaattggtatgatttgaccatttgatgctaatacccatctaagcacgcctggcaatgtgctattgcagagtgacaggaagccctctacaagaagagagggagactactggttcattgttcgtcaaccaattaagtagtactaagtaatccactagggttgcaatggatggatgtgaaaatgcgggaagtagaaaacaactgcaagtcacctggcagatgaggtctccggtcagggttaggacggcagaggtaacagccttagtggtgatgggatgcttatcaagagccagcaggtacctgcaaatcatggcgcatttcagtaattttgcatttagatatgagtatggcaaaaagcgagccaaatgaacatgggcagtgcttgcccgcagaaggcaccaggaatcaggaaaaggcggaattggacttaccaggctaacaggagacgccaatccattgggtaccgagctcgaattcgcc

SEQ ID NO: 35052 - DNA, 3154 bp, Oryza sativa
  unsure (1)..(3154): unsure at all n locations
nnnnnnnnnnnnnnnnnnnnnnnnnnnnnnnnnnnnnnnnnnnnnnnnnnnnnnnnnnnnnnnnnnncgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtatatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttactctgatgattcggagggaggatgaataacgatcacaaaacgagatgattgattcatgtgagatccgaacacccatcttgagctgtattttctttcaagttcttgacggtctggaatcctaatgtgctctctttccatgggaaatttttggccatttcagtttcagagcggcaaggagccaaggatgcagcagcactagggtcctagtccaaattgtcagctgggggctcaattgcaatggcggagatggtgaggctgcccgaacagcagcgtcgtaggcctctcaccattgccaacctccctgaagaaattctgtcggagattctgctcctgctaccgccaaaatccatcctccagtgccgtgccgtctgcaaagtctggcgggacgtcacctccgaccgcgccttcctccttccccaccactgccgccagcctccgcagcgcctcctcaccttcatccgcgacgtgggcagtcgccacgatgacctggatatcctggactactgtgttgaagccgttgacttccgcacacaccagttccagtctctggcccggttcactggccaagattacgactgctcactcgaagacagcccattcaccgtccacgcttcttgcgatggtctccttctcatgtcctacaacaactatttgcatctctgcaatcctactacacgtcaatggctttgggtcttcccgccggcgcttcaacatgacaccgtcctggggctctattctcatggccattcttctgaataccgagtattgtattatcgagaaattggtttgggccctgaattctacatcagcattgttggctcagggaaggagaggagcatttggccccattcatcgtcagcatccctgagaaagtggttggcgaaagggaaggaggaaactcagttcaacgagcctttcctgtttcatggaaacctgcactggctgccgcacttaggtggacagaacaagatagtggtgttcgacactctcgatgaggtgtttcggtggttgcatgtacctttcaagatgcacaatatgtcgtcattactcgagattgagggtagccttgccatgtcaaacagccatattggatcatcaaaggtggatctttggcttctgcaagattataagcatatggtatgggtccacaagtatcgaattgaattgccagttatagagattcgccgttttgaagaagatgatggttggtatcttcatattgtttctcaagagggtgatgtcttggttgatggatttgattggcagtttcactacgacataaagggcaatttgctggagaaatttcaatgtagtggccgcatgctgaacattactccacatattctccaagaaagtctcgttccacacgaagtgtgccaaattctaaataatgaaagtagacatgaaccacatttcttcagggggctgtagagcatactttctttaccgtgaggctacttcacacttttgggtgtctattcattggatactgcaattttagcgatggaacttaattttgtagtgaatggtcaatgatctgatgttgcaaagggcagcattcactctgatcagtatttctgtacctccacatgttcatcttcaacattgagggtatcatttctgtactgtacatggaaaattaaatgcctgagactgttttttcctggtttgtggaagtctgagactgaacagttgattatgctcgttgtttatttcaacattgcgagatggttactttttattggcttcttgcagcttaattttgccacttgggttgcgtatataacgctgtggtattgaaaggtcattatctacttgtgttggtgatgcgtatgtctgatgagatccttagtgccatttattttgagtttgttgtgtcttgctggaattgttgggttacattccctgtttgaacaatgaccagtcatgaactgttgtcctagtagtcggtaaggaggtcttacagtgactcaacttgaattatgactgcactttcactgggctgctggaatttcctcaacctttgtgcttgttgcaggaaccgagttaccagcttgatgttatctacggaggcacggagtgatggaatccaacaggaacaggtactattaccatgacgacccagagccagaattgtaacatgcattgtaaacaggagaggaggcagtatagtcaagcagtgtgtgtacatatactcttgtggttgagcgatgcgattcaagcagcggcatgagttgagggaggcatattaaacttattccaatatttaactgggcttacttacggcccaaagactggtccaatcaaaagtgaactatgacgaatgtttctctccccgtagcagcccaggtgcacatgggcccagcaaccgcagccgcagccgcagcggaggcagcactcgcccgccgcgcggccgacccgctgcccgcgctccgccgccgcgacgcgctcccgctcccgctcccggcgcgcctcttcgcgcagctccacggtcttctcctcacaaccggcctcgcgcgccactcccccaactt

SEQ ID NO: 35053 - DNA, 3812 bp, Oryza sativa
  unsure (1)..(3812): unsure at all n locations
gatccccggaatgcccatcgtgccaaatgctgcgatatacaggtctctgatccgggcctgtggcattcatggcaagctggaactcggcaagaagatgatcgcagaattgatgcgacttgaaccggatgacagtggaaaccatgtcctgatttccaacttctacgcaacaacgaaccgatgggacgacgctaagaaggcgaggaaggagatgaagtccatgggcattgacaagagccctggatcaagctttgtagacatcaatggagttctccatgagttcttggtgggtgacaagacgcatcctgcctcaaaggagatatacgccatggttgaggatattgagaccagattaagcgagtgcggacaccggtcgagcacctcatctgcgttgtttgatgtcgaggaggaggacaaggcggatgcactgtcctaccacagcgagaggctcgccattgcctttgctctgatcgcttccaatccaggagctcccattaggatcatcaagaacctccgggtgtgtgccgattgccatgagagcgcaaagcttgtatctcgggtgtatggtagagagattgtcatgagggaccgtacccggttccatcacttcagagacggggtgtgttcttgtggagatttctggtaaatactcgttgtgttgtattgtacattatacagcgtaatgtgctgtagatttctctcataattctgtggtaaggggatgtgctgtactggtctcacacatttgcttgagatcacaggctgtgtttagttccacgctaaaattggaagtttgaagaaattagaacgatatgacggaaaagttggaggtttgaagaaaaaagttggaatctaaacagggccacaattcattcggttgtagttcgcatggttcaatatcagttttttttttttttacaatcattttattgatggcggatcaagtgttacatggcaagtggtcaaagaactgaaatgaaattccgaaacttggccgtcgtagttcaatatcagttgtcagaattcaaacagttgtagtttgttataacttgcgcaattcgtgcatatgtggttagatagttcatatgaaaaagaattatttcggggcatacgtggtctattcttcctctagatagttcatatgaaaaggaatgattttgagattttgtcaaataaacgtgaactggttaaataggcgagcacaggcagttaagacaacaagtctgggtggtgtagttggttatcacgttagtctcacacactaaaggtccccagttcgaacctgggctcagacacaaacatgtttttttccatttttttcaacgatttgaatatttttcttaataacaacagcataattacatgcaaaaaaattcctccataacaataacataaacacttgataaccacatgcacatgattttttttttcaaaaattcgaatatttctcaataacaacagcataattacatgcaaaaaatatttctccataacaataacataaacacatgcacatgcacatgatctttcttttattttaaaaaattcaaatatttctcaataacaacagcataaccaaatgcacatgaccttttttttttcaaaaaaaccctccatatcatcgagcaactttaacagcataacttttttctttttcaaatatttcctccacaccaacagcataaccacatccacatgatttttttttcaaaaaaaaaagatcttcatatcatcaagcagcagcataagctgcaaaaccatatgcacatgaagtcaaatatttcctatacgacctatatagcatcgtagcagcacaacgatatgcagtaatgcagatgatctcattcacagagttaacagggtttagtgctacagcttcacatccatatgatctcatccactaagttaacagagctttagtgctaccacagcaactagcaaaagatatagtaattgcattagtggctacacgcctacgacatgggcaatgtacagcacaaaatgtgagggtctcatctcatgccacgcaaagcatcagtccttgctacacatttccactaacccaccaccacaaataccgagagcccctttatcactttatgctaccattcatagagtagtttaatatcctgcaaatgtaggatggaagcattaggcagtcacaagagaaatagagttgccatagtttcagatctaattgttcagttcgtcaatattatatacattcttgaataaatatatggcatgctaagcttaagttgaaaatagatgtttatgtaccaaagcatgaaaatcgccacataggtgctgcaggcgactgtaaccacagagttgttttgagagttcttgacttacatgaatggagtgatgaatcagctacttttaaaagagattattcagttgcataaataggttggaagaatgcatttcccatgaagaagcagattttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgtgggtagctgtcatcgccatggtcatactgtacagcttgccaaaggagatttggagaacagctatggttcagaaaacgagccacattcccttcattgtttgctcttatgatgattggtagtttcttaaagttcttggttatcacagccgtacttttttcttcaagtaattcttctcccaaattccagcttaaagccttattgccgggacatgaagcgcgaaaggtatatttgtcttcctcaacatctatgtccatcttagtttcatcaatgacttcaccggcgtactcacaaatgaatgtgccagcacggataggatcccacgaccgcagaccccagccacggtctccagtccagaaaacctcaaagttcagttttatacccttctgtgtgatcctgtttcgacaattatgagaacactgacagttagaggagcactcataaaccatcggagtgtgctttgccagcaatcccgttgcactgtaaggaagatcaccaccattctgttgcgcacacgaacaattagggtcaccaggcaagcagacactaggacatttgcaacattgtaatggttttgtcttcctaagaggtctcaaatacttcactccagcaacataattgaagtgacttggccctttttcatcatcaacatcattaacaaggcacacaggtaggtgttcaacctttgatgataaatccaacaatatagccttttctcttgtggcaggatttgctttccacttctcagtcatcttccaaagtgaaattccatcaggctgtcctgggtcccttctcagcttgtacttgaaaacattaaatccgttctttgccgtgtctgtccaagtgtcttcgatacgataaagcccatcataaatatatattttgcctgagttacagaaggggtcttgtgcgctgcgcacaaccctgatctgattcttcttgctcttgctgttcatgagagcaaggttacctctctcaagcttctgatcgtgcttctccttgtgacgactgttgcctccctgtcctgtgtacaccaaaatgtcagtgtcatcatcgtcattctcatagnnnnnnnnnnnnnnnnnnnnnnnnnnnnnnnnnnnnnnnnnnnnnnnnnnnnnnnnnnnnnn

SEQ ID NO: 35054 - DNA, 9210 bp, Oryza sativa
  unsure (1)..(9210): unsure at all n locations
nnnnnnnnnnnnnnnnnnnnnnnnnnnnnnnnnnnnnnnnnnnncaggatttgctttccacttctcagtcatcttccaaagtgaaattccatcaggctgtcctgggtcccttctcagcttgtacttgaaaacattaaatccgttctttgccgtgtctgtccaacccgtcttcgatacgataaagcccatcataaatatatattttgcctgagttacagaaggggtcttgtgcgctgcgcacaaccctgatctgattcttcttgctcttgctgttcatgagagcaaggttacctctctcaagcttctgatcgtgcttctccttgtgacgactgttgcctccctgtcctgtgtacaccaaaatgtcagtgtcatcatcgtcattctcatagcctccagatgaaatgatgcagacagccagagtctcatctttgttcttagaagagatgtaatcaatgccacccatggctggtgcatgtaaaccaacaatgcacatctcaatcctaaagaagaaaatgtcaccgacttcaacaccaggcacatgccctatcatcttatgattgttgattctgaggttgttctgcatcatgagagtgccagctttcaggtcagcccgcctgcttgcatcctctttttcatccaattgcagtacacggcgccgaagtgaatcaaacatcatcaggattccttccaccgattcctttgggttgtctgatgaggatgagcacaagttgaactcgttgtccaggttcctccttattgatctgcgcttgatgttagcatcattggatttctcagcttgctggggcctcttggctctcttcggcatcgctggttttttattcttgcaaaagggcttgtaatcttgatctgatgattcatcttcatgttgcggtgttggaaatgccgctgagatgggtgtagcctttatagggacgggtgactttggtaagggcagagaaaatgaagctggggcttcttgaggctgttctgatgaggagcaaggtatggatggtgtggcataaactaacagtggatcagttgattgagtttccacatcatatcccaaaatagtaggaaactttggtgctaatgagcgcaatggctccaagtctaagggtagtttgtcactctctgcttcatcttccgagttctccatggtgaactcttggagaaattctggcagtagcaaaagcagaagtcattaaatagtctgaacataatacttgtatgatttcagcatgatgaatgatgtctcagaatttgatatgctaagaataagtgcgcaagatgaatataaaaaaaagcattgttcagtgcaatacaacgtagaccgaagaaatcgaataaaaagaaatagatctgcaaaatcagaaaagtgcaacttctgaacaatcagaaacagaacagtctgcatactttggcctgttggctgagtactgctggctcactaaagatacacaaatgtgtcaatgtgacgtttctatggcatatgaatcatggatattctgattggagttaattggtcccacaaaagcattaacatttcaaagtcctacctactcccccttaaaaattaaccgaaaatgcaggcaccaaattaaaaagatggcagcaaaatgcattgcaacttcgaggtggtcattcaggcaacccaaatacaatatccatttgttcaacaaacccatagttaaactcaatgcagacatttacacagtgcacacaaataagaacactaacaaatcacacgaatttgctacaaaaagatggtcaggaactagctagaggacttgcagaaaattagttaggattctagagggaaaaaaaacaatggagagaaagctgatcaagaagcactggatgaggagtgtgtaccttgaggatgtcgcctttgctggggaatgcgtgagagtagctaggggagcttgaaggggcacaggcagttccactatcggagacccctagatgaaatcgccaaatgtatatatgtatatgtggatatgcagtcgtgtcagtgtgccactaagcgctggcgtacaccatccaccgttggataatctcgagatacgtgcctctggaatatacgataactaattaattgtggctacttaaacacgaactagaacggcggtgatgtgtagtttatctgagtaaaaaagaacagtggtatagttcagtcttgagtctttcatggcagaacactggaggtgttgaatttctgatcattattgcatcagctggttgaactcatttcacttcaacacacacctcattctctcccaagacagtacaccccagtaacacattttctgctccaggctatgagcttgtctctgattcttttcaggtcaaaagtagtcaaagtacagtagcgcttttaatctccttgcaagagcaaaacttgcaatcgtttcactgagaacgtatagcaggaaaaacaccaaaactgataaaatgcagcaaaaagcaagtgatgcctctctagtttctagcatcaactattatagattctacattctcgacgcagaaaagacctatgcgaattttcacctagggctgctaactcgttgcacgatgagcatcttcagttcgaaaaagcgtttcgcgcagttggacagacacgaggcttcgctgttgctgaagctgcttccaatgctcccagtgatgcatttgtcccagcaaacatcagtcagcttcgccacgaactcgtttgccattgccttcctcttctcctcctgaagaggggaagaaaacaaaattgtcagtaacatttctgtgagtaacaatcaccacggttctgcaattgaatagtggatcttgacaaagaacacatggcttaattatccattgtccaaagaacagagtacacaaaataatttcttgtgcataaagggaagcaagcaacttctgccattaatgaacatatcagaaacccaggacaaaggtcctagcagcatactagatgtaaaataggcaattccttttttttcctcaagtcgtttaatttgcagactgatgatctttctattctagtacttcttttcccacatatcagtacgtcaccgggaaaacatccttggctccttgcaacatgccagaatacactgcactatcattttcttacataacaaagctggtagcaaatcaaatttaataaaacacctcaccgtgctatatgcattagcggctacacactcgggatttgggactactgcaatttaagaaactactgcatgacaataaataatttgttggatatcatgagagagaattgtaacttctattagtaatgagtgaacagccatagtccttaaatatagagcaccacaaaagcaattaggaataacagaatatctcctccgttgaagcgttaaaaacttttcaagttatggggatttttaggaaagacttcatgaaccaccaggaccattctaaaaaagaaaagttagacaccaaggaaggacttggtgtcaatgattttaagaaggaagaggtaaatatttcccctggtgagcgtgctcgacaagggtcgaacccgggccgacggggtgcgtgccagtgacccctgccactgcgctacgagcgcatctccaccaggaccattctgatggtgcctaaaaggctaaaactagacttatccaaattagtttagtttgcagtcagggttactgggtacttgggtatcgagtaatatgcaaattaatatgcaactaggattcgagtatcgatttccacctaaactgtaaattccagcacatgtgttaaattagggcacaaccttcctgcggactgaagaatattgctaaaacaactgaacaaaataaataaaatgtatacataataagctaaaggttggaaggaacagtaagggcaaaaacttggcccaaatcagcaaactttcgcccaaagctcagcctttttcacgaatctccgagtagatctagaaaggacacataattaatagcgagcgtaccaacaaaaagatgggctgaagagcaggaagggatcaaaagaagggggctgctaattaatctccatgttagggttccataggtcgggtactcgagtgtgccgctcatctctaaatctccctaatacattatgggtttattattacctctagcatggcctgcagccgcgggttgctgagcgctgaagcatccatggctcctcccctcctcttccgctcttcttcttcttcttcttctctctctcctttacgattttcttccctcctctctcatttgcctcgtcggcggcttgcagaggaggaagaaagaagagaagaggccgtgggctcttttcgttaatgggctatgggcttcgtttagaaatcagatcgacaaaaatgggctatgggctttttttacattctggcccaataccgtttgcgaaagcggccctcaaccgcgtccgattgcctttccccgtgtcactgtcaaccggagccaacctaagcaaagtgaagagattaaagatttttggggaatctctactacttagaaaatatacaatcaaagcagatatacaatccaacttaaaaacgtacatcgacacgtttggagcgacaaaaaaataaaaaaaaagttacatgcgatccggaaccaaaaaagcgtaaaaagcgtcgacgccccacgacccgcgtcccacgcgtccctcgaacgcgccgcctcctcgccgccgtcaccccttcctccgcgcgccctccatcgccgccccgcgccccctcctcgccgccctcgaccgccgccgcctccacgccgccctcgaccgccgccgcctccacgccgcccggcgcgccctcgaccgccgccgcctcctagccgccctcgaccgctgccgcctcctttacgccccgcgccccctccttgccgccctcgaccccgcgccgccctcgacctgcgccgcctcctcgaacaccgacgccccgcgccaccctcgaccgccgacgccccgcgtcatctgaaggtatgtatcccctcgtgccccaccatgacgcccgacgatatggccgccacatgttcgatgaaatgtccagtaagtagctcaatccgtggtgtgattttgagccagctgttatgattaacctggctctaggaaatctgctgataatatttattttctgaatcatctatgtgatgacgtagaccatgcctgcgcacctggccaactcctggtttctactccttgatttccatgtatatacagcttgagatggtttgattttcttttttgatcaagccatctgaatcgtcttgttctagaaacatccctatattgttccaattctgatttgtcaacgtggtttaatttttttaccgtgtattaaaccaaatgttaggtgtaggcaatgagctcaagtgttcgtttatcatcagttcatgtttcaagctttgtgaatcccttctttcatcacaaataccttaagtaataatttttgcaatcaagtagtaatatcccattttttatgactacgtggtttgtcatgtcatgctcataagtaagaatattaagtttctttgatttgtgattgttgaatgactatgtggtttgtcatgtcatgctcataagtaagaatattaagtttctttgatttgtgaatgttgaatgactatgattctgaacgtttacatcaaccgatgagaaaaaaactaccatcagcagcactgagattctgccttatggtttgtactggattgaactctaataaatttggacttgtgcatttcagggttccaatggatagcaactttggggcctcagggccgacatcgttgacaggattaggtgagtttttcaaaaaatataataataggttaatagctcaagctttgccctatatgtttatttgttccattcgtcgtcgtcgtcgtgtcatttaagccgccacgcccgatacacagtaaagacttcactgcacagccccctacccctgtgcctgcccatttgccctcgaccggagggtcgccctcccgccccgtcgtgctgccttgcgcgatctgtcgcacaaacctattgcgtgttcacgtaaatattccttatctcttggtctatcgtcttagggattgaactcctggttctgccttccaaggaggaaagaagcaaattttagacatttcacaatcgaattgtttacatgtgacgtattatttttattcaaattatgagtttctatgtgaaattactcgtctgaaaattgttgtggattttacttctttctatccctcccgaatgctaatattagcttatttgtgtcctgactcatttcgaaggcttgcagatataccagaaggaaaataaaggtgctgtgactgtaactagcaccttcagggccttcaggtcggataccaaaattggtggagactggagaggctctgcaactaaatcaaactctactcttttttttttctgaatatgctaacaacatttctaatttctgatggagtagatttgttgtatagtcaattgaaaggggaacgacttttatatcaaatcactgccgacatatcaaatttacttatatacatcactgccatcatatcagattttgacagccattatttatcttcatgcttgaattcttacagtcattttgaaattagattgggcgtggaacttcctgctactgctgttgttttaattatctttactggcagtacagttattatcatggaataatctgttttaataatcttattttagatcaatttgcaaatccatttaactttactcgatttcgcccattaacataccaatcatttcctagaactgcagataacaacttattaattactgttagtagctttgaaaaataacccttagataaaaattaaacatgtagattgaagtatttttatttttatttagcgatgcactgaactttttactgtataatagattgcggtggcatggagatacacatgcaagttgatagctgatagcaatgagtaaatcgaatagcttctcagttcctcctctgcattcagacatgctgagcaaccggcgttgaggaccttgttggcacccgagaagaggttgttggtccggagtggtactgaaggtatgctcttattgtgattcactctttagcacatgttatagtatctaaggtgccatataaactagcaaggatgaaccagaccggcagagattgttgccaagcaaatttgatggcacatgaacacaaaattgtgatttttgatagtttgcattataaatgctccttcttgtcctgaggcccttttccttaaatttagtttacatgctgtagccaggcaatatttcctaaacacttcaaaatggatagaggaattcagaactgagaggggcagtgatttctataattgtgctggttaggaacaaaactaatcatgttgacaagaggtgagtggttcagaagttttcttgttttctgtagccttttcatgttgtcttgcttatctgatggattttgctcactgaaactgggactcactgaattgaaggcaaattacatagctcttgcttatggtcttctgtgttggagcacatcttccatgggtttgtggatgtgctcatcctgctcaaggttgactatagttttggtcagtaaaggggatgcagttagtgattgagctagaacagacttacatgtaatagtcaagttaatcagtgcattgcttgcagtttcaatgcttacaccacaatttcattccctgcaattacatttacattttaagctttgttttcttctatactcccaaccactgaactcgttttttaatgaaaattcaacttgctttttgcaagttctctctgtttttttgcaatcggaaaaccgtcacatgttcaacacaaaactatcacttataagaactgtaacaagctgatggatgaactttgataggttccttcacgaaatttataaatgcaccttacaaatctgaatgcttggagttatatgagatgatggatgaatattgcagggtaaagattatgtcacctttgacaattaaatttaatgtcgaatgatttttgcgcatgtatactccattttgttcgattaacttgatatctgaattgtgttttaggagcctatggacctgtttggcacagctccagctctaactctacccctcctggagctggagctcagccaaacagtttcagctccaccaaaactaggagtggagctaggtggagctctctcacaaaataaactagagttgtggagctgggtttaagcagcttcacaactccactccaaacccaactcctggagctaaatttaggagttggagctgtaccaaacaggccctatataagattatggtgtgaaatacaaaagggtcaagcatgtttctcttgaaacttctgataggcattttctgataccttttatatattttgcacttacgatttgttcgttgttttactatttcagattggacggaggcatataacctcttcaaagaacaaggtatcaaggatcttgttgtcaatgtaaaataaaaaaaacaatctctgttggtaggtaatactacaatgttgagataatactcctcagtggctgataacaatgtagaggaatagtttctagagccaaagggtgaacatcaaggtttaatacttcaaggtttaagttgcaacttacgcgctactgcaccaacctacttgtgccgtttagacatcactttttatagtgttgtagatgttagattattgtcacagagccaaataatatttgtttacctcctttgtgcttcaagatttgtgaatatgctttctgctatcagcactgctatacgtacgattgtttttgtacgatgtttgtacgatgaaacgtttctctcctgacctctaacggttttttagcgatgaaacggatcgcttccctgttgagcccatatccaaagcccaagctctgacgtgctggtctgctctctcgttggcatgcttgcatagccaaccaaagcaatcttctttctaattatatactccctccattttttaatagatgacgccgttgactttttctcacatgtttgaccattcgtcttatttaaaaattttatgcaaatgtataagatataaatcacatttaaagtactatgagtgataaaacaactcataacaaaataaattataattacataaattttttgaataagacgaatagtnnnnnnnnnnnnnnnnnnnnnnnnnnnnnnnnnnnnnnnnnnnnnnnnnnnnnnn

SEQ ID NO: 35055 - DNA, 546 bp, Oryza sativa
actcaatgagcacacgagctgggtttccaatgcctctgttggggccaggcattggtatcaaggaatgatttgaattaacaccattgtgttgccccacgatgaaaggatcatctgtgcagcggccgaagatgtagctgcgtagcgcgtccaaatgatcccgtactgcaaagtattcatacaagtgaactgagccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaa

SEQ ID NO: 35056 - DNA, 15163 bp, Oryza sativa
  unsure (1)..(15163): unsure at all n locations
nnnnnnnnnnnnnnnnnnnnnnnnnnnnnnnnnnnnnnnnnnnnnnnnnnnnnnnnnnnnnnnnnattattaaacttgtgtttcaagtataaatcttttttttttcgccgggccggcgtaagatacgcggccgaagtttattaagattgggaagaggttcaaactagtacaacaattacagctgccatggaggctagagctgtacggccgctattgttcaagtataaatctttacttgtttgaatattcaccataatgttatagtgatgaattgcttctctctttcctatttccaggccaacgttttatctgagggtaaaattcaagaagatatatatggcttttggtgcaaatgacattgtgttgcatatcaagagactaatgtattcatctgtcagaattggatatcaatttgcttgtgattaccctatagtactagctgctggcgttttgttgctgtttctacacaggctttgcccttctctattcaacttcttgctgtcttcatctccagtcttcctgttaactgcacttctgcttggagcacttttgagttatggtgaacctgctgttcttgttcttggagagaatcaacaaactttgtcctttaaatccaagatttccattactgactgttcgattgacaaggttgagactgttgctgtcgaggagcacttggataaaacaactaccagtaatgaagtatatgtcagggaaagaaattttgagggtaatatacatgacactcactgggaagagaaaaatggcacctacatgacagttgataccgctctaaatgacgaaatacatacgaaggatggaacttctgattatgatttgcaggatacccaccgtgaaggaaaaggtatcacatcagtggaaactgatactgttccttgtgtggcgccttcaagttttgcctacagtggtgtaactgtggaaactgaagacgttggggagaacagcaagaagaatgatgagctgcaagaacttggaagcatcaatcctgaaagtgataacaataaagtacaatatcaatatcagttaggtgagtttatgagttcatgttgggaacctgttatgagacaggagccacaggatgcttgttctgattctgaatctgatcttactgagagttctcctgatgcatcaatgactgacattattccaatgcttgaagagttgcacccattaatagacttgcaaactggccacccttcattggtctccagagacaacttgaatacttcttcggatgatgatgaagatgatcttgaggaggaggatgctagcacagatgaaaatcaattggaagggaaaatagatgattttgctaactggaaggatgttattgatctaaattacttggatatggacaataatagcaagctggagggtatgatggatctgcaaagagcaaagaacattctgaaatttgaacttgacaggaggttaatggacttgcaagcagctgatgcagtacagaaaatggaggaggcatcacgcttccgtgtgcaggttccctccatttccactggaaggcagaacccatttgattcttcaaatggctcagatgaaataatagagttaccacatgttcctgattcagcaccgtcttgtctccttccacggaaaaatctatttgatctttgcagtcaaccaaaatatggcccacgatagtccattgcaagaaacttggactcctctttcgtacttttcagcaagacggcatagaaagcatggaaacttatatgttaggcactctactagcctgcatcacaatagcttcaaactggagaaagatgaaataagtgaaaatgatgcccataatagtcagtcagactgtgatgccaagcaagaagggaacaacagcaagttatttggttcactggaagcacatataggtgaagaaatcaaaatattaggcgcagcaatttcagatgtgggtgtattagaagtaaattctggaatggatagtggtaaccaaaatgctgatttcagtgatgatatcagtttatctcctatccagaagtctagacaaagcactttcgaagctaaggaagcagtacatgcaggtaaaactgttttttaaccctaagtaatgtattgcaatttgcctactggaaatgataactcaactgaagttgatgtcatgcaggtattgagcaattaacatcgtgctccccttacaaggtaaataattttgaggcacatattgttgaagcagactccattgatgaatttaactcattgtttaagtgccgtatggaggaagtactagtgcaatccatctcagagtccagtatcagtcaacccttgacagttaaacttgaagatgaattgagtgaaccattatcttcagactctgggaccgggacacatttcattgacgggagttcagttgaagattcggatccacaatttgcacagctcaaggatgaagcactggtatctgctacttctaacgcaacatgtcgtaatgagtcaattgaagagaaatcaagtgaagcattactggcaggaaacgaagattattcagaactgccaaatgaactgttaaaatcaggagatccacagtttgcagatagttctgagattcaaatgcaggttattgaggctacaggtcactgaatcatcacaagggcctaaaacaaggccaaacagccaatttctcagagagatctgtaaagcatagatgtcctgtcttagctctctgaacaggtttctgcccccctttgttccaacttactctatggcgtctggatttaactattcctcttcttaatacaaaatgtgcagcaatcatgctgtttttcctccaaaaacttttctcaggaagtccgcaatgtcagaaatatccaaggaacagtggatgtacatatggtttctgcttatttcttctcttttgtttctgcttatttgctttcggttttgggctaataggttagtagataggagagtagatgacattgatatgaaacaccagttgcagttgggtgtgatatccattcagtcaagccggtctttctttcgctgcctatggagtattaatttttcttgtctgccagacaggcattggcaacccctgatcatcactttgtttcagtaaataagatgattggatgtctgtttgcctgttggtaaaccgctggactggagttgcagcttctgcagtttgcttcttcaacagttatcctgtcagtaatcattgagtaatcaagtaatgctttcacagatttttttttaacacctcctcatgctcattatctgcttgctgttggtggtttcattaagaaaatcacagttccttgattaaaaaattcatagtcctttacattacatacatgatgcattgatgcttatgttgggtatactgatctgaatctgaggcgtgctttgttgggataattgaagatacgctactcccctagaaccattttcaggaaatcactcctttagcttgaccttgctaaaatgaattgtttgcatgatactaacaaatagatgaatctttggtgtagaatcgcagtgatgaataaatctattttttttcatctgtttgtagagccatcttacagatgagagcgtggtattcttcgactgttattctgttaaacaaataaaaaaacttaagagtgaagtacatgggcacacctaaacttaagagtgaaataaaaaaacttacagaagacacacctacatctaggttcctgaactcgcaaaatacatttttaggtccctaaacttgtcatgtgtgtcacataagtcctaacggattcaaacccgctccatgcgctgacgtggcattgccacggtggcacctacatgtcgagcatatataaaaaataaaattaaaaaccatattttctcctcgtaggtaaacagaaaaaagaaaaaaaattctaatgtagagaggagaaaatatgtatttttaaaatttttttctatgtgactaacacgtgagtccgactaacacaaagatgctatcgtgacatgccacatcggcacgtggaacgggttagagctcgtttggaccttgatgatatctcaagacaagttcggggactcgaaaatgtattttagtttaggttagggaccgctcatgcatttcactcaaaagttaaatatgtaccgaacatagggtcaaacatttgacaactacccaacacacagaaatatcgttattttcaaaatcacttcaaagttgaccaagacaccttcagcagtacacgggcgccaccaagtttaagctctttcatgtcatatccatgtcttctagctttgaatgggcaatattcagagacacgatacgagccatccccctgatcaaccttgaagaccaatggacagtatttagggatatcataatccgagccatccctatgaacagccttgaagattaaaaacaaaggtgtattctccaccacagcaactacaaacctatccaggtcacatggcttggaaatgacaccatcaaagagccgaatcttttcaggaatttgaccgatataggaatataaagataagcttaagccattgtcatgcacttgtgatatgctaacttgtattgtggcctccactgcttcgtggaaaagggctcgactaatgtcgaccgcatcacaatcaccttcaatccgttgcgtaaacactctatcgggaagcacgaattcgctgcagatgatggcaccatcgatgagctgaaaatcatcgtcttgtgtctctccgttcttgatcttcatgtcaaactcgatgagcacacgaacttggtttccaatgcctctcttggggcctgacattggtatcaatgaattatccgaatcaacgccattgtcttatcccatgatgaaagggtcatccctggtgcggttgaagatgtagttgcgtagcgggtccaaatgatcccggacagcaaagtatccatacaagtgaactgggccatcaacagcagcagtgatattggatagcttgagcgagaatatctgcatcatgaattgcacactgtgcgccttgcaagcccacatgtgtggccggcaattggttgggtttgacagcatcattgcctccatacgagctgaacagccagccatacacgtcagtggatgacagtaagttagattgttaaccccaatattgaaatgagcaggaaagaaacaaatagatacaaataaggtttaaaacagcaaactccgcactatcatggacccaaagcaatatatacaatatactagatggtgcctttaagagttttttgaagtagtacttaaggaatatctagtgttacttagaactagattatgttatgaaaggtctaaatttgacatcaagctagacagatatgttatgaaaaaaaagggtttaatttgacatcagttccatagtactgagcatacacaggaacaaattagatttttttttattattttttttccgtgctgaccaaagacccctcagtccatatttccttacgattgagaatatgtacaaatttacaagtttagaattctgacaagatgatatcgaaactgaatggagtatgccggagcgccctcccaaaaccaaaataaaagggattgcatctctattcttactctcctaagtttttaaagactcctgcttccttccagattacgacctcttctttgattgcacccaagagggaacaaattaggtgatacagcaatatataaaattgaagttaaaagagcgtgaattgaatagcatcgatctgaggtgctaacaagtgaagctaaattgaaagggaactaattaagggcagatgagaggattgtagatgatgcaaagttaaattgaaaaggaagtaattaaggagatgaggattgtaggtgatgcatggtggagaggggaaaaagctagggtttgcaagaagttaaaacttactctctcgggtatcgtcgaccttgtaaaacatgtgccaaaaatcgtcgccgctgtagatcgatccatcgctatgtttgctgcactcgaggatgaacgcgcgattcaccccgtcctggctacctgctgctcgcctcccatttttctccgcttccgcctccgcctccaccagctcaagctcggactctgccgccgcttcgccatgaaatcccctcgcgattcaacccggcctcagcctctctcccttcgatctctctcgttagcttcatcttctccgtcctccacccttgggttttattttgatttttgcggcaacaaatccgaaaccgattcatattagtagtagctttgaaaaaactattatcctctcaaatagcagtagaaaatagagagaataggatatgggctgctttctgggcctggatatgggccgtacttccattttccgttgaggcccatctagacccataaaagatgaagtttcttccctaacctccggcccccgctcccttttcttgtcttctctctttctgtagtctgtatatgtatttttgtgttgatgcaaggtaatagtttattgttttaagttaaacacacaaatacgattttcttattgtttcccacgaagaattgcatatttgtgtagcaccatatctaatttgtatgaacatacaagaatagaaacttgctttcttacaaataacacagtgacgttctttgactgctaaacttacacaacaaataaataagcttaaatatgtgctgaacataggaccaaacatttgccaacaagacaatacacagaagcatcgttattttctgcttagcatagactatgtatcccttgggctgttcaaaatcactccaaagttgaccaagacagcttcaccagtatattggtgcaaccaagtttgagctcttgcatgtcatactcatatccatgtgttctagctttgaacgcacaacatccaggaacatgatctgagccatctctcttgtcaatcttgaagattaaaatcaagggagtattcaccaccacagcaactacaaacctattcagatcacatggcttggaaatgaatccatcgaagagctgaattttttcagggattctactggtataagaatataaagataagctgaagccattgccatgcacttgtgatatgctaacttgtactgtggcctccaccgtactgtggagaagtgcaagacttatgtccaccgcaccacaatcaccctcaatccgttgcgtaaacactctattgggaagcacgaattcgctgcagatgatagcaccatctatgagctgaaaatcatcatctcgtgtctctccattcttgatcttcatgtcaaactcaatgagcacacgagcttggtttccaatgcctctcttggggccaggcattggtatcaaggaattatctgaatcaacaccattgtcttgccccatgatgaaaggatcatctctggtgcggttgaagatgtagttgcgtagcgggtccaaatgatcccgtactgcaaagtatccatacaagtgaactgggccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaaaggcctaaatttgacatcaaagtagatagatgtgttatgaaaaaaaaagcttaatttgacatcagttccatggtattgagcatacacaggaacaaattaggtgacacatgaatatatagaattgaagttaaaacttaaaaagagcatgaacgagttcacagcatgaggtgctaccgagtgaagttaaattgaaagggaactaactaattaaggagatgagaggatggtagatgatgcatggtggaaaggggaaaaaggtagggtttgcaagaagttaaaacttactctctcgggtatcggcgaccttgtaaaacctgtgccaaaaaatcgtcgccgctgtagatcgatccatcgctatgtttgctgcagtcgaggatcaacgcgcgattcaccccgtcctgactaccagctgctcgcctcccattcttttccgcctccgccttcgcctccgcctcggcctccacctgctcaagctcggactctgcccgccgcttcgccatgaaatcccctcgcgattccacctggcctcaagctcgatctctctcgtttgcttcatcttctccctccttctcccttcggttttatcttgcggcaacaaatccgaaaccgattcgtattgctaccattaaaaagacgaggaaaagaaagaaaaaacgattcttatatcctctcaaataaatactagcagtaaaaatcgatatgggctgatttttgggcaaatatatgggccgtacggccatctaccggtgaggcccatctaggcccataaaagatgagtcttcatccctaacctccggacgactccttgatgctgcgcctcgcgatcgagcggctccagcgctaagtagcctctcccttgtctcacaatcattccatcccccttcctggctaccttgctcgccgggatcaggagtctgctgattgggttgggctgcggacctgcggtggagggattcagggtttctcttgtccctgatccactgcctccacgaccaacaatggaggacaacgttcttgtctcctcgaaaatccatggaaggtgactcccaactcatgcaccttttcctttatttgcttgtgattttaatacgatatggaatctaaacaaaggcccccgcaaaaaataaataaatagagaatctaaagaaaggcatccttacatggcagaattccatcacattatatgcttatattcatttatttgtgtactgttactactaataataatgcaaaataccctctgacatatgtgttattttgctaaaaaaaatagtttcaagaagtcaattctgtgtgctacttaaaacttctgaaagaagtatcattgcatactggcagagcatgcatgatatctttcaccaacattagccagagttactgcccttctttctttttcggcatgcatacctgtagggttgtactgtaatcaaacttgttgaaaaagagagagcatcttacagatgttatgctgaggcagaattcatggttattttcatcaccttgttaatcatgctgattgttggtttcaggagtaaaagcacaacagccaaaaggaattgtataatttgcggacaacgtattagtaagaggagaagaacacaacataattttcagaagataagtcgggggcagcttaatttacagaggacaagaccatgtctgcttaattttcagtctcttcccaaggtatgtcatatcatgacatgaagtcatgaaactctcaactccttttgtgctaggactaggaggctgtattctgatgcttgttcaaaatgcattgtcaggatattgtactaagggtaatgtcaaaattaacattaaaggaagtcgctcagttgagtgttgtgtcaacaaactggagacaggcttggacattccatcctaatctgtactttggtattaaaacagcccttggaaataatgccaagagaaaaggaacaagctctgatctgaactgtagaatatcaagtggtaacaagttcattaaaagggttgatgctattctggaaaaacattgtggaacaatggtaaataagtttgctgttaagtttggtttgtcaaatgagcatgctaaccatgtcaatggctgggttgcgtttgctattgcatcaaaggcaagggttatcattcttgacttctccccagattggaaatcacatgaaaacaaatatgactttccttgtcatattttcgacaaacataatggatcttaccttgaggctcttcggcttgacagtgttactttgaatccacctctagatttctgcggatttgcaaccttaaactgcttgctcttgacaatgttaggttgcaacatttagagcagttaatatcgaaatgccatgttctagagtggttaagcatccaatcatgtaaccagctgcataatttacatgtgtcagaaccattatgccgtctgcaatatttgtcaattcagggttgtcatttacaaagaatggagttacatgctccgaatctcacaacatttgagtacgacggttccctggcattggtaacgctcaatgaatgctccaatatcaaagcatcaaccatcagactttttgatgagaaaaccctccaaaatatattaactggaattccaagtgtattacctcatgttgaaacgttatatgttgaagttcatgtcaaaactcaggtctgattattcttgtactctctatatacatttaattctattttattttctgtttcacatcttgttgtttgaacctatgtgtggcctggtcaccctccagatgtctggatttacacaatcacctctcaagttcactcaattgaagtgtctaactttggaaataacttttgagagaggttcattcgatagaaattcagtcttccagttgactaatcttttcgtagcagctccatttttggaggatctttatttggatgtaagtagctatatcatttgtacttcactacttttattgccttcttccctagccagttacagttcgccttttgtattctcattgaccgattacctcttttttcctatttaatgttatttcgttggtttggaaacccaatcagaataacctgctaagccagtactgtcaatctaattaggaattacctgcttgtccaatgtgccctatgcatgattcatgaactcataagtcccagaaactggaacattcgctgcagactattgatcctttttaacgatcatcagaccatcgaacatagctttggcaaagtaatattgttcggcccggcgaaagtagtattgttcagcattagttggcaactgcatttttttccatttgacagtggactttgtaaattttaatcataattatttgggacatctgtagaagcttttgctatatcgatgtcactgtttaccctgagcatcacatcaccatatttatgcactgtacaagataccaaatagtatgaatcaaggtgataatatgtttggaaaccgattagccatgtgtttccttgattgaatatatttgtatccaaacagagcaaaagcttctttttttctaacaaaatctcagaattccatcccctgcatttgttttgacaagatatatgttcaggctatccttctcttcctcgatcatgaatctttgatcttcttttccctaattattacgtgttagcttgctccttgttagtgatgccataatttcttgcagatgtattgtagcttgaacaggtgccctttggatttggatgacatcgtggatcagcctcactatcatctcaagatggtgtgcatatttggattttgtggcaacacaggccaggttgagctagcaaaatgcattctcagaaatgcgttaatattggagcaaatgatcatcgacccaaaagggagatatcggttggatggatattttgggcgccaggaggcagatgagaagcttgttccagaagatatagatggtgtactcacaattctgtaacttatactccgtacagtagcaaactacagtcacaagttgaagtgttgttccttcaaggcactagtaactaggagtaagttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggccgaagtttgtgctaaacattaaactacttgagaaagtatgcactattcatatgttacaatgagttttaatctccaacccatggaccttttttttttaagcttcaattcaaaggatgccaaaggggtgggagttttaatctccgtcccccaagggactattttttctttccccaagatcgagcttttttttaatgtagttttgtgcaaacacatttggatagttttgaactactagtatatcacatagtaggaaataattgattactatggaagtattcttcacagacaaaaagcttcagttttcacacacatgtacacacacatggattgtttagactagcaatgcatataagaaaaataattacttcctcgaatatgcggatatcttaagttggatatagtagaatactagaatagataaacatctcatcttacgcagataagtgcttctggcagagaagtgcaagataacaaccacattcagacaggatcatataaaaattagagtaaagtccatcaccggtccctaaatttataccgttttgtcatcccggtccctaaactcgtaaatcgaccattcaggtcctcaaacttgttcgactgtgtcatcctagtccctaaacttgcagattactcgtttaggtcctccaacttgttcagttgtgtcaccccggtctctaaacaggacggtctaaaaactttatatcaaaaaataattcataactttttcatgtgaactctaatgaagacaaactttatatcaaaattgtagctctggatgcgacctacaactttgtagttgaaaagtttttgaattaaaactgttggtcccaaaatattgttgcatgtttatagattttgaaattttaattttaaaattacattttgggacaaaaaatgacttaaaataaaaaaaaattcaactataaagttgtagatcgcgtcgagggctataagtttgatataaagtttgtcttcattagaattcacatgaaaaagttatgaattatttttaaatataaagtctttagaccgtcctatttgacccagatgatatttaaatccaagtttagggactagggtgacataactgaacaaattggaggacctaaacgagtgacctgtaagtttagggatcgggatgacacagtcgaacaagtttgaggacttgaacggtcgatttgcgagtttagggaccgggatgacacaacggtaaagtttagagaccggtgatggactttactcaataattaggtacagtatgaggcaccttgagaaaaatcagtgctagaatggaacgttctctttcagatgattacaacctacggagtagcttgtacctaattccgtagtaaacccccataatatttgactctttcattcacattcatcatcgaacccacgctagccatttccttgatcaaattatcacacctactcctgcaggacatagtaaataaagtagcacgttgtcttaaaataatactactccaccttttaatctcataaatgaataaacggagaaatagaaaaaaaatcaggattctgatagaaatgcaagtgcaaagcaggtgattgaaaacacagaaaaagcatataaataaccgtttattggaccgctggaaaaatacagaaattgaataagagagatagacttaaaggaaaattttcaagagattattcatttcataggaatttcaaaggatatgataggatatgatttaatcttttgtttcaaaagcattcataggaaaattttctatatggttgaaatcctccaaagttcttatgtttttcatccaaatcaaaaggaccctaagcatttttagtatttaaaatttgtaacacaatatactttctttattttagaatataagtatttctactatttaaatttcatatacaatataagcatttccaggtactacttcagaattcagatacaccgaaagctaagtattttcagtcacttaggtgattaggaagggggctaagcaattcacaaaatcaaccaatgagacaactgagagggaatatttatcctttagcttactatttactaaataaactaaaaatatgtgtcctttgcagtaagtttaataatactactaccttcaataattgaaacatcatctaccaactcatattacatcaacaatacctaatccatccatctcccctcacatagtctattgaaagccagtcctgtggttggctacaaatctagtccgcttttcttttctcttctctcctctcttcttcacataagtacaaatttaatgtgccaacttttacatcccgctttcgtcactctgtccaatgcataaaaattcatgcattttcaaccaatcaaatgcttgggaggataatctaaataatttaatattttaccactactttaatggaaaggaaatcttcttacttaacctttgtaagatttgctaaacaacctaaaaatactcatattttaggacgtagggagtactattctctcttttttttaatgtatgatgtcgttgatttttgacatgatgtttgaccattcttattattaaaaaaattatgtaaatgtcatttattttgttatgatttttttgtcaccaaagaaatcttaacttatacttttacatatttacattaaaacttttaatatagtcaaacgttatacgaaaaatcaatggtggcatacataaaaaaaatagcactaactatcaatagaaaaaaagatagtgaaattatttaatagtaccagagtatgaacaggatatcgtgagatttatctttaaaagaaaaaaaaagaataccgtcagatgaccttttccgcgtgttgtgtctgtttgttgaagatgaattctaatagctcaagtggacgtccacccgtttattgcatgtcaactagatggttacgaaaaattttcaaaaaaattgacaacatagatcaatatgtaatatatcactccacaaacatgcaagttcaaattcaacttctataagtagtaacgaaaataacaaacaaaactcaaattactatatgtatatttataattaaatttgttatttttgttacaac

SEQ ID NO: 35057 - DNA, 10772 bp, Oryza sativa
  unsure (1)..(10772): unsure at all n locations
nnnnnnnnnnnnnnnnnnnnnnnnnnnnnnnnnnnnnnnnnnnnnnnnnnnnnnnnnnnnnnnnttggttttttataggacagagtgagtatgtatcttagttcttaaggctcagttcatctggggccatcaataaaatcaagagttgaacgtttcaataactaatagcagcgcatacgtgttttcaccaattgtcgccatggttgctttcgcctgaactcagtcatcccctgattttgtctagacggcgacagcccaacttcagtttgtttgtgcaactagctgtgtgcatgtcaacatactaggaatttccagcggggtggttagcaatatagtaatacggcaaacctgcaggacctgaatgatgcatgcaagaaacacacatctagtaaaataatagcagccaacttttttttctatttttctttcttttctccgagttggaccgtacctcatgcaagctgcctactccctccgtccaaacaaaaaaaggcaatctagtgctaagaatatccagattcgttgtactaggatatatcacatattatagtacgaggttgagtttttttgggacgaaaggagtatgttttagtatagagtacgatagctgcatcagcaagtagaatacgccctcaaaaagagaaaaatgaaaagaacaagtagaatacgtcaagcaagtagtccaggactcaacaagctgttctccatagctaagtcagctgggtgaggatcatcttcatcttcacattcacataaacaaaaatacttctgacttggctgcccttgttcaggatattctcaaccctgaaaccaacctcactctgttttttctctatttttgggtttttcctcctgactcctaggcaaccttccattcactgtttatacaagtcagcaaccacacaatgctggctgtgctgggacctgggagctttaaattgtcccttttaggaagagacacaaagaaataagcaacatagaggggaaaaaaacagcatgcatgaaactagcatcaacaagcaagagagccattcaaacaattaactgtgctgccacaagcaggcttgctttgccaaatgaaagcattaggcttctaatacgttctaagagttagtaacaagagcatccgaaagctatatatattcctctccaactagaagttgcaactttgcctgccacttcaaaaggattacctactggctactgctactgtatgtacatgacaaaaggaacctggagatctcactagcaagcacagatcaatctcatcagttctttcttctcttagatgccctggttgactgcgaaggtcctgctgcagatggcacctcttgagcagcctcaactgcttcagctttagagcttctcaaagccctccttgtcatcctcgctgatgggcctgctctttcattttcttccaccagttcagatttgacacctctgcgtctagtcctcgaatgctggttggctgatgggacctgatcttcctcaggttcgttaacatcctcatcctcagcaccgtcatcttcaccctccaaccgaggccattcagtaccacaaccacaagctctcgaggcctacagacacaaacaaatttagaaagccactcctgttcatatgtgtaaagtggaattaaaaataggtgactacctttctctgcgaaaatttcttcttcaaacagtacccatgaatccttacattgcattcctcattaggacaacatgatgcctgttttaaatataagtaataaaaatacatggaatgacattagtgaagtatatgaccatgggtacaagataaatgcaaatgtagaatcgtaattcataatgacatatctgcacctttatacaagcttcattgcagacctcacatgatgggatatcattactacgtaaccaacttcggagatcaagaaatgatcttatgccaagaccaatctttcctgtgggagtgtatgacagccaacgatcctgtatgagttcattaagagttttctccttttgggacaatgagaagttggtaatggaagtaggcagacgggattgactgccctgtgaagcgtctgcaattacaacctgggagcagaacaccaaataattctttcatttgtcacactaccataaaagtttgcaacaataaaaatataaaacatttgcttaaacagaaacaaaagctctcatagtgattgggtattaatacgagatacctggttctcaatccgtgtgttaagagcatcgatatttgttatgctcccatcatttccagcttcatgaactattgcttccaactgcccatacaattacatgaatatagcgaatactagattgagctggattttttaaaaaaaagtgcaaattgattgcataccaatcccttgtagaatgcaatctgtggcacagaaaactttgatccaagctttgactcttcatcagcaatgttattgaccactccataatacacagtaccatcatactggtttatgcctgctcttaactcaaactgcaagtacgtgagctccttgttgatcttgaggagtgtatcatcgaacagctgccgatgagtggctgcaagcagtgatacggaacatgagtgatcgcaaaccattttgttagactcaattatgggaatattcacaccccttaggccggaaattatataacatcacgcatagtatttttatgatttgtcagcaatcttaggtaataaaaccaggcgtcaatggtgaactgaagcagaaattatctgaaactgagagaaggttgggaccaactaagattgtttccattgagatgatagtaattcctagaggggcattacgtcgaacacctgtgctacgagtaatgaaatcaatgactgggagctacatcaggagaaagataagagtagcaagcggagcaggcagaagcatataccggggttcttgccgccggagatggcggagaagagggcgtggaagtcgcgctccgagaggggcccgcgggagagcagcgcctgcagcagcgtgtggtggcgccacgagagcggcgccatcgctcgacttgcccctgccgcaggatcgagctcgctagtaatctggaagagagggacggaatgggagggagatgaaggaatgaaggaaggaaccctagcaagagcagaaggaagtttggggatgaaatggaattgacgagggcattgagcgaggtgaggtgggggaaaatgtgttggcgattggcgggaagaggcgcgaggagacgcgggaagagaagaagagattggcagcgcagcgggccagcggagcaggacggcagaacaggacaggttggcgtgtgcgggccgaatacaaggcccatgtgatcgagcccacccattgccgttggtgagaattgagcccgacccaatcctacccgcccaagtatttcaagtgtagccgatgcatggtttaagccgaacgggaaaggacaaaagtttattcgaggcgcctcatgttgttgttgagtttcaaaatcgatttttgacccgtaaaaggggatacaacgcatttctaactttcaaaaccagtacaaacaagattccttcctttatgtattgtccctgattttatctgacgtggaggccgccagccccatctctctccccgttagccgcccttctctccactgcccgtgttcggccaacatcggtctgtagatcatagatggaagaaagagggaagtaataagggttggttgttgatatgtgggtcctattattatttttattttctgatatgtggccccttgatttttattttttttcctggatcaaattatcatgtaagcgtcatgtcaatatcacacgtcgaataaatacctaatcaaagaagccacgcaaacgtcacataaaccaaaagcagtaacattattgtcaagtgacctcgtttgtattgggtttaaaagttaagagatgtgttgtatctgattttacggttgattcgacgagggaaaatttttctaacaggaaacgatgagaaaaccaggtcagtctaggccaggcagaccggctgacggctgttgcttcttggcctcttgggcctgtggttactggttagatatttttgcagccagttggtgcgtgtttgacactttgacccactgcattgtccattggttggttctgcatgcacgagtgagtgtctcaacctctgcttgagtccacacgtcctccacgtcacacgctcgcgattcgactcccatttcgtggcaggacagagacaaagcagagctagcgatctctgcagctttcttgttcctaattcgattcccatggcgcactcccactctgcggcttcgctgcacgccgcccggctactaccgcagcagcgcacgcccaccgcgccacggacactgttgccggcgggcggtggcctcttgctccgccgcccccacccaccgctccaccagcagcgccgcagccgctcctcctctcgtcctgacctccgctgccgccgccgcctcctcaccgcgcggggtgactacgacttctacgagaactatgccgatgaagaaggagatgaggaggaggagtcggaagtcataggtgggagcttcgacgcggcggtggcgctgttcaacggcggcgagttccacgcgtgccacgacgtggtggaggagctctggtacaccgccgaggagcccacccggacgctgctccacgccatcctccagtgcgccgtcgccttccaccacctcttcaaccaagtatatattttcatcgtctcatttccacatttgactatgcatagtaaattagtaattactccagtaaaatttgtgattagacatgatcgtgcacaaacacagaaccaccgtggcgccatgatggagctcggggaaggcctctgcaagctccgcaagctgcgtctcgacgacgacaccacgagcccattctctcggttccaggaggaggtcgccgcggcgctcaacttcatctaccgcacacagaaggagctcgcggcgtgcaccgacgatctctgcctcaccatggatggctccgcgacctcctaccagctgcttggcaacttcgccgctggccagaagctctaccggcttgaaacaacaaccagtgcagatggagatggcgttccaactataatcttctctgcttcttcacgactcgtcagggtgaagctccccacattgagcgccacggagcatcatctagcagcgcttcaatgtacaagcgagtatatttagtttctttttttttccctgataaaatgtttagctcttccgatccgtttgaaccaaattgtagttttctgtacttgggaaacgaggaatggagtcaaatggattatagtaccattggtttccttttctttcccttcaatttttctctgcacatactcttattatacgatgatgctaattttagcataacgggtgaccatgcatcttaaaaaaatagtagaactatgttatatttaaagtacctcaaatgataaaatgagtagatttcataaaacctgaggtcttaggctatctaacacaaaatcctaaaatttacaatttatgttcatgcccaccatgttttagggtaaaatgttccatacgattctagctacaagtatttcgtccatttgattataatagttgtaaaaaatgtatgagatattttttctatatgcacatgttaattatgtgcttttcaacgagccatcatcatggttttattgagtgaatttcactttggtccccctgctatcgaagtttcactttggagcatttttatctgatttttttttcactttggatcatctatttttgttttcttacattttggaccatccaaactctctttgcggcacatcaacaatctcaagaacattggcaccctcatgaggacgatctctcctatttacattcaagttacatcgttaccgagggagagattggatgtgattatacataagcattagggctaaagtgtagcctaatatgttgctaaaatatattctccccgtcctagcatataagagattttaattggacgtgacacattctagaactacgaatcttagttctgattcgtagtattaggatccaacccaaataccttacattttggaacagagggatgtagtgagtattatttggaaaaaaataaatgaacgagccttatcataacattaaatatgtaagggtatcaccaaaagcgatatgtataattcaagtgataaatgctatggctatattcaatatagcccgcattgtacgctaaacaaataacacgctttaacgtatgtatattaatagaaaaaatgtatagcatatttgtatacgagttttcaaatctcacaagaataaaaccaatagtattatctatttaattcatttttatagctatctttgataaaattataatccaataacattatcctcagtttcttttttcaccctctcatgttctgatgtgaaaaaccctctgccctcttgaacccaagaggcttgcagcgaacacacgcagcacggaaaggggaaaaaaaaagaaaaccaaaccctctcgtctcgtcctcccccgcccgccccggcctcgccgcccccttccctcgctcaccggcggcgaattcaagctgacgagctcgccaccggggtacacgccactctccctcccaaaacctccgcaagcttcaatctctcacttccaaattcctgattttctcgctttttttgggggattttttctgcgccaggattggttcgatcttggccggccaagaagcacaagtttcttcgggggattagcttgttcgcgagggggaggagttcggtggtggagccttcgccttcgtgatggcggacaccaaggcggacgccaaggcggaggcaaaggcggaaactatcggcggcggcggctctggctcgttcagcgagcaagcgtttgttgagaagcttaacaagctcaacaacacggcgactaggatccagagtatcctttcttccggttgtttatttcttttgcgcttgcaaatttggtagcgctcgtactttatctgtctagtggttttaattgatttactgttccagatgaatagaaccctaaattgcaatgtggatcagtacaactgacataggatatctccttggcgttccatacgttggttcttgcgctatttgtttggttaatattcaccttcttatgttcctaacagtgcttattgctgttagacagcatctcgtgcgttatttactgatgcatacggatataacttagtgtggcaattgtttctgtagcttctggatcatttttttgggcatattttgatatactgttttgaattatagctgtataagtgtatatagatgagcatggctacaaaatttagatttcttatcagcattatggtgtatcagcaatcaaagttggtataataatttctgtttgatgcattcttactgtatacatgctttccattatttttgtttcttggggaaatctttttttcttgtcttttgaggatgattatctttacaaaaatgaaaaataatggcatgaactgttaggtattattttaatagtatccttctgtttgatatgcaacgattttttgtttgttgagaaatactatgtttttcaatgccttttgaggatgactgtatctagaaaccgaaaaatgatgataaggagcgttcgggctttgtgttacattttactagtattttctaggttgtctacttagtacttatatatgtttcctgtacattagaatggaatattttacctgttcaatttgcaaattaataaccagaactgatcatattgccacatactttggttccttttggttggtgctattagggtagtggtatgctagtgctattagggtagtactactttggttgcttatattatctgtctggtagttttgattgatttactattcaagttgaatagaaccctaaattgcaatgtgaattagtacaactgacccagcatatctccttggcattccatatattgccttttgcactgtttgtttggttactgttcaccttcttctgttcctaactgtgcttattgctgttagagttagattgcatctcatgttttacttatcaatacttattgatgtgtacgatgatacacatataacttggtgtggccattttttctctagcttctggatcattcttttgggcatattttcatatattattttcaattatagctgtatataaattagcctagctaaaatatttgtagtttcttatcagcgttatggtgtattgtgctattggcaatcaaatttatattacaattttggtttgatgtgttcttactgtcaatacatgctttccttttgtttttgtttcttgggaaaataagttttcactgtcttttgaggatgattatcttttgaaaaatgacaaataatggcatgatttgttaagctgttgtgttacatctagtagtatcttctattcttctgtttgacgtgtaataattttttgtttgttgtgaaaaattaagtttttctatgtctgttgaggatgattatattttgaaattgactaataataataataaggagcgttaggtttgtatcacattgtagtagtgttttcttgtacattcgaatataactgttttcctgttcaatatacaaattaatgggtagaatcagtcatatatcacatagtttgtttccttttggttgctgctatcagggtactgatatgctagttcaactttttttttttatctcttgatggctgagcacaatctttgtggaattgctttttacgatgttcgaaatacagtgtgacaatatttggttgcactaatgttgtacgcccttcgtcccaaaatataacaatatctagccttcagaatttgttgcaaatataataacttcttcactaacattctctttccaaccaatcacaatcctccatttctcatccaatcacaaccttcctccatttaattctacctattttcttaataaccgtgtataaccctaaaatttcttatatttctaccaaacaggcccgtagtattggcaaatgaataaacaaccttttctattattttatggccatttatcttcatttctaagtcagttaatcagttaggtcagaactaatatactttcatcaatttaacaaataacaaattccctacggttgtaaaaaaaaaacaaattgcaattttttggcctttgaacaaggataaatatagcatttatccacctgcatccatatattcatgctactaagggggtggggggattatgtgatggttatgtcatgtccttttgcttacatattagcaactcgaagccctatgtaaaatcttctgaacaagttttaccacttgctttcctgtgtttaatgccaatgccataaaaatcatttacacagtcatgataccaaattcccacagcatatttttaacaatagcatctagaatacagtagcttgccttttttattccttaattcttaagcagcactttcaaattggtgcatttttcaccgaaagagagccagaaaggttgttgatacatgggagaagcagtataacagtgcaaataaggataagaaagtatcattcctgtacctgtcaaatgatatcctgcaaaatagtaaacgcaagggaggggagtttgtgaatgaattctggagggttcttcctggattattgaaagacttttatgtcaatgggggagaagatggaaagaaagtagtcggaagattagtaagttattcttaattccgttacatgtttaatggcaggaaaagtctatttacttcatttttttctatcacaaggccaaaacccgaaaagtaaaaaaatatatttatttttaaaattacagatagatatttgggatgaacggaaggtctttggaacccgtattgaaagtctgaaagatgacattcttggtggtagcactcatacaatgggtaacaatggcaatagctcaaatccaagctctcacccctcttcagtttccaaagctgtgcgaaaagattctggtacagtaacaaaagtaagttgccagatcttgacctgctaaagaaatattttcttgtgctgaggatggatgcagtatattgtcatgaatgtgagctatttttgttgttttttcttttgatgtagaaacttactattggcgggatgccagaaaagattgtaacagcatatcagtctgtgcttgatcaacattttgacgaagacacagctttaaacaaatgcaataatgctgttagtgttttggaaaggatggataaagatgtagatgatgcttgtacccaaggtaaaggattttctctcttcaataggtctgttatgttgtagatatgtaccgttgaaaaattggcacttaatgcattctgataccttggcctgtattgcatcatgattgttccagcgttattttacttctagttccatcatgtacttgacttgggaaaaaaggaatttacatagtatttccgattttccattgatctgccatgtaaattctagactaaacaaacatctcaaatacataaaaatgatctagcatgttgacaaagaaaattgctgtacataattttataatcatgtgaaaaaaactataatgatgtgattgtagcacgcgttggcatataaaggggaaaaaacatttttctgacatttgttttcacaagtggtggtctagcatacatatcctttttcagtggaccacatccagcagcttaattattttacattgcgttccttgagtcctttatagtgcccactatgcctgtaggccataattat

SEQ ID NO: 35058 - DNA, 355 bp, Oryza sativa
aatttttggatgagtctggacgcaaaatagttgcctacatggagcgccacgtcgtcggtcagccctggtcgaacaaggtttggacctgctgtgtttcatggacctaaacgcgcaattttcaagtttacagacctaagtgacaccactgctcaagtttaaggaccgaccatgcatttcactctaatcggaaacctgtaccctgactttttatatttacaaagttggatatgaagagatgatcatcctttgacactataatgctttcatcctttcacttcgattcttggatcaaaataatctatgcacaccttactccttttctatttcataggtattcagcaaggatcatcgttga

SEQ ID NO: 35059 - DNA, 731 bp, Oryza sativa
  unsure (1)..(731): unsure at all n locations
atgttgatgatgaaaaggggccaagtcacttcaaattatgtggctgaagtgaagtatttgagacctcttagaaagacaaaaccattacaatgtggcaaatgtcatagtgtctgcttgcctggtgaccctaattgttcgtgtgcgcaacagaatggtggtgatcttccttacagtgcaacgggattgctggcaaagcacactccgatggtttatgagtgctcctctaactgtcagtgttctcataattgtcgaaacaggatcacacagaagggtataaaactgaactttgaggttttctggactggagaccgtggctggggtctgcggtcgtgggatcctatccgtgctggcacattcatttgtgagtacgccggtgaagtcattgatgaaactaagatggacatagatgttgaggaagacaaatatacctttcgcgcttcatgtcccggcaataaggctttaagctggaatttgggagaagaattacttgaagaaaaaagtacggctgtgataaccaagaactttaagaaactaccaatcatcataagagcaaacaatgaagggaatgtggctcgttttttgaaccatagctgttctccaaatctcctttggcaagctgtacagtatgaccatggcgatgacagctacccacatatcatgttttttgcaatggaannnnnnnnnnnnnnnnnnnnnnnnnnnnnnnnnnnnnnnnnnnnnnnnnnnnnnnn

SEQ ID NO: 35060 - DNA, 587 bp, Oryza sativa
  unsure (1)..(587): unsure at all n locations
nnnnnnnnnnnnnnnnnnnnnnnnnnnnnnnnnncctggctctgagccaagtgcaggcatctaaacgaacacaaccctgctgactaggtgtgagctaggtgcggtccggaaaaccaaacacatcctaagttgacaagtatattgagaatatggttgaagtatactgactaataatcaagtaataatagacatacagacggtgaaaatttaactggcaaccaagcaatgaatcccccaagaaataaaccagatttgagggagaaagtccaggattttagcctttgagtttatggataccttgcaccagatctcctatgccgccgccgttgtgcgcctccgtcaccgccgtgcgcagcccaaacctccgcgcggcgccctagccgagagaggactgagtcaggcgcctcctttctgtcgtcgcgagagaagccgaggggatgcgcgactcggcctgagcccggtgcggatggggaacgctggcatcctgcttgtaatttcgtccaacactagtgtttattannnnnnnnnnnnnnnnnnnnnnnnnnnnnnnnnnnnnnnnnnnnnnnnnnnnnnnnnnnnnnnnnnnn

SEQ ID NO: 35061 - DNA, 522 bp, Oryza sativa
  unsure (1)..(522): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacctcagaatcaacaatcataagatgatagggcatgtgcctggtgttgaagtcggtgacattttcttctttaggattgagatgtgcattgttggtttacatgcaccagccatgggtggcattgattacatctcttctaagaacaaagatgagactctggctgtctgcatcatttcatctggaggctatgagaatgacgatgatgacactgacattttggtgtacacaggacagggaggcaacagtcgtcacaaggagaagcacgatcagaagcttgagagaggtaaccttgctctcatgaacagcaagagcaaggggtaccgagctcg

SEQ ID NO: 35062 - DNA, 1541 bp, Oryza sativa
gaggtccttcagtgccactcagtgcggcgatattaatgtggtaacatcatactttcgagttctacgcgttttaactttggaggattgtagtgttactggggaagcttgtggaaaacatagattagagcatgtagggaatttacgccacctgagatatctggggatttggaatacacgtattgatgagttccccaaggaagtaggagatctcaagtttctacaaacgctgaatttgtcaggtactggaatacaacagctcccggaggctgtgggccttttgaaacaactgttgtgcctacgtatcaatgacagtatagcagttccagctggtttgatcgggaatcttacttcattgcaagagctgaagatatggccggttgatgatgtctcaacaaggcagtttgtgaaggagctgggcaagctgagggagctaaggattctccggtgtaccattcatattagcgatgagggcatggagagagatttgctagaatcgctagcaaatctgcacaagatccgcactttgtgtattttgggctcagcattaccgagcggcatcacacgggaagcatgttttgtgacccctcagcgccttggacagctgtgcttggaatgcttcaagttctctggactaccagtatggatcaactcttcacttcttttgaacctcacccatctagatgtgtcagtgcatgtggtgcaagaacaggacatggaaacccttgggaggctaccagagctctgttatctcaaactgtgttcagattacaccaggctagtaagcataaggaatggtgatctgcaacgctacttatttcggaaattgagattctttgtttctccctttttatttgcccggtttgatgatttgcacggccgtgaaaacgacggcggcatatgcatagcagtagcaccttccatcatgatgccaagccttgaatcccttgtgttttgtgtctacgtacggttcctaaaagatatggtggaaatgcagcctggctttgacaatctgcatatgcagcttggctttgaaaaagttgctagcagttcgctccagagggtcactgcaacgatccaatgtgaggatgctactgctgctgcggaggtggaggaagcgaagacagcattggcgcatgcagctgacctccatcccaaccgtcccacccttacaactcaaatggtgaacaagcataagatgctctcatccgaccgagagctacgagtgtgaagcagaggagatgatggagaactggcggagagaatctaggagcaggagagcaaggataccagctctgctttcccctgatggttaccctgcaaaagcaagcatacatgttgcattgcttctgtatcaattctgtgagacaatttagttgattctctgaacagagtcagctaaatgccaaatgcccgggtccagcctgtgtttgatcgattgacgattggttcggatatctccttcacttttctgaactccatccccgattcaagatgtcaaatgcatataattcttaattagcaactagcattacgtggacaat

SEQ ID NO: 35063 - DNA, 609 bp, Oryza sativa
ttcttgctttagggtttgaagctggagccaacacatcaaacattgacccatggtccatcattggagatgaatcctctgtgcacgtcacaactgatcgctcatcctgtttcagtcaaaatccggttgctgtaaggatagaggttgtctgtgacgattgtccagctggtggtgttggaatatacaatccaggattctggggcatggtataagttctctctcagcatatagcagctcattcccatatgaatatgcaaaatagatcttgtaatcgaaagaatcttttttctgatgatagtttaaagtatacggtgctgccaccgaaggtaattatagcaaagttattattcttatcaaaatactgaagctaacagataactaagctaacctattttttgtttgctttcaatttgcattgatcgcataatgctggttttctatcttattgccgtgcatcacttgcttggaaagtgtaatcagtgttatagcttttcgtcaaaccattttcacttttaccttctgatattttaatgtgattatgatcatttcaattttcagaatgtagaagaaaggaagacatataatctagtcatgcatatcagatcattagaa

SEQ ID NO: 35064 - DNA, 713 bp, Oryza sativa
gctcggtacccatgttacaattctggctctgggtcgtcatggtaatagtacctgttcctgttggattccatcactctttttcttcgtagataacatcaagctggtaactcggttcctgcaacaagcacaaaggttgaggaaattccagcagcccagtgaaagtgcagtcataattcaagttgagtcactgtaagacctccttaccgactactaggacaacagttcatgactggtcattgttcaaacagggaatgtaacccaacaattccagcaagacacaacaaactcaaaataaatggcactaaggatctcatcagacatacgcatcaccaacacaagtagataatgacctttcaataccacagcgttatatacgcaacccaagtggcaaaattaagctgcaagaagccaataaaaagtaaccatctcgcaatgttgaaataaacaacgagcataatcaactgttcagtctcagactttcacaaaccaggaaaaaacagtctcaagcatttaattttccatgtacagtacagaaatgataccctcaatgttgaagatgaacatgtggaggtacagaaatactgatcagagtgaatgcttgcctttgcaacatcagatcattgaccattcactacgaaaataagtttcatcgcttaaaaatgcagtatccaatgaatagacaccccaaaagtgtgaagtagcctcacggtaaa

SEQ ID NO: 35065 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnagtgtacattaacataccaggaaggaaggcaaggatgcccaggaacaagagaccatatgcctgagagttatccccctccatgtgacctgtgaatataaaatatgacaggaagagaagagaacatcctaggaggaggaggaatagtgccagggcaattgatttccacgggatttttctgagggattttggggtgtaagtgaaccgaaggtctacatcatcagtaaggttgctgtcatccctgtcctctgtaggaagaggagcataccccccaacattgcgtctagacgccatagtgcagtgcctgcatttgaaacacatactgtaaaatacaggtagaaaatggcatggtaatacacagtaagatctaagagttcaactgacaaagaaaaattaaaatacactgttgctgttaatgataatccaaaattacaaggtttgaaaaaaaaggtgcaccaaacagtaacagagatgatatgacaaacaaaactaaggttgtggttgtcgtcgcatgtgccatgccaagggccttaatggactgcatgtgacatggacatcacaaatttcatgtgaatcattctcagagaagaactattagtttttatagaatgattagaaaaatataagataaaaatttctgtaatgcgatacataatttgaaatgaactccaagaacagaatcaaagacaagaacaaga

SEQ ID NO: 35066 - DNA, 692 bp, Oryza sativa
  unsure (1)..(692): unsure at all n locations
nnnnnnnnnnnnnnnnnnnnnnnnnnnnnnnnnnnnnntttccaagcaagtgatgcacgggaataagatagaaaaccagcattatgcgatcaatgcaaattgaaagcaaacaaaaaataggttagcttagttatctgttagcttcagtattttgataagaataataactttgctataattaccttcggtggcagcaccgtatactttaaactatcatcagaaaaaagattctttcgattacaagatctattttgcatattcatatgggaatgagctgctatatgctgagagagaacttataccatgccccagaatcctggattgtatattccaacaccaccagctggacaatcgtcacagacaacctctatccttacagcaaccggattttgactgaaacaggatgagcgatcagttgtgacgtgcacagaggattcatctccaatgatggaccatgggtcaatgtttgatgtgttggctccagcttcaaaacctaaagcaagaaattagacaaaagttcagttaaagttaaacttcaaatattattatttatttatttatttattgagggggaaaatgttttcttattcaacattgctatacatgaggtgattggattcttccccaatattcttggcagtaagatcacaattcacaaattccaccattcatgttgcttttttaaccttcag

SEQ ID NO: 35067 - DNA, 748 bp, Oryza sativa
  unsure (1)..(748): unsure at all n locations
nnnnnnnnnnnnnnnnnnnnnnnnnnnnnnnnnnnnnnnnnnnnnnnnnnnnnnnnnnnnnnnnnaaatgcaactaaatatggtcctaaatgtcaaacatttttaatcggaagggatacatactaatataatcgtattgaacagtgaaccacaactcttgcagtaccgaataatctctgtaaactctgttaaaaaaaacttactcctagttactagtgccttgaaggaacaacacttcaacttgtgactgtagtttgctactgtacggagtataagttacagaattgtgagtacaccatctatatcttctggaacaagcttctcatctgcctcctggcgcccaaaatatccatccaaccgatatctcccttttgggtcgatgatcatttgctccaatattaacgcatttctgagaatgcattttgctagctcaacctggcctgtgttgccacaaaatccaaatatgcacaccatcttgagatgatagtgaggctgatccacgatgtcatccaaatccaaagggcacctgttcaagctacaatacatctgcaagaaattatggcatcactaacaaggagcaagctaacacgtaataattagggaaaagaagatcaaagattcatgatcgaggaagagaaggatagcctgaacatatatcttgtcaaaacaaatgcaggggatggaattctgagatttttgtagaaaaaaaagaagcttttgctctgttggatacaaatatattcaatca

SEQ ID NO: 35068 - DNA, 771 bp, Oryza sativa
agctgttaaaacagttttcctctgtttgttctcttctcacgcgttctacgctacgcgggaggcatataaatccggcaagcaagcgaccactcccacgccacgcgccgctctcactcggtcactctcactcttcatttcgtcgaacacctttgcctcacaaccaccccccatggccgaccgcgtccaccccatgcccgctccaccgccgccgtcctcctcccctccgttggaacacgccgccgccgccacggagaccacgccgctgcaccccagcttccgcggcgcgcggccgccgtcgccgggcacgtacatcatccaaatccccaaggaccaggtcctccgcgtcccgccgccagaccgcgcgcgccgctacaaaaagctcgcggcgaggcccgcacgccgccgccggctccgccacgcgtgctgcgccgccttctgcgcggccctcctcctgctcctcctcgccgccgccttcgtcggcgccgtctacctcgtcttccgcccccgcgcgccgtccttctccgtcgcctccctctccatccgcggactcgacgccctcgccgtgtcatcgttgactccgcagatcgacgccgccgtgcgcgcggacaacggcgccaacaagaagaccggcatcgactaccgcggcggcggggaggtgaccgtctcctacgccggcgagcggctcgccgccgggccgtggcccgcgttccaccaggcgccgaggaacgtgacggtgttctcgacggcgttggccggaggaggcgtgagctt

SEQ ID NO: 35069 - DNA, 843 bp, Oryza sativa
gggccagaatgtaaaaaaagcccatagcccatttttgtcgatctgatttctaaacgaagcccatagcccattaacgaaaagagcccacggcctcttctcttctttcttcctcctctgcaagccgccgacgaggcaaatgagagaggagggaagaaaatcgtaaaggagagagagaagaagaagaagaagaagagcggaagaggaggggaggagccatggatgcttcagcgctcagcaacccgcggctgcaggccatgctagaggtaataataaacccataatgtattagggagatttagagatgagcggcacactcgagtacccgacctatggaaccctaacatggagattaattagcagcccccttcttttgatcccttcctgctcttcagcccatctttttgttggtacgctcgctattaattatgtgtcctttctagatctactcggagattcgtgaaaaaggctgagctttgggcgaaagtttgctgatttgggccaagtttttgcccttactgttccttccaacctttagcttattatgtatacattttatttattttgttcagttgttttagcaatattcttcagtctgcaggaaggttgtgccctaatttaacacatgtgctggaatttacagtttaggtggaaatcgatactcgaatcctagttgcatattaatttgcatattactcgatacccaagtacccagtaaccctgactgcaaactaaactaatttggataagtctagttttagccttttaggcaccatcagaatggtcctggtggagatgcgctcgtagcgcagtggcaggggtcactggcacgcaccccgtcggccc

SEQ ID NO: 35070 - DNA, 481 bp, Oryza sativa
aatagaatgaaatttacgcatgtatcaattcgcggcaggcagtcataattggagggagaaattaactgggaagaatatatcaataattgattctacatatccacataatcactaattaactgggaatttaaagccatgcaaaatttgtgcatatataactcacccgcaagggagttcagaaaaccatccaattcaacaaatcatcttacataggttgatcgaagatcaaatccaccagtatacgtaggaaactgaaaatgtcctccattaatggcgtcagtatcctcttcctcctcgccgtccttcttccggcgtctcagctcgccgccggcatcgactcggccctgtacggtgcatgcaagaccgtcgccggcaacagcggggtggtcagcgtcacgttctgcatctacgcactcagctccgacaaccggagccacgacgccgtcggctttaaggactacgccgtcgtcaccgtcgacct

SEQ ID NO: 35071 - DNA, 418 bp, Oryza sativa
  unsure (1)..(418): unsure at all n locations
ggcgaattcgagctcggtacccttggccagtgaaccgggccagagactggaactggtgtgtgcggaagtcaacggcttcaacacagtagtccaggatatccaggtcatcgtggcgactgcccacgtcgcggatgaaggtgaggaggcgctgcggaggctggcggcagtggtggggaaggaggaaggcgcggtcggaggtgacgtcccgccagactttgcagacggcacggcactggaggatggattttggcggtagcaggagcagaatctccgacagaatttcttcagggaggttggcaatggtgagaggcctacgacgctgctgttcgggcagcctcaccatctccgccattgcaattgagcccccagctgannnnnnnnnnnnnnnnnnnnnnnnnnnnnnnnnnnnnnnnnnnnn

SEQ ID NO: 35072 - DNA, 614 bp, Oryza sativa
ttacgatattcatgttttaccgcacatctcatcaggaacctaactttagaaaatatatatatatatatatatatatatatatgcacaccatacattacatgcggccaaaacgaagccatccatccatctatccatgatccatcctattgttagtttttgccatgaaatcatgaacgcgtgcagtaatacacacccctagaacgcacactctacccagccatattaatcctctcatatctttgacacacgctacactataaaatcagttatccatagccaacaattcatcacagattcaccaaccagaagactactcccgtcgtcatctgtgtgaggctagctagctctagctcgatcgatcgacatggcgaaagctagggtgaacctgaccgtcctcggcctgtcgtccctggtggctctcctcgtcctcatcatcgccgtcgaggatgtcgccgtcgtcgcgcaggtcatcgactactcgtccatgaatcgcgaccatattcctggaacaccgcagctcaaccaccccggcgacatcgctaacaaatacacgcgtggatgtgagaaagagcaggcgtgcagggatagcaagatgacatgatcgatcgatcgat

SEQ ID NO: 35073 - DNA, 948 bp, Oryza sativa
aaccaaggataatttagcaagacggaattggaatgggtgtttacgatattgtttttgcatgaaaaatgagtctattcaacacctgtttttggattgtcattatgcaaagtttatatggagagcggtttagttctctttttgcttatacctccctagaagtatatctcatatgtttgacagttggcttcagggtgtggacaagaaaaagagtaaactgatacttgttggtgcctcagctttatgttgggctctgtggttgtgtagaaatgatagggtttttgacaaatcactatctgtttcctatatgcaagtaattttcagggcaacatattggcttcgactgtgggctcaactacaaaagtgtgaggaagatggagaatttctgtctgatggagattcaccaataaactggaataatgttttccttgtcatattaggatttcttttatttttggttggtgtgcttgttttattttggactgcgtctttttagtgtgctacttcttgtaataattggctatagctctcctaaacaaaggccggaatgttttattccattatctaaaaaaaaatctaacaatgacagtatgtgttgcaccctgcattgtcatgaccgatgcttcaaagaacctctttgctattcaactgttgtgatcttgtgattggtatcctattcatttcgatggaatatgattatttccctttcttataccatgtttagcattgccaccttttcacacttcttttcttagcatttagctaataatcgcgtaatagagtatatgcatccttaccaaggatttaaatctccggttatagctaccactatagccggagatagttgttaggaaaggaatcatctaagatatgctgattttgccgctacacattctcagccgctaatagctggtattagcgggagatggctggtaaatagacctcgaatta

SEQ ID NO: 35074 - DNA, 15299 bp, Oryza sativa
agtgtgctacttcttgtaataattggctatagctctcctaaacaaaggccggaatgttttattccattatctaaaaaaaaatctaacaatgacagtatgtgttgcaccctgcattgtcatgaccgatgcttcaaagaacctctttgctattcaactgttgtgatcttgtgattggtatcctattcatttcgatggaatatgattatttccctttcttataccatgtttagcattgccaccttttcacacttcttttcttagcatttagctaataatcgcgtaatagagtatatgcatccttaccaaggatttaaatctccggttatagctaccactatagccggagatagttgttaggaaaggaatcatctaagatatgctgattttgccgctacacattctcagccgctaatagctggtattagcgggagatggctgctaaatagaccttgaattagcggcagctaagttgttggtgggccaaaattggcaacgggctatagcccatatccctctcctatgtgactaaagtactaaccctaactctctcctatgcaatgcgtactccatctctttgcagcgaccggcggcggctgcgcctggaggcggcgcgacggcggtgctcgcgcggctacgtgcaacgacggtggccacaacgcccggaggcagtggcgacggtggcagcggccgccgctgcgcccaatccctccctccccattcttctttgttcttcgtttcttctccaagcggcagctgcatccagaggtctaatcttctcccctaagtgtgttcagtatacttatcatgtgacataatatttattttgttctagtgatgtactatttatctttaattcatgtcaattttttggaaaaccgctaaatagcttagctgcagctatagccatctatagccggctatagccgatgaaaaccatagccgctaaaaggcttagccggagatttacttgaggtagagactaggatattacacttcttatctagtattctaaactggcagattgtcctgccagctgattggtcgagacggtgtctaatagtatacgacacgtggaaaaaatataacagcgtatggtcggatttcacggttggactttctcgattaatcgcgtatctgtgcacgtccgtctggccgaacgacttcgcgcgacggcgcaagcagcccactccgctcctgcgtgcagccgcgtgggccgaagcgcagagcaaacctcgccgcgccggtcgtgtgggcctgacacctagctggaccgtgcatgcatgatccccgaatttttttttatttttaattttttttattaaaagttttacaaaaataattttctattttgaaaattgacggaagtggtcgcctaccgccctctgggagggcgatttttaaaaatcgtcatcccagagggcggcgaaagtgacgtggcagacggccgttcgctctcgggcgacggccgccaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctcccccctataaagcccagtcccccctctctgaaatttcattatattcactaaaaatccaaaaaaaacgaaagagagagagggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaatttagggcatagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtaaagggtcctatcaatgcaggggatgttgttggaccatcgatgcaaaatgagaaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaagcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctagtactggttcctagagagagtgcacattgcagtggtgcgtatgaggcccaacatttgccttatacatgatcgttatgcgggtatgttgcgggctattgactacttgcagaacggttgggatgagaagggacttccagctaagtggcctgatgttcggagtcggtggtgcatgagtcacatgggtgcaaatttctacaagcaattcaagaacaagcattttgtggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacacaagcgtactttagggattgatacaagaaaattggtccgtccatggccgataacaacatagtgtttggcaacgtagtgacaaagtacgtggaagataaaatcaaaaaggcacggagacatagagttgttgctcaaggcacacaagtgcatcggtatgaaataatgtgtgttgataggagcaggcgtggtatctatcgcaagcaagccgtacaggaatgtgtcttgaaggcggatggtggatgtacctgcagttgtatgaagccgaagcttcatcacctcccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaataagcagccgcgcaaggccaaggcgtcgtcgcacagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcactcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagactgctggagacctgagacgcacacgttccaccttccctgtggggagatggctccgacactgcaggacgtgtcgtacctgctcgggctaccgctggcgggagcacgagttggtcccgtggacggtgtttttgggtggaaggaggatatcactgcgcgcttcgagcaggtgatgcgccttccacacctaggaccggccaacacccttcctccgtactctacagtcgggcctagcaaggatcccctggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtgcagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacatgacatgtctaattccgatcatgtttattgcagcgtcgttacgctcacgtccaggtgagacgaggttacccggactacgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagtttggattgttcatttctaaatttttatgataattacttcatcgagccatataatttacctctcttcacaggttgactcgacggggacagctagcaggcgcactggctccacgtgtacagcagtacgttgacgactgggtgttagctacagaggaggtgatcaacgagctctttccacacacggaggagaactaccgtgactaccttcactggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctatcgtcggaacaggacctcgacctacggtacctgtttcacacggtactgctcagcccagaggtttcttaagttttgtttctgtttttgtacgaaaacatcaccccgtcgtaactagatgttccatcctcgcaggacctcgtttgccttcgagcgcccctagcttcggagcagtgcgacctacagcaccggtttcgcacggtacagttcagcccaaagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccatacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatgatgctagaacaacttatgctcacgacaacacactttcggcgcttcacggtagtgttagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacatgaaaatggaagcgccattccttgagcgtctcaactggcgaagcgatccttttgctggttggtttccaccatggtgtgaccatcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgatggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatgaatgtacataggaggatgtaaggaaatgttaattcgtacaatggattgacacagtcagagttacttcaagtggcgggccgataacgcaacctaaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcaatggatcgacaatgtcactccatcatatcatggccagaagataacagagtcagcaacacaagtagagtatcaacgattgaaggaccacgagaatgcaatgcattctgaccgacctagaaggggccgataggttaccgcatgcttgattcgtcgggattgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatattaatacaaaaatataaagcacagtataaaatcgccctcccccagggcggcaagggggccgcctgcaaaattccaggcctcccgccgcccatttgcaggcagccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattccatgatccccaacgtcccgagcctaacatccctatgtgattgaaaaaaatctttgtataaaaatacactatactacatgtcaattaaaaaaattagcaaacatctaaatttacctaaaatgaaaataataaataggaaactagctgatgtacagaagtaagttgcagcaagaattttgttaagatggttgaaaatattttaataaattaaatcattacatgatttttttcatgtatttttcattgcaacatgatggatacaaattaccacaaaacacatttattagagtatatatttcctgctatatattttgtttgtagaactatctactctctccatcccataataagcgtagttgtgggtttcaatgcccatctttgaccatccgtcttatttgaaatatttttatgattagtatttttattgttgttagatgataaaatatgaataatactttatgcgtgatttaacttttcaaatttttcatacatttttcaaataagacggatagtcaaatgttgggcacgaaaacttatggctacacttataatgggacggtggagtatatatttatggaacaacatattgtttttaagaataacgagcttttgtttttaacgtaatatcatcttcaggaagttaaatagtatgcctagcataatacactcaccgatcaggatagtatatactattattgtaccttgatttgttcatcggccatctttttttttcccgaaacacataaacccattaaaaattcatgcaagatttctatatgtattagccacaaactagcctgcgcgtcaatagacgtgctctttttctagtgtttttctaaagagcagttttcccgtccttaaaaagatgaggatttttacagtccatcagggagaggaggtcctaaatcctgtatgtcaatatagttagatctgatggctgatgatcctcagtaccgtgaggtattggagtacccatgcggtggtacccccgcccgcccgcatgtggtgagcaagtggaagggcaaaaatggattttcgcatcgtttccagatgcgctaagtcgctcgttcctttcctgatcccctccttggaatggcgcatcctttcctcccaagatcgccggctgcatccaagaagtcaacgacctcagccactaccacctatcgcagccgccgccccctttttctccttctcctccccctccacccttctcgtcccagtcctagatccagaggtcactagttcgattccccatcccattcttctctcttttttctcttctcccacggtggacgcttgatttttccatggtgatggaggagcatcaactctggtccatcgtacatggtgctggagatcgatccacctgaattttggcttctcttttcctcacccgatgatgctcctgtgcccaatttttttctcacacggtggtccatggcaacggaggagcaaatgctatctagttcatggcgatggagatccggtgtagattagcccacggaggagtttaggagctcgtccatggcgaaggagattcccggcctggattggcatttactcctgtgctgcacttcgcccaagctctccggtgacccccgcttccgaccgaacgagcatggtggatgagcagaggatgcgcggtttctgcctcacggggaggggaaggacctctcaaccgttgttcccatcgtacccttttagattgaagggttggattttacttggtacctggaagtaccagtacttagaggtcccagctgttggaccgtagcaaagctctaaaaagataccaggcaccaccatatctaatcaggtaccaaattaaataatatttgtccatgaagaacgatcgcgcggtcgaaaaaatttggtacctcctctcgtcaagcatggctcctactatacgcggtaatctttctgcacgtaagttgcaggggcaaaattgttttttcgcgttggttggattatttctctcacgaaggagccggccggtcccgttcctcccttttctcgcaccggatggcggccatcgccgccccatccaagatgttgccccacgccgctctccactccaccctcaccacgatgtgcaacggcccttgacggtcaatatctaccagatgttcattcccctttctcatggattatgctctggtgtttgaattctcctaaagatgaagatgaagatgaaaattaagtgttttacgcaaaacgagatgataataacgtgtgattatttgagttttaattattacaacttaaaaaagattaatctgacattttagaacaactttcatataaaaagttttcgcacgaaacacaccgtttagtagtttgaaaagcgtgccacgaaaatccaaaagtttatccgaggattcgaacggggaggcagaggtcgccgtaggccactgaggcaacggcagcctcgacgcccgaggagcatgaggcttgatctagcgtgcgctaatttgagtaggaggtcgtagcctcgacgttggacagccatcgctaggcaacagccgattgcatgttcagtggttatacatgccggttcttaattttatcttgttaaaaaatggaaaacgtctctcacatatatatatatatatacacatatatatatatatatatacacatatatatatatatacacatatatatatatatatacacatatatatatatatatatatatatatatatacacatatatatacatatatacacatatatacatatatatatatatatacatacatatatatatatatatatatatatagagagagagagtattaggaggtggagtaatgtggaccattcatcaagaggggcatggtacagaatgaaaattattataaccactggttgtggagtaattaactagtaaaatattagtattttaagtggatggattactcggctggactgaaccggtattgatcggtaggtaaaacgtaaatcgggcattgatttacgcatcgaatagatcttcacagaaaaaaggatcagaacgtcttctttcttcttctgcattggtttgttcttgttctagggtttgacctaaactcactaaaaagaaacaaagggagaaccgttggaatcattgaggattcaatataagacgagatagaccggtcaatggttaggtgaagcccatcttgtaagatctccttcacgcagttgattagttatttatgtagttcacaaattccttcgtataaggggctgaaataagatctctgttctaatagggtttgaataggtggacacaaaagaacactagtacagatcctctcatctgtgacggcccatcacatacctaggcaacgtgggtcgtcagaacgaagtcatctcaatcgggcctaaatttttgccattgtagatgtactcgtcggggtgcatattcctatagcctgtcaccgatgacactcatctgtgacgggctcgaagttaggtctgattgagatgacccccactatctcaatcgggcccaaatactgagcccgtcacagatgagtgtcatcggtgacgggctccaaagaaggcccgattgagatggccttaatgcccgtcaccgatgactcttatcagtgtcgggcttctatttatgcccgttagagattagtgtgcgcccgttagagatgatattttttttgcccgattgtgatatactttgcacactatatatattccagcagtccgttgtctgtagttatcccactgttcactatgttggtgggaggttgaagggggcaaatttttgtaatttttttgcaaacaaaaactggaaaatcataaaagtaagcaaaagggtactaatcatttcctattaatttagtagtacttatgttatgagatgttaactaatattttgttcattgtttagcgatggatcgaagttggatgtacacgactggcctgatgcgtcagtacaaggagtttagagatggcgtattaagttttatgaaagccacagtggaggataggataagaagaaacgacaagtacatgtgttgtccatgtagcgattgcaggaatgagatttggttggatgatgaaaaggaagtacacgctcacttgatacgccgaagaattgttcccgatcaagcttcctacgcgcaggctcatttcacagtgctgcaacatatggctgaagtaacccagtgaacttcagcctattatagatgagaagacaggaagagtgtacctcccaccagcttgccacacattgtcgaaggatgagaagatcgcaatgctatcatgtctggcagatattaaagttccttcgggctattgcgcaagaataagtaagtacgttaaattggaggatctaaagctggttgaaatgaagtctcacgattgccacgtgctaatcacacatatcttgctagttgctatcagaggcattctaccaccacaagtccgtcacacaatccaacggctttgtgccttcttcaatgcaatcggtcagaagattatagatccagaagacctagatgggttgcaggcagatattgtcagtaccctgtgtcacttggagatgtattttccactgttcacctagtgaagcaaacaaaaatatgtgggctagcttttatgagagaaatgtgaccattcgagaggtacatgggaattctgaagtcctacgttcggaacagagcaaaaccagaggggagcatcattgaaggttacacgaccgaggaagtcattcagttctgtatcgattacatggccgagactgatcctataagagttcttgcgtctcgccacgaaggaaggttggcaggtgtcggcacaactagcaaaccgtcattccttctctctgtggcatgccaacgtactaactttgcttcattggggttgg

SEQ ID NO: 35075 - DNA, 3401 bp, Oryza sativa
  unsure (1)..(3401): unsure at all n locations
ccctcccccgcactcttcttttgcttgtatcgagaagccttgcagacaggacaagcatctaagtctgcgtattgcttgtggtacaatatgcaattgtttggacatgcgtgaattctccggacctctaaccctaggggacatagaacctattttgcttcatatgtcgtcttggccaatgtgttctcctgaggaagcatgtccttcagtattcccaaaagttctgtaaaactcgtctgaccatccactactagccttcaacttcattaggtctaatgttgctgataatttggtggcttgcatcttgtgtatagaggagtctccgagtcattgaccaacctactgaacttcatggaatctctctcgttcatagctaggtcatcaacgtcacgcaacatgtcttgcagcatatcagggtccacatcaaccattttaccgcccaatggagatgggacaaacatgtcatgctcttcttcatctccttcttcatgattgtttgcaccacttccatctgcagctgcaccatcagtacccagatcttgctctccatgcttcacccaacatgtgtatctctccatgaatcctcctgtagaacgagacgcgcattcaacccgtcctttgttttgccaggcatattcagcaatagccccagcaagctatcgcacacattcttctctacgtgcatcagatcaatgcaatgacggacctcaagatcttgccagtaaggtagccgccaaaatatggatttttttcttccacatcctcttcttgtcctccttgctatgttttcttttcttcccaaactcattagtaatgtccttcaccatgttgtgtacctgatctccggacaaatccgcaggggcagacccaagttttttcttaccattgaaaattttcttctttcttctaaaggcgtgccgtagggggagccatctcctatgacccatgtaaaccatctttcttgatttcttcagccacctactgcgtgtatgttccatacagtcagagcatgccttccttcctttcacggtttgtccagaaagattacccagcgcaggataatcattaatggtacagaacaatagaactcgtagcgtgaagttctcctgaccatatgcatcctaagtttccacaccctctttccacagaatctcaaggtcatcgtaataggctccaagaacacatcgatatcattgccgggttgtctcggaccttggattaacaagcacaacataatatatttccttttgaagcacaaccatggtgggaggttatagttcgcaataagaactggccaagtgctgtgagaactgctcatgtctccgaaaggattcatgccatccgtacacaaacatatcctcatgtttctggggtcggcagcaaagtctttatgctttcgatcgatattcctccattgaatcgaatccgcagggtgaggagcatttagcgaaggtccgacaggacaatattggtcgatcaaatatttggatcaacagagaacatggtgctcgcttcaacaaatggttcaaggatcatgtagcacggtcgaccgatggcccaagtgagatattacaaaggttggcatggggtccatcttgggatgttaacacatggcaagggtacgatatcaatggatacatattttacaccgtcacacaagatgagaaaagcacagtgcaaaacagtggagtccgtatagttgcatatcaggatcaggctggatcaagcacatactacggccgcatatagcaaatatgggagctgaactatctgaacttcaaagtccctttgtttcgttgcagttgggtgaatatctgcacaggtgtcaaggtcgacatggaaggcttcacattagtggacctggacaacgttggatatgcagacgaaccattcgtactagcgaagcaggtcgaacatattttctacataaaagaccccgcaaacaagaagatgcatgtcgttagggatggcaagcgaagaattgtgggggtggacaacgtcgtcgatgaagaggaatacaacaagaatcttcatgtcagaccttagatcgaccttgacgatgatcccaaagacgaagtggcttacgttcattcagaccattcggaaggcatatcactgtgaatgatatatttaatttgtattggagccttaatgaatgaattgcatatgtttcatgccattccagttaaaactctttgaagaaatggatttgttaattatgtggttttaaaaaattatacttgttatttaaaactacatgtgagaaagcaaattgttaattgtatgaatttaaaaaaagtaatatgaattttaaactatatgtgagaaaggcatttgtcaattagatgattttaaaaaattaataggagttttaaactatatgtgagaaaggcatttgtcaattagatgattttaaaaaattaataggaattttaaactatatatgagaaaggcaattgtcaattatatgattttaaaaaattaataggaattttaaactatgtaaataagacatttgttaattatatgtgataaatcaaatgtaatagcaattttaaatcgggtagaagttaattataaatgatttttataacttaaaaatattttaataagtcatctatgatgggctttagtactatgcccgatagagattattccatctctatcgggcttagtgctaatgcccgtcatagatgactttcatccgtatcgggcagagtactaacgccatcacggatgagtgtcatacgcattgggcatagtagtctacccgatagagatgaggattgactagggtttacttagtgaatcctcatcccgacgccgcctctcactctctcacactctcactctctcagatccaccgccatcggcgccttcctccacacctctcagttctagatccaccaccgccttcttcttctcgacgccgccaccgccttccagttcaacatccaccgctgcctcctccctcgtcgtggatccggcatccctgaccaccgccgccgccttccggttcaagatccggccttcccgaccgccagcgccttcttcgcgcccaagaccgccggcggcgccgaccttcttttcaagtctgtgtccttcacccccaagaccgccgccgccggcttcctctccggctagtcctcaagaccgatgccgcggccatttcaccgaccgccgctggctcctcgtcctcaacgctgccgcctcgtcctccctcgaagatccggccttactgaccacggnccgctcacatcctcctctccagatctacgcccgacgggcgtcgacctcatcctagccgccgcgtcgacctcctccacgccgctggcttcctctaccgattgtcgaccaccgccgttgcggaagaccgccgtccttgaggccggggccgctcaaga

SEQ ID NO: 35076 - DNA, 2634 bp, Oryza sativa
ccgtccttgaggccggggccgctcaagatccagcctccccgacggccaccgcctccctccacgccgtccccgagcccggccccgcccaagaccggcgtccccgagccaggtgcctcccttcatgccgtccccgagcccggcgccgcccaagaccgccgtccccgagcccggcgccgcccaaaaccgccgtccccgagcccatgtcaacctcatcactgagcccgccactgtgtgaggtaggtactcctcaccgatgatgatgcataatgtgatgatttgctgtgtacatgttatatgtgatgatttgatgattcgatgataatgtttaaattcgacaatgtgatagtgcgattatttgttgattcaatgtttagatgctaatgtctacatatgatgacttgtgctagcgatgaatttttgtatggctgtgatgacttgtgcatttttatatgtgttaactagtgatgaatttttatatggctgtgatgacttgtgcatttttatatgtgttagctagtgatgaatttttatatggctgtgatgacttgtacatttttatatgtgttagctagtggtgaatttttatatggctgtgataacttgtgcatttctatatgtgttagctactgatgaatttttatatggctgtgatggatgaatttgtgaatttgggggagaatgggatgttgggaaaaatgtttagatgtgggctgtgatgatgaaatattataagctatgatggatgaatggccagtgatgattgctcaagaacatactatttttgggatgaattgttgtgggctgcttttctatggcagtttttttactgcataaggacatacacttgttcttatatagttgtttgcaaaatttttagggtattttgggtccaatgggatggatgaattgatgtgggctgtgatggttgaattattttgggggaaatgtgagttttggtatgtgacctgttgtcacacccagaaattctcgaaccagaatttttaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaagcaaaccttgacggcagtgacgaaaccaacctctctgagatagctccaactgagaagaacttcaactctggtgtgggggaaaagagagcaagactgagtactacccactgtactcagcaagtcatatcggaagaggaggtatgatgcaggatataaccaaaggaagctaggggttcttttgcataaagcaggcatttcaaagcagtagttgaaagcagtaaaactgctgtagtaattaatcaatattaaccaatcactgtccaacgctacaccacgtttcaaaaggcatgcggcggcgctagtggcgagcggcgcgtgaccggtaggaggcacaggagagcgcggtgaaaaggggaaaagggagagggagatgcggggaagctttataggggctcgagaggggcggacatggccgggaaaccccccgatttggccggcgacgtggggggagagagagagagtgggggggattcaaatcgaatcccgcccatttgcgggcgcgcgtgcgggcgggaatggcggggagggcggcgacgtgggaacgcgaagtgggggcgcggcgtggagcgaagaaggcggcggcgcggacggtttcggcgacggttgccgtcgtggggcgggtggctggaggaaggggacgacctgacaggtgggccccacctgtcagcgtcccggagagaggggaaaagggaacgggccggcccaaagaaaggaggccgagcgcgggagggtgtgggccgacggcccaatagagaaaaaaaagaaggaaaagaaaaagaaaaggaagaaaagatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaactagggatttagctctaggttaattaagataatttcttcgggcaatttatttaaccaatttttaaagcaagaaaaaggggaaacttctgggcgtgacaaacctaccccccttaaacggaatctcgacctcgagattcggaagagctggcgaagaggtgcgggtgggtggcctcttcttctgagtgatgactccactgaactttgcagaatctgattactttgtttctggtccttctctcactggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgtttgagggaaagctcaagctggtaagcaacttcacctctacgttccaagatcctgtattgtcccacaaagcgtggtgccaacttttctttgttttggaaaccgatgtactcccctga

SEQ ID NO: 35077 - DNA, 7126 bp, Oryza sativa
  unsure (1)..(7126): unsure at all n locations
nnnnnnnnnnnnnnnnnnnnnnnnnnnnnnnnnnnnnnnnnnnnnnnnnnnnnnnnnnnnnntatttattaactagggatttagctctaggttaattaagataatttcttcgggcaatttatttaaccaatttttaaagcaagaaaaaggggaaacttctgggcgtgacaaacctaccccccttaaacggaatctcgacctcgagattcggaagagctggcgaagaggtgcgggtgggtggcctcttcttctgagtgatgactccactgaactttgcagaatctgattactttgtttctggtccttctctcactggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcaattctcaatctttccctaacagctctgactttttcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtactgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcactggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctaacccaccagaacttctctttgaggtcttggtacatcttagtactaccggaaagaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctacttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtattttaacttttgtgatctgtatatacctcacaacggtaaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcatttagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaatttcataaacaccttgttcatcaaattcatgaagaaggcaggtgtattagtgagtccgaaagacataactgtgcattcgaacaacccgtaccgagtgatgaatgctgtctttggaatatcctcttcgtggatcctcaactggtgatagcctgatcgcaggtctatcttagagaacacagtagctcctttcaactgatcaaacagatcatcaatccttggcaaaggatacttgttcttgatggtgacctcattgaatgcgcggtagtcaacgcacatcctcttggttttgtctttcttctccacaaagataaccggagcaccccaaggcgacgtgctcgggtggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctttggatactctctaactatgggaatatcctccagcttcttagtggttttctccactgctacctcttgttcttcaccagcagcctggtttaaactgatccctggcttctgcggcactagagactggaaggttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggggctgactgcgcctcctctgcagatgcatgagtaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactgttgttgtgactgccactatggtggttcttgttgaagctacccgggtggtagggacggtgctgccggataatcatggtggaaggtccaccgtgatgtcccatcgtgaaacgaggcttctgactcttccctggggagtcctgaactgagctgtcttcctcttacggtttattttgttacagtgctcctcctgacggatagccttatccaccagcttctcaaagtcctcataatctctagagatcaactggttagtcaattcatcatcaagaccagacagaaacttctcacgcctcccgtcatcggtacgcacgtcctcaggggcgtagcgtgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgttgcaacacctgatggtactgttgctgcatctgttgcatcatcactgtcatcatctgagtctgattgtccaacacctgagcaattgttgggttctcgggcggtggggacggactgttgtcagatgcactgttggcacatgctccattgatcagctcttcgctgccactggcgttgttcgagtcgcgtgaaccattccttatctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaatcgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacataggcacgacctaatgcatatcacccgacaattcccgaccgactgccgaataaattccgaataaacttttactaaatccctagaatgtccctagtcgagaaatccaattaaataagcgaccaagatttttcccacaaatcgaaagaacaaaccccaaaattttcccgaaacaaattccaagtgcaaaagggcatatgtatatgaaaaaaaaaagggttcagagggctcttatgtttccagttggcttgtcctacggtcaaggtcggctctgataccaacttgtcacacccagaaattctcgaaccagaatttctaagctgaatgtgcattaaatccctgtccagggccagccagggtacacaaacgacaattgttgatatacagacccacgtcttacaaaaatataaaagattacaaatgcagtgggaaagataaaagcgagctaaaccgggaagcttgacttcagcagcgggcgactccactccacaggcaaaccttgacggcagcgaggaaaccaacctctctgagacagctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaactgctgtagtaattattcaatattaaccaatcactgtccaacgctacaccacgttgcaaaaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgaaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaagacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaataaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctaagtaataggacccatcccacatgacattgtaaaagaatgcaacatttaatagaaatgcagggtgtttgtaaattgggtacaatatgatcaaatctaaagcatgacttgccttgctctcgaactgatgagacctcagcaacgtcttcgagaaactgcggatcgacgaaacggccgaaacctacgcgacaaacaaagcacacaagcaaaacatgctataagactactgaaacaggaaacaaaaccatttttaatggattctttgcatttctcttgatttactgagacttgaatggacttaaacggagctcagatgaattacttatgaattttagaagataaactgtgtttttactaataaagaaaaagtccttaattaat

SEQ ID NO: 35078 - DNA, 24818 bp, Oryza sativa
  unsure (1)..(24818): unsure at all n locations
gttggccggagacgaaggagaatggatagctcaccggtgtgcgaggagaaccgggctccggtggggtttagcggaaaccgagcggcggccgaggtggctcacgcggcggcaatgctaatggcggcggcggctctagcggctgcggcgcacgaccggaggtggcggcatgcggcggcgctagtggcgagcggcgcgtgaccggtaggaggcacgggagagcgcggcgaaaaggggaaaagggagagggagatgcggggaagctttataggggctcgagaggggcggacatggtcgggaaaccccccgatttggccggcgacgtggggggagaggaagagagagagagagagtgggggggattcaaatcgaatcccgcccatttgcgagcgcgcgtgcgggcgggaatggtgggaagggcgacaatgtgggtacgcgaagtgggggcccggcgtggagcgaaaaagccgccggcgcgcacggtttcgncggcggttcccgtcgttgggcgggtggctgaaggaaggggacgacctgacaggtgggccccccctgtcagcgtcccggagagaggggaaaagggaacgggccggcccaaaggaaggaggccgagcgcgggagggtgtgggccgacggcccaatagagaaaaaaaaagaaggaaaagaaaaagaaaaagaagaaaggatttttcctgggatttaaaattgcactttggtgatttttaattggttaaaattatttccaaggctctgaaaattccactaaaaatcttgttaatgcattggagcatggggaactcaagaaaaattccaccatgctatttccgattattaattgcatttattaactagggatttaactctaggttaattaagataatttcttcgggcaatttatttaaccaatttttaaagcaagaaaatggggaaacttctgggcgtgacacctgtgttttttatggctgtttttttttccataaggacagaccctctacacttgttcttatggatgaattattatggctgtatcgtttttgcgtaaggacagaccctctacacttgttcttaatttcttttgggggtgggggcagttgcaaatgatggtaattgatgcataatttctgagcaaaactgagaccaaacttattttatgtcatgacttgtgtttttttaggtacaaaaataatatatatatgacttgtgtagtatgggctattttgggtgattttgagggaaatgggatggatatgcatagaaatctgttattaaatgaagttactgaaattatggcatttaggagaatacgaagtgtcccggttgccaaatctggtttggtcgggttactgcctgcacggtaccgaccaagacaaattggtaaacagaacattttgttcaaatacaacatttctagaaatctgttatcgttaccaatatcctagattgcttttaaggtcatttctttagggaaccccattcccataaattcagtatccaaagatggttgttgtatgtatgggaataagggttccctaacgaaataatcttggacgcaatctaggagtttgctgatgataacgttagggatcttggataggaagggttttggttgcctgtgtgttctatctgcgttcgccttgtcggcagatatgtagcatccatgttccttaggcggagcaaacgggatctcgacctcgacatccatatcgcacaagaacttgctaccgttgccactatcttatggtagtgacattgatagcaagttcgagtgggatattgatgtcgaggtcgagttcccggctgctccggccgtaatgaacatggatgctatggttctgtcgacgaggcaaacgcaggtaggagatagaggtatatcaaaccatcagagaatgtgtgtagatgcaattttgtgtttaaaaagtactttctccccgtacaacagtgacataggacatgtcatagcaaggcgaaccaatgtcgacgaccactactgggactacttcgagccggaatcctaggacccagaataagattcctagggaagtctacaccataaaagaggtggacgatgttggatatccgacggctccgatgaaagatgtcaaaaagttccctacgatatgcggagtcttagggaggcggaacttcactattctgaaggaccacattgatctggtccctcaagaagaaaaagaagaggcctggaggcagttcaaggaaagcttctgataccctacagaggccgaggcagggctcaagcggcaagctatccgcaagatggagaattgttggaaaaatttcaagacaacgctggtcacggagtacgtcctcaaccccgcctagccagaaccatttgggaaatacccattcatcacctgacccgtgtgggatgagttccatgcctccaaatcaacgaaagagtctcagaaaaaaaagccaggcctaccgtgatctgcaggcaaggaaccttcacccgcaccggcttggcacaagaggctacgcggggaaacaagcagaatgggacaaggaggatgaagctgcagcagaatctaacaccccacaagtgcttgctgatatcccggtccagagggcaaggaactgggcaagggcaagggtgaaaaagaatagtgacggaactctttcgttcccaattcccgaagatcaagcggtgtaccagaaaatcgtaagttgaacaaatagaataagtttcattatgttgtatcgtattctttgtctaacgcgtcctaactttaccccaggtcgaactgaatgctgagagacaggcctcccaagaggtctgctcacaaaaacgggaggatgacatcctcatgaaagcgttgggaaacgaagaacaccgtggacgaacaaggggcattggctccaatgttccatggaagtttgggtttccccaatatgcgtggcagtacaagaagcacaagctttccaaggcgcagaaagctgcacgcattaaggcccaactttgggaggagcttaaagaagagctcactgccgagctgttaggtatggaggctcggatggaggcacgcatcagggataggtcgaccgatgccactcccggtcccatagtacaagtgagccccacacagaggcgtagcagctgcgcattcaactgaggctccggcagaatagtctaaaggccccgccgcggtggaccacataacggtaaaaacaacttaataacgcatatattgtattagcaccacaatacattgcaacatatactaaggacactaatgaatctatcgcaggaacgcacatcgtgtaccctagtcgttagggtgacaccaggatttgcaattcctgtcgcagagggtcaagcattcaagcctaccccggagacccaagtgcatggggcgcagctgctagtcggcaatgccaaagttcaagtggacttagtgaagcccgattgtgttggctacactatcccacacccacctaatgacgagattctgacccttggggctgcacatgggacctttattcaatggcccaagcacatcattgagatcaatataactccaaggccagcgccaagttctcgtccgccgccgacgcgtccccatccaactgttgtatctctccattcctgccgttgaacaaagagatgaagatctccaattacagtatgatactgattttggggacgacggtatgaaggtcgacagtaggccgcacctctcccctcttgccaaaagtagcaagagggcgaaatcttctccacccaagcttgacacacgcagaaaagctgctggaacggggagaggaaaagtaaaggtgccattagccccaaagaagcttgatcttggcaaggcgccagtagctcctccaaagcttccagccgaattcacattcggcatgccattggtcggagacgatgccttattcaagatgggccctgcatgcaaggagttgcacgggtactacatggagaagtccaatgcaaggaggaagaatagagagacctacatgttgggccagcatgatggtcagccgtttctcgggcctactgccttcatcgccatagacttcaaagatctatgggacctctacagggtgcgagcgatcgacaccaacctccttaagtgctactccttgtaagtatttcttggtacacgaaatggtaatgactgtccataaattacgcttaccctgactcttgtcttgctcgtagattaacctggaagcatgtccatcataaagcaccccatattgccttacttgatccaactgtcgtcaacgagacaacgctgaaaaatgattgagcaaacatggtgggctatatcaaggactgcttatttgcccgtcaagacaaggacttcattatgtgtgcctacaatcaacagtaagcgtgtactatacttatactcaaatactcgacgcgtacaactgtagtatgtaactggcaatttaataatttcgcaggcaacattggattcttttggtaataacactgaagtggagttcagtacactaccttaactccaatatcaagccagaaatatacgattggtcggccatcgaatctgccttgaacgaggcatgggaccaatacgtggcaagaggcgggaggcataaggatgggcatcccaaactcggtcacaagaaagacttcccaatacgtcaacaagttggcgaccagtgcaggttccatgtctgtcataacatgaggagcttcgcagacaaggtgacattgctcgaccttgaggtgtgtaattcagttgtttatacacacataggacgacaaatttacaagtatgtagactaacttggcaccgaacatgcaggaatttatttcaaggattccggaaatcaacttcgaaatcattagagaggagatagcacaattcatactagatgatatcttgtcaccgaaagggatgtttagagtgaagtcctaggtagctcgtctcggaatggcagaacatttgcaatgcatatgcgacaaacatttgatttttgtaaatattctttgtaatacaattatattctttagagtaaagtcctaggtagctcgtctctgtatatacttgcatttctagttacatataaaattgttccaatttattacttagttttgcaggttttgatgcatgtcggcggtttggagagaaaaaaaggatgtgaatgacatatatatgtgaatgggttgtggatgtgaatgtatatgtgtttgattttgtgaattggctgtgctatgatggaatatgaatgtgaattggctgatgtaatgctgggaatgggtctatatgaattggctgtgatggtatatgtgaattgacgctgggaatgggactatgtatatatatatatatacatatatatatatatacatatatatatatatacatatatatatatatgcttctgtcatttttgcagcgggcatggctagcaaagtcctgaggctagccaaaaagacaaattttattttttttggttctaaactcatccctgacgggcatttagctaatgcccgaaagagataactcatccgtgacgggctatagagtcaagcccgttagagattagtcatcagtgacgggcttttagaatacacccgatagagataagtcatccgaaccgggactagtttgattcaacacgtggggtcaaacctatcggtgacgggctctggctgaatgcccgatggagatgactactcatccgtgatgggcttagtggtgtgcccgattgagattagtcattcgtgacgggctcctaactacggtggtttgactggtcatactcatctgtgacgggcttggttgtcggcccgattgagatagcatccatccgtgacgggctttagcccgattgagatattttctcacatcagtgacctttgcccactgacggggccttacccgatagtgatgaggctttcagcccgttaaagataagcgatcctgttctagtggaagtcacgtgcggtggacccgcaaggagaaaccgcaaggagaaacaggcaagagggagaagctctagcatggtcatgtgtttcggacaaaacataaatctatagaaaaccatgcaaatgaaaacttttacgctagtataacatgttctttggaataaaacataaatttagagtaacgtgtgtgttcttggaacaaatcgtaaatctagaggaaatcacacaaataagaacctcaaagaacacaacctaaatctagagaaaatcatgcaaatgagaacctaaacgtacgctagtatcaggcaaatgacttaagtggtacctatacagtaccgatttaaatttggagacaattttgccattttctctctagtagcaaatttatgttttacccttggtacctaagtacgtacactaatactaatacttaaatactgtttacatggtaccatgttactgataattaagcgttggatttttactctttggaatgcaaaaactataaaagctctcatatatatactcccttcgtttctatatatttaacgccgttgatttttttaaatatgtatatacactagaaaaaatagtacctgtgcgttacaatgggtgaagtctattttaatcttattattgttatatggtttagttaagataaaattcactatggaagttcgcttggatatatatttttttagaaaatcatgagctgcagttagctaggagtccgatcgtcccaagttagcatgtgagtttttttaaaacagatttcttatatgattccttctgtaccaaaagtgaacgatcttaaaaaccgactcaaatacagatatatatttccaaaagcaaacaaacttaaaaaccgactcatacacggatgacgtaccaaaatatcggtaaaaacaacttaaatttttgtgatagtagagatatatagaagtcattactaactcaaataaaaatatactgctatatgaattatattgttgaaaagctcccctagagcaccaaacgaagtttaatccaatcgaacgtgattgcaagcttcagtgggatcgatcgatcatgcatgacatctcgcgacatcctgctaatccctgcaatcctgttctttctcacatccacgcgtgtacgtgtttgcgggaccgccggggtggaggagctttggtgttccagggatgtcgtcgtggttcatggtcgtgtagccgatttcattgtcggcggagacgccgacatcctcgacggcggtgaggacgaggagagccaccagggacaggccgacgacgacggtcaggttcaccctagctttcgccatggcgatccgagctaatatagctagcttcacagatgatcgacgggcacctcgatcgctcgatctccttctctttctcctggtttgtgtgaatctgtgatgagttaattgttggctaaggctaactgattttatagtgtagcatatgtctaagatatgagaggattaattaatggtccaggagtgttctagctaggggtttgtattaccgcatgcattgatgatttcatggtaaaaactaacaatagcatggatcatgcagggatggatggctcattttggccaccatctaatgtatggtgtggatatatatagcttttctaaagttaggtttctgatgtgcggtgcaactgactactgtaactgttcgcttttaatttattggccgtagttttgaactaacaatccctgacagtggctttcaacggttcataaccgcctgcgaatattgtgcttataaattctatgataaaaaaaaaggctatatgtgatgagttgtgttactgcccatatggtttcatggcaagatttgtctataccgattggaagatatatataaaagaaaaaggctatatgtaccaacttttttcgtactaacactgaaacataattgactaatgcaccagaagaaatactcattacgtttcaaattacttgtcaactttgtcctaattaagtcaagtattcctaactttaactattaaattcaagaaatttatgtgtgaactatatattataaaagcatatttctcatgttgaatcttaaagcataaagcactactaaaaaaacctagataggtgttggttgggaacccaacataggtgccggttttttccaactggcacctagaaagtgatacagatgagagaaatcaaaggtgccggttttgaaaccggcacctttgtggtcccaagaataaaaaaaatcggctcgatgccaaacatgcccaattatcgagccactcgccaaacatgcccaattaatatttatgttgacgccaaatcgtgttgtcatgttatgtgcaactcgcaacggcacccggagatgcgccgccgcagggaatggtagatatatgccaccgaacgaacacccgggagggacccatcagggttaacgcgtgctagtttgtcctaggttcaactggccagttaggacatcctgtaacgccgacgagagacgacgaacaattaagaaattggagtagaatatactttgcatggcataggtagcaaggaggaggaagatatggaatacagagggtttggacaataaattttaacgattgattggtggttgtttcaatcaggcttagtcctctatatttataggagaggtgaacttgtttcccagggtcttttccacatccaatagatgttgaaaccaattagaactcaaaaatctcagacccaagaaaaaaaaacctgagatccgacaagtcgaactgctggtacgaccgcccacatgtcgccagtgaggccgccccccgcagatgaattagaccggccctatggtggcggtccgaccggcctcacgtggtaagcccgggaccttctcaaatttgaccacattttcatattattactctaggtgtgatttcgatgttaaccatacatatgcttgtacaattattcatgccggtttattaaaaaaaagaagaagaagaagcaaccaacccaaaaagcctggcaaacatatatcgtctctgtcccctctataggatagaaataatatacaatggcgacggtttcttacagcaaaacaccatatataattttgtggtatacatccatcaacagatccacattcttacaatgctttctagcaaagatcatggcaaattttgccaaagctgcaactatatatatagagagagagaaatcattactaacccacataagaatttgctgttacaatacttatattatcgaaaagctcccctatatagcaccaaacgaagtttaattccaaacgaacgtgcatcgctatagcatcagtgatcaatcgatcgatcgatcatgtcatcttgctatccctgcacgcctgctctttctcacatccacgcgtgtatttgttagcgatgtcgccggggtggttgagctgcggtgttccaggaatatggtcgcgattcatggacgagtagtcgatgacctgcgcgacgacggcgacatcctcgacggcgatgatgaggacgaggagagccaccagggacgacaggccgaggacggtcaggttcaccctagctttcgccatgtcgatcgatcgagctagagctagctagcctcacacagatgacgacgggagtagtcttctggttggtgaatctgtgatgaattgttggctatggataactgattttatagtgtagcgtgtgtcaaagatatgagaggattaatatggctgggtagagtgtgcgttctaggggtgtgtattactgcacgcgttcatgatttcatggcaaaaactaacaataggatggatcatggatatatggatggatggcttctttttggccgcatgtaatgtatggtgtgcatatatatatatatatatatatatatatatatatatatatatatatatatatatatatatatatatatatatatatatatagcttttctaaagttaggttcctgatgagatgtgcggtaaaacatgaatatcgtaactgtttctcttttagtttagtcttgaatcgtctctgatagtggcagtgttcagaaccacctgtgattgtgcttataaagtctatgataaccctttttacggttgtgttattgtctatatggtttcaagatttctgtctatactgattgcaagatcggaattgctaaaaaaatatcgcaagttttttgggaaaaaaaactttcaaatgcaactatatatagtacagttgtaatgtaactagactgtaattacactataattacattgtaactgcactataatgacattgtaatctctatattaagttagatacaaagttgcatatattactttaatacttacactggtggagaagtgctttttagtcccggttcgtaaccccccttgtagtcccggttttcaaccgggactacgaacccgggaagtcccggttcaaataaccgggactaaaaatcgatctctagtcctggttggtgttaccaaaccaactgggactaaagatatttttttctttttttttctgtttttaatattgaatattgacttcacaccatcccctcctatatccaaatcatcacatatcacagaacatctccaaatcctcaaatcctcaaacaaattatctccaaatacatcacaaactcttaaaaaaatagatcatctccaaatacatcacaaactcttaaaaaaaattacatcacagggttctaaaaaattcatcacagattcacatctcatacaaaaatacatcacagattcacatctcaaaaaaaaaagaaaaaaaatccggtcggcggccactgccgccaccccgcctcccctttgcgccggccacccgccgccgccgcctacctcgcccgcgccggccgcctgcacgcttcgcaaacttgtggggtgaaggaaaaaaaaggaaggagaggagaggagttagagataaggaaagagataagaagttagagaggaaaaaaaatgagatagagggaggagtttgttgtgtggacgggaaaagaggatcggtactagggattatatagtgtgttttgatttttattcccagttagtaacatcaaccggaactaaaaataggtttttagtcccggttggtgttactaaccgggactaaagatcctagggccctggcaaggaatcaaccggaactaaaaatgaactttagtccctgttaccaaccgggactaaagatgatttttagtcccggttggtaacaacaaccgggactaaagatcttcctcttattaaccgggactaatttttagtcccggtttttaatggaatcgggactattatggatttgggtcgaccgaccaaaaatggtttctctaccagtgttatatacaaattatattatagttacaatataattaaagtggaattatattacaattatactacacttagattttgaaagttttccgttaaaaaacttgtggcagtcttttagatagcatcttggaatatataaaaagatgagcttaatttactaatgtacaagaacaaatactccatatgttttaaattacttattgttttaactttgccttaaatcaaacattactagctttgactattaaaatctatatattcatatatatagtttgaaaacattgaagtatatatgtaattataaaaagcatttgttttgatgttaaactatattttttttaaaaaaattgatattcaaagttagaaaggccaattggctcatgtctgatatgggctgctagagacaatacaaccatgtacatcgcatatatgtgtttacttaaaagccgtgggaatggctgaggattagtgcgccacgtcagcaattttttcaaaaaaacccctgtgtttttgttaattacataccagttcccatcaacatcgtccgtttgatctcgcggcagggtcgatctaaccgtccacgtgtccgctgcggcggcccttcctcagccgtgggatcgtcgaatcgggaacgaacggcgtaaatttagtccacccacacgaaaccctagccctccctccccggcctgtctcgcccgcagccacgccgccgcctcgccctttgcacgcgccatggccgccgcatcctcgccctcctccagccatcatcgtcgcgccgctgccaccaataagggaggccgtggcatcagctagtgatggccccgcgtctgtcgcccgcggcgagacgcgctctccgctccggtcagtgcggcgccaaatccacctcggggacatcggctgtctcgctgcggtagaagaaggtggtaggaccattgggggttgaacagtgattgctaggagatcgaggaggataaggaaggagaagagcacagctcagttacggctgccacgacgatagctgctggtcggcgacaactacggcaaggccatcgcccagtgccacacgtgccgctgtacatgtcaccacgccgtcctctcttgctccactagaatctcctcatctcctctccgtcctcttcaggtgagtttgggggccactttttgcaggcttgcaaccatgcttctctcctgcctgtgctaacgggtcatggctgttgttattgatggtactgcaattttactgttgttgtattccacagatatttgatttgggcatagttactattgattacaatctcacttatgcatatttaaagtaaatcatgtactcatccattccattgaaaaatagaacttgcgctgagttggtgatctttagatattaccaatcatttgttgcagtgtgtttttttgaataaagatcttttggacttgcttgaactaatatggcatcttgcctagagcaactgctgatttttgcctcattatgaacctatcaggaatggccaattcgtcactgattattttcttgacgttcatgattcctaacactatgaatggatgagtgacaagtttgacaatgaggtatgtacctgatcctgtcattttgtctttttcttaagaaaagcagggtctacccttatgtactttttcctgcagttttgcctacattatgcatgaatctaaaaagtccacctacataattcatcaagcctacaggtgctctcctacgatatctcacaaggatttaggtatactcatatttctgctagacccaaaatctcatgaacgagtatgtatctgtgttctctatttaacaatgagcgattcattgaagctagaatgctttagatatgataatttgaatcaaggtcgctaattgtggttcaataccaaatggcaatgctggtggccttgctgtagttgtcgaattaactatgaacctatctcagcagctgccaaattcatgaataatttcccccctttttcctgtgttcatatttctatcatttacattccttttgcaggaatttatacatcctacaaaagacagaacaacatagtaggatgatatgtttgggtacggacttcaagattcacttagatttgattaaaaaatgaaaaatatttatcacatcctaccttcacagctgtttattttttctgagttaggagtatgtagtactccagataatcaaagagtccaggattattaaatatgtgcatgttgtgtttacatggcgagaaaaggctacatgaccaaaatctttgcttaattcgtgcaccacacacatgaataagtccgaatctttccactggtcatttcttttgctcacggccaatttgaagagctatgaactattcgtatttctgtcctcaaacaaatcttaatcctaatacttgaaagaaaaagagagattcaatatgtatctttacttcatgcaaaaacacattgctcctttgtattttgcatttcagaattcagttttgccttatgaatagcttttcatcctagaattaactaatcgaacaacaaattgatgttgggaagatctaactaataatcaatatctgctgcaattgtttcttaccattcctgctctgtacttgcactgatgataccatgccttcatagcatataactaagcgtgcattataccttcttatctgtttgttgtgtggattggctaagcaaacataatggagtgctattctttgtatagacatgtaatttttttctgtttgtaggtaatttttacataaatgtgttgttctgaactaataatccagtgttctgttcaggctttccccattcatttctattaagtgaactattgtatcagctctaatttcccttttatgtgcatctactgaataatgttgcagggtctagtgaaatctattcatgtattgtgacctgaaaaattaatcaaggattgctctttaccgatgaagataacatacggaaatatgccaagcttgcaaagttgatttgattgataagaaatccatgtcccattatcaatgcgttcaagagtcaagaatctgtgctggtaatgggtactacatgaacttttctgcaactacaggtttcaagcatttgctccctttctgttctatgcactttccaaatttatcaaggcaagcacatggatcatggacgttatgtactaatgtacatatttgccaaactatcgcctttctaaatatggaacttttcatgtttcagaatttaggtaagatttagggttgccacttatatttagtgatcagtacaaattcaaagttttgtcatttttctttggtgcatcataggtcaattgagattcattcttgccaagctttcatcaaaattctgacagcttgtgttttacacctacctgttttttctatgtttacttacaagcatgaatattggtagagaagaatagtactatagtttgctcatataagtaaaccaggatatgagatgatttggtgtggcctgagacaaagctgaattaatcagcaagtttttaatcaattattcttgctaaaggcactttgagaagttgttttcagtttgacaaaaataataaagaaaacaacaagaagaaaagttgtttaaagttatttaagtaaagttgtgagctattatgtgatagtgcatcaaatatttgtaagatagatgtagccggttactctgaaaagtaaaattgaatgaatcaatgcccatctttcgttttttctgttctttaatttatattttttagcgcatataatcctttatgttgtcgattgcacaatataaaataatggaactttaccaatgccctgcaggtgaaaactttacattatagttcatcattctatctgacagctaataagacttttagagctccttcaattactactcaagcttccgtgtagccatgccaataggattagcaatgaagattcccacgcatgctcacacatatgcatgggaaaactcatgtggttccgaaactaatgttgcatcatatatctcaattaaatcaagttaactgtatactgagcttgatgttgcatatgcattgtcttgaacgatttgtctattgcggatttgcggtttgccatatatgaaatggttcttgaatgcatcagaagtctctgtcttttttttcctatgcattgttaggcatcgttcgtttaggggtgataggggagattggctctcgtttttcgcgcgcacgcttttcaaattactaaacggtgcgttttttgcaaaaaatttctatgggaaagttgttttaaaaaatcatattaatccatttttaaaatttaaaatagttaatactcaattaatcatgagctaatggctcacctcgttttgcgtatcttcccaatctcctcaatccccttagtctatggacagcgctacgctgcgcgcgtttattgctagtattattaaggggcgcggattggggcgatggcggcgcgggccacgtcacctctttttcctcccgccgtccgatcaggcgtgggcggctgggattgaggcgcgcggtgtaaattttgcgaaaatcctccggtttatgcgtaattcgatttaagtcccttcggaacagtagctatgaggtgctattttacgtataggcccttacaaaatcctcatattccacgataaggagagaaaaaatcgagaataaggactgtgctgtaaacagtgaaaaccgagggactttttcgcaaaatgtcgcccactaaccccaaaccctagccgccgcccgcatcctctcctccctcccgtctcaccctctccctctccctttccttctcccggcgccgccacctccgcctcacgccgtccccgtctcctcgcgccgccgcctcctcctccgccgccaccgtcgtcatgtcctcgtctccgtctccgcctccgcctcgcgccgccgcacgccgccaccgccgcgagaggagctatcggaagcgccgccccggaggaggaggaagagaggcgagagagcggaggacggagagggatccggcaagatgggagtcctggcgttctaccggtggctggcggaccggtacccgcagacggtgtcggacgcggtggaggaggagcccgtggagctcgagcctggcgccttcgtccccgtcgacctccgccgccccaaccccaacggcctcaagttcgacaacctctacctcgacatgaacggcatcatccacccctgcttccaccccgagggccacgcacgatcctattcccccatcccctctgtcttctcgtcttctaatcaacccattctgtgttcgatctcaccatggatttggactccctctcctgcagccggcaccgaccacttacgacgaggtgttcaagtcgattacttttgcatataagtaaatctttctttgtttttaattcactggtttgattctctggtttttttttttttgggatcatgtttaggttcttgttggatttggtactgatctcgttaggtttcttggcccgttttcaggtgcggctctgaaggggaatttcgtcgaacaagatgaatgcgttgccaggaacttcaagcaggcggccaaactgctgggcctggactccaagctggagaagaacttgctcatcccattcagggagatcaaggtgatgattctagcgcagttttcttgagatatggtagtctgttttctttggcttcacttgctcgaagtagttttctgatgaacatgagagagagtgttgaaagttcttgctgcgaccaggttcaatggagtaaaggattttctttttggtttggagtgccaacaagtctgtggttgattgcaggttgaatgcacagttccgaaagatgatgggactttagcatcttacatgttgggtttagggtttaacatgacaatgttaggggacctatgaagggtggaatcagataccgccatgaggtgagaatattgattgattagtgtgttcttcgtaatacaagctggtgcctagctatgattgagtgaaaatttatattagttgaactcagttttctgggttaataatttctctggtagtacaagcattaagattcaatgaaaacatcagatgctgatcagatttcacctttggatgcaatctatttctaattttctacttctgtgttagtaaaacttatataagttatattaccatttacttgcaacaatctatcaatatcagacctgaaattgttcaagcttgtctcttcagttccagctgcacattttttttgtatgggctttactgatgatgaactccggtcacacaattgtaggatggtgaaaaaaagcctatattctgctgttagacaattcataattaggtaagggaatttggtaaagagtacaatttactctgcaagaaacatagatttatgcttgctaatcccaatagatcatcgagccatcactttcttttacagtagtaacttcgctcaagaaaatgtttgccttttaaaggaaaagggataattttgctctaccaccttgccagggccagagttgtgtgcttgtataggttaaagtcagtttcttttgcaggaaaatgctatgcctttactctctttcctaaaaaatcggttttgggttatgctgttacagtttctttccatatttctttttagatgttggggcctgtgtcccaactgcatgaagatttcatgcagaacatttaaacaagtagcaaagcttctgtctggccatttttagacaagttgatacatcaatgatataattctttctcaatattttgtggttcaggaatttgatattttaggccaccgactgggtcttcgacaccacagaggaccgcgcctgccaaggtgattatcgccttgtttaacctctcagcaaggtggattatttttaatcaatccaaacatggcattgcggtgatttctcgtgggatccatgcgccatccagattatgttgcgcagtagtagagtttgcaagaattatttatttgttaacatatacgcgccaaacaattccacccaaaagccttaatctgtgaaaagaggttgggtaatctactcaatacttaacaactaatatgctgcactgtttatgttaatctgtagcttggatgaatctgatgtaacatattctgagtgcttgggtacagtaattatcactatgtactagacaatacattttgaccatgcgaaggtatgtggaaggtgttatcgctttttttttcttataaaagatatgctggttgttagtgttgccattttgattatgactctacgttgctatttgcatatcagttatcagtggaacttttactttttaaccgttgtactgtaagccacttcaatacaggccatcatatacaactagggagcacgttttcttgtgtgctactgacaaataaaatacaaagtacatttcaatgagatttgtttacagcttataagtgatgttctttgttttacaccatttttagtcatcgtacaaaattaggctgaaattgttcttaatgctattcttttcagcacaaaagtccctgttgctactgtgcatgaagatctttcctctgtggctcctcctcctgtccattgccctcggtgttataaagttaccatttgatatttctggtctgggtaatctcctaatgtaaggtgttagtttgttctattattctattctcgattatacaagctgtggctttaaagaaatagcagtagatatgatatggaccattgaggtcacttccataaacttggatctgggtgtgcaacatttgtcagtacaccattgccctcggtgttataaagttaccatttgatatttctttgatctgatcaaacaaatcttaatccttctttcatagcaccagcactgttgcatcttttgcctaaacatattatgttattacgctgtcacactgttgcttgtcctctatgtattgtccctaacaaattttgctgtaaacatgtcctgtcaatagtcatagccatcactaacaagtgagctacgtatctatttatttcagtacaccaaattatgtgctattatgatgttgcactacaacatcacaattgcacatcctctaactctgctttaatgctctaaatatactctgttaacaaggatatccatcgctattattagctgctaatgaatgaattgtatccaggcggcgcgccccaggctctagtactccgaatttttttcatataataattaataacctcaaagttaaataaatagtaaattcgaatcagtaattagaaaaataggaaggacgttgggagcaacaacgtctcaagtggacgctggagagacgacgtcctttaatggacgctgtaggctagcacgtacatctagctgatcccagcctagcccaagaactcatgctgcaaaggcccaagtaaagttcctccaaacaaaaacgggagaaaaaaatggcttgcctcacctgcgcgtgtgcgtcgtctggagagcgctcacccttctccacttctgtcctcattcgcgcggcaagccggcggcggcgcgacgcccctctcctctgcgcccctatccgtttctgtgcatggttccagcctggtccctaggtgaatcctagcttccgattccctctgctactgccgccgcacaggtataatcgaagaccccttcccctgctgctgccgccgccgccgccgccctccaatccctttctgcaaggccttgcatctccggtgcccttgactgctcctgcccctgttgctatttgattccatattgtaatgcagaaatactagattaatattatttataaattagaatgcaacccagtctattgtgtttatcaaatacagctagataagatggccaccaatgatcggttcagtgatttgttatggatgcctcattgtcagcataaagtttccaaaatatgggatagtgtgagttgctagattttttttctacgttattcgtccattgtgtgtaaaacttcaaacagactgtatggtttgactaattgatgaaatgtatttttacagcctactaattgcattaacatacggcttcatcgtgtcggcattccttaccactcattatgtcagacagctttagagaatcttgggttctttcagattgcacggatgaaggaaatcaataatgataaatatttgatatcagcactggtggagcgctggcgacctaaaaccaacacttttcacttaccagtgggtgagatgacaattacgctacaagatgtaagttgcttatggggtttacctatccatggtagaccaattactggccaagctgatggctcatgggttgatatgattgaacggttgcttggaattcctatggaagaacaacacatgaagcagaaaaaaaggaaaaaagaggatgatatgactatggtgagttactcgcggtactccatcagcttaagcaagttgcgtgaccgctttcgtgtaatgccaaagaacgcaacagaacgtgagattaactggtatactcgagcacttgttcttgatattattgggtccatggtttttactgatacatctggagatggtgtacctgcaatgtacctccaatttatgatgaacttaagtgaacaaacagagtacaattggggggctgctgcactttccatgttatatagacagttaagcatagcatctgagaaggagagagctgaaatatctagacctttattgttactgcagttgtggtcttggtcacgtttgccacttggtcgacctgttaaggcaatgaaaatcacgaaagaaagggaagaagaagatgaacaggaggaattggactattgccttgtatttggagcaaagtggtgtctctcacatgaatttcgtgccccacataatgcgggtactatttctattttgattatatcatatgtcccaattatggttttttttcttggtgtacttgtctacttatcctatagtaatgttatgcaggtactgaatattaccgaagtcaaattaatctgattcgagaaggagtaattgtttggcagtaaccttatggatgaaatgcccatccaaatttgtaatgatcgtgcttggtggtttgctagattgcccctaattcatttctggattgtagagttccactacttagatagggtgatgcgccaatttggtcgtcgatagaacattccacctcatcctccatatggcaaggttgagcaccgcaaactatgtaaaatcaaacatggaggaaaaatgcgcagttgggagatagtacatgctaaatatatacaccaatatgacaatttggaagcagtaatggtccaagaggaccaaccttttgatccagctagcttgccagagtatagacgttgattccaacaaaatggtatgtatagtgttttttcgatgctcagtgcttgggaggtcttgaaaacccaatcccatatccccgggacatatttgaatggacaggctacatgcccagtggtccaccactagcacgaattgtaagttattttgtacaatccatagtaaacttttgctgccattttggttcaaactacaatactcttttttttttctaaatgcagagcttacatgtgataaagaatgctgcttgggggatcaaatgtgcaattactaatagctgtaagaagttaggcaagtcaatactcaagacatgcttgggtaatttgagagatctaaacctagagcctaggttgcaaaatatgctcactgatgctgggttgccaatcaatattgaagatattccgtctgatgatgatctctcagctcatgttcaccacccaagtcctccgaaagactctaattctgatatatttgatgaatgggtgtactcaggaagaggttttgaaagatatctccatgcaggtgggatagctgcaacacaagacctaggccaagtgacacggatagatgagtagagctgtaggtttgagattctttcgatgtgtgagttgctaagatagtggtccatgggttgtaatagtgaaaactacagcttgttaacaacgtgcttgttttagataaattattatactactcctaggttgcagctctaaagttcagtttgtgtcgaattctatgtagtgcatgtgagctctaaatttatgttccatgtgggtgccactatatcaactttttttactcactcactcttactattgcaggcaaatatatgtaatatatatgtaagaacagagatctagatagcccatttggatcgataaacaccaaaaccaaacatcagtgtaatttttctccataagtcgtacaaatataacatatgtgatgctgactcagttccatcaacagttattacaatatctgggcacaagatgctataaagcaaataataacaaaaaggggcacatctgatcgacaatgttgcgtccataaggctggaagttcctggtagttcccaatcagttgtatgttcagcgaaatgatgcacctatgaaataagaaacaatcaattcctgtcggtgttgcatagagcctccatgtgcaactattgtccgtgcattcagccacaattttggatttgctactggtactgtacttcacttcagcattcttttctatgtgaaactcacctatggcaattttcaggtgctcttttgaatcaaaagtcttcccccttgctagtggactatcaaattgcttcttatgcccaaagaaactctcatctgcaattgtttcctttagtacataaatatcactaaaagcctttatgggatttttgcctgttgcatgcataaatggaaatgaattgatagaatgaacaacaggctgtggttcaggatgctcatcatctgtgctatggtctgtggatccgtcagtatcatgctcgctgtcgtcatcttgttcaattctgtcctctgcaaggtccgtctcctccccaacataatcatcttctgcaattttttgttgcatctgaaatatgtgctggcattatggattccatattaccttgagaggcaacttgtgctggatggattgttctgtgctgcaaataaacatttgtgtcattcctttcagtttgtctgcttgattctgtaatttgactcaaaactacttgggctggtttacagtccacatataactcaataatatgccaacttgcgcgtgtctgtgtcttttcaaatatcatcttccatcctctttcttcataaatcggaattagttggaaataatgtggcccaggagccccgatatcaaatcgagcttggatactaatgatatagtcatcctcagtgtatccgagtcctctgaaaatttcattcttgacgtcttcaaaagtgctacggttagatgttggaaaagttattttcggaggaatagtatattccggacctgtaattccattttggatactcccatccacatatgctagaacaatgatagtcattttctatcagttactcctgcgagggaaaataataaatcagcaattttagttttacgaaatctattacttagttcataataatttacatcaattagaagctacgttgcagaaaacacttttacatctaataagttagtctaatttaagattaggaacgataagaccaagataaaaacaataatacatgcagagagggtgtgtacaacaacaatagtatattatccagatcagttagggcatgcacctgttgcctcatggtgagctgccctacggctgccactcgcacttgtagacgaacaatgcaaacagagtgttcgtgatttgtcgtgagtagtatctacgacgccacactaagacggcgagaggcggcgtgacctgacgcgacgagagcggcgcagtcgcgcggctcccgactcccagggttcaggacgtcgtgctgattgccgacgattgctgcgtgtgatgctgggccgattcacgtggtggatgctgtcaacgacaacgtccatcagtggacgtagttcctcccagcgtccatttgtggacgttgttgtctgtagcgtccttcctatttttctaattactgattcgaatttactatttatttaactttgaggttattaattattatataaaaaaattcggtctagtactagttaaaagcctgtgtgatgcagcatattttcttagaaagaaaaatacaaatttgagttgtttcagtatatatagtaattttttcttcaaagggattcagtatagtaagttgattacactcataataataaacaaaatataacttttatgattttcacaatatacatgcatggattattcacatgacctctaaactttgcactgttcaaatcattcccactatttatgggtgagcggatggttagcagtagttattagcagttatcaaatgaatgattggccaataattaccagcgcagtaactgttttttcatttcaaacaaatcaatttttataaatcatttcaaacaaatcattccggagagggaataaaaaacaagagaggagatgttttcgtggcctccgcggctccacgcaccccacccggtcagctcagctcgacttgatccatcactgcccgtttcttagaaatctggtactgataatataagtgccagttattaaaaaacatactgatgaagatttgatatgtgcg

SEQ ID NO: 35079 - DNA, 11274 bp, Oryza sativa
  unsure (1)..(11274): unsure at all n locations
nnnnnnnnnnnnnnnnnnnnnnnnnnnnnnnnnnnnnnnnnnnnnnnnnnnnnnnnnnnnnnnnnnnnnnnnagtaactgttttttcatttcaaacaaatcaatttttataaatcatttcaaacaaatcattccggagagggaataaaaaacaagagaggagatgttttcgtggcctccgcggctccacgcaccccacccggtcagctcagctcgacttgatccatcactgcccgtttcttagaaatctggtactgataatataagtgccagtttttaaaaaacatactgatgaagatttgatatgtgccgatttttttataagaaccggtaatatcggtttttgttacgaaccgataaaatatgtggttatagttatcggtttttaaattaatcctgtcaaaaggattggtttgcacggaaaacctctcatagatgccagtttaaacttaaccgacacctataagggcgttatggatgtgatgttctataccgtggacaaaagcatatggttatacacatatttatatttaggattttatatcagctctttgcatcgagatgtccttaagagaaatactaccgctacatgcatgatgctatagggtttggaacaatagccaaccagctcgcatggccagggattgaaatttcggtttgaaatttctaaaatcttagagcccccgcaagcaactatctcatccaaatattttgcacttatccaaatttgtgtgagtttggtcaaaatttattcaaattcagttaaaactataaataattttatgaaaaagtaccatgcgtgtaaatccccgctaataatcctaccgattgagggcacaattgttggtattggttacaatcacagataaatctgcaaacgtacgaataccgttgtagcacttcaccttagagtattttaaatatatcaaatcacaaaaaacgtgtatttgaaatctaggaaacaggttcatccaaggagctgaggatatatagaggggatttttatgggttaagattctgaaattagttaaggtaaaattttatctcttgcttcgggtaccggttttcccttggtctgccaagcgaatcaggtatacaactctatgatgtacccaaatgtggaggattacaaaagacagagaaatggttgtcaccacctaccgtctattctataactcgtggtgcacgcaacaaacaaaagtaaaatttaacttagacaccacgtctacattatcgattactactctagcctcgcacaaaaacatcattctttatttgtagccttagtattagtactagagaattaaatataaatattaagggatgaaccccaaatgataaaaatatatcttacttaaacaagaaaattaaatacccaaaaaatcttgaatactaaattttataaaagaaacatctgccgaggtagaagagtggagacactaccaacaactctggcacacctctagaagtccccgtctccccactctctctccttattttctaacactactagagagtagtcttgaatgaaattgagagttttccacttgttgagtgtcttcaaatgaaatgataaactccttttataagcatcctatgatggtagttaagttgttttaacacccctaaccgctattgggaagcaatgatgaagcgccacgtggaagctggtggcttggggacacatgggtggttcgcctgaatcactcccatcttctctggccaccgactttttctgtgaagctaacaggtgggattttatgatggtgcacggtggattggcatccataatgttggtttgctctgatttttggaccctccaattcgtggactcgcatttgattggccggagttgtatttcgttgcatggcgagtgtattttcatccaaaatctcttgcttacaaatatttcattatactcgtggaaaatggttagtaataaaccctaccactacgttcggtgtttcattttgtttagttttatgcagaagttgagggttagattcagcatttaaggatcgtcaacaacagtatttctttgttttttttgtctggattaatccactaattggtgccaaacaggcccaatacatatgcttgtaggagtattattcacgccagattattgaacaaaaacaagcctggcaaattcatcactccagatggatggaaaaacaacttgaatatatattatttagcttagcataacgtaattcaaatttcatcacagtgttttcattatcattgtgtaggaagctgactactgcaaaaaaaaaaagtccattggtgcccgttgggaaccggccttaggtgctagatttcccccgatggtggcatagatgtggagaatcaaaagtgtcgatttaggaaccggcatctttgaggtttcagaattgaaaaaggaggtcgcctcgaacgcatcgagccaatgctctcagaaacaacaattccataggtgaagaaatcaagaacatctacaatctagaacaaatcaagaacatctaccaggaaaaaatcaagagttcggtggtggaggcagggctagctgccagggtgggtggagcaactgttgccattgccactgccgccacgccgaggaaggggagtagccaccgtcgccaggggagcagcaggcgccacgttggggaggagggagcagcttccgatgccatcatgccgggaaggagggagctacccaccactagatgcgcgcgccagagcggccgccgccgccgtatccgcacgcgctagccaccgtcgccatatcgaggtggagagatgaagcgagaaagcgagagagaaacagagagcgagagcgagaaagacagagggggagggagtgcataaggtgggggtatggagcgacggaggtagtcggtaggattgactggctcaacttaatcggctcagtacataggtgccggtttttaattaaccaacctatagtataagggctagttttaatttagaaccaacacctatagactatagttgcttaaatgtattggttttttatttaaaacctatggaggtgagaaaaagactgtaggtgccggttttagcattttcagcacctatagtgccgatctctatgtgcctttttatagtagtggctatcgccagccacatcattatcatatatatctatctataaaataaaaaaaaaatatctctggccaaaatgttcagagttggaaataaactacatgaatggtaaaccaaattgtaactgcttgcagggtattagtttctggtaaaaccggtccttgtcgtttccgcaaacaaacttacggtcgcccttggggtgcaaaatgtcaaacccggccggacaaaatgcgcagcttctcttgtactggtcaagtggttcttctgcatgttaaagattaaaataattaataattttgaacgcacatatcagaatgaatattatgcatggatgaatggatgaagcatcaaataatagtcgagaccagtctagttaagaagaaatcaaagaaataaattaaagcaagttttcttttcaaacgaaaaggtgcagtgttactatcgatatagatggaaaaaatacaagatatattaaagctctataagactttaatcaggaaaaaagaaaagaaaaacacaaccacacactgacaaactaaagcaagttatatatctatgcttaccaatgatggtgcatgtttcaacaatggcaactggagcagggagtggatctggcagcagctgctcccagctgacaaatccgcttatagttatcaatggcttgtagtgcagttcagcgaagaagcgcttgatcttgttgctgctgcggctgcgagcccagaagttgatgtggaaccagtgctgccccttgaacaccacccttgcttgcatcaggggtttcactacatcgaactcaccaccctacaccggccgtgccaatcacgaatcatgcaacggcaaggaatcagtaattgggaaacataaggtgaattccatatttggccattaaggctgtgtttagttcgtgggctaaatttttttttaagtatacggacacacatttaaagtattaaacgtagactaataacaaaacaaattacagattccgcctgtaaactgcgagacgaatttattaagcctaattaatccgtcattagcaaatatttactgtagcaccacattgtcaaatcatggcgtaattatgctcaaaagattcgtctcgcgatttacatgcaaactgtgcaattgattttttttcgtccacatttactgctccatgcatatgtccaaacatttgacgtgacgaaaaagttaaaagtttgaagaaaaaagtttgaatttaaacaaggcctaactctgctcgaagtccgttttcaacgtaaactatatgcaaaaccggtgattttttgtcaactttggaaactggacatgacatcctaaaccaggttttatgatagttttgcttgatattatagtgatttttcagtagcatgacctttgattatgtaagtttcatggttgtgaacctaattgagtgatacatatttgcatcaacaacataggtatatataataattaataagagtatgagcaaggaaagccatcttcattttaggcaaaaccactaacaaatttgccctaaggtgttggttagctagtttaattttcaaagtttacatagaaaaataaccggtttgtagttcaaggtgaaaaatgaactttgagcaaaagtctaagaataaactttactcatttaattactactcaaattaaatgaatcgctcaaatgcacataccgggtgtctggcattgtaatggcggagagcattttggacgtgagggatcatccaagtgtcacgctctctgcatccaatacaattagagtagtttgattttgtaagttagttatatattcaacttgcgagatatacataatagccagaaaaatatacataatatacagatataattgttctgatctatcgaaaataaccattattttcagtaaatcatggtctccaaaatataatttgtaccacatctcattttatattgcaatagattagtaaaaaccttattaattatgatattataaaattattttgagacaaatctataagtgattttcatgtgtccaatattcataaaaatatattaatctctaacttttacactacaatatgttgaaaacattcgccaccaaaccaagaataatatgtccaaaatggcatgttttattttttacgagagcattattttggtgtgagtctcatcctcactaacagtaactacgtgtcgtaggaggcggtggcgtgcgaggcggacgatatggtctgagatagtacttttgaggatggagcgagtactatttatttcatattcaacttattactcttgtattttcaggcgtagagaaactaactgaatcgtaatgatggttaggaagaaacctatacgcgaatctaaccgccaaaataaaataaaataaccataaaaatgcacgaaattaatcctacacgcactgcaatcagcagcaaatctactggctagaatcactctcctttttttcaaaaaaaaaaatcctaatcgatcgggaggggaataggatttatacgtacttctcttggcggcgaatcttggtggaagacggcggaggagtgttgttgtatcgcattcgcctccacctccggtcgcggtcgtgcaggtgggtctccaggcggagctgctcgccgcggggcagctgcggcagaagctcctcgaacgccggcgacgtccatccactctcagatcccatcacccaatcctccatatatcactccaatttggtctcctctttctctctccctctccacgcacttcgattttcgtacgtggctttcccttttttatatagagaggagagcccaactgagccagacggttcggacccgtgtcaaaaacggagacgaataacgaccggcctcatgatccgaattatccgattcggatacatgctccgtatccgatggagcagttgctcatctgcagcggccgaataaaaaagacctatcgcggtccaccagatactcccgtaaacccaaaagctagatattactcaccctagttagggtcggagctataacgaaacagagaatggtgccacttgcttaatttactctactttagatcgagtttaagctgatacggttgcctaagtttgtattgaggggtgcatacatggtgaaaatagaagaggtatagctaaaaaaaatttcttgaccgggttactgggcacccccttaatatatactagctccgcccctgaccctagtaccggacaaattactctcttcaacccaattcaaagcggttttatccaatgtggcatacacgtggcaacccagtcagcattttcctttaaaataattggtgggacccatgtgacatacctcctcttcacctcttcctaatctctctcaggcgcaggtgtgtacggcggtgtgcggggtggggtgggtagtgcgcggcgacgcgagacgaggacggggaatcggtaagtgggctccgcgcagggaagggaaaggaggcggccgccgtagcaacagctagagagcgagctctgcaccggcgtgtccgatttcttcagcgccggcgtgtccaagatccgcgccgccgccaccaccagagctggccgagtgctacccggcatgtaatacaccgcgtcctcatcagacgacccttgcgtcagcgcaaacgcccctcaccgcagcggtgggagcggaccttgcggtacgggcagaccaccgttgagcagcctaccacgtcagtttgcatccctgctattgcgccagctctagcatgcgcgtggcctggcggcggcagggtggcgcgccagccggctcgtgaggaggaacgcgaccacaatggcgagtagcgcgaggaccgcggcgacggcaacggaggcgaccacgatggcagccttgggcatgccaccgcttcctccacacgacgcctgcgggtccggcctgctacgcgacgacaacacgtcagcggcgatcgtgttcggcagcggcgcggggagaagccttgggctgctgttgtccacgagggtggcggtggcgggtgttggggggtcggaggagaagtccgaggacggtgacggtgtccactcgatggggaagagcggctcatgaagcacctggcgcacgtcgtcagcgccgacggtagccactaccgagaggaagaggaggagagtgagtgagggcgacattgatgatgaggagagagagaatgtgtgtgatcttggattgtagagagagaaatataggtgtgtcccaccaatttttttaaaagaaatgctgacaggattgccatgcgtatgccacataggacaaaaccgctctagattaggagaggggggtaattcgtccagtattgaaagttcagggtgagtaatctctggttttcgggttcaagggggtaattcggtcgaccgcgatagttcggggggtaattcgtactttttccttttaaaaaagaaagtattatgcaacccctcctgctactgaggtagtccaaaagggattgcatagttctacaaaagtggagacacaagatatagggggaggcactcttttcattgattaagcacaagtgtacaaagtgagcagcctcctctttatatagccatattgcatatatggaatgtttaggtgtgggcccaattagtgtatatgggttgggccttcatggacccaaccccataggtttcctaacactcccccttggcactcaccgcgtgatgtctatgcctcatcaaaacttcagaaaaatccagtgggaaaaatttagagaaagagtacatagcatacgcttgcaatgtcacacgaatcgcctcgttaaaaaccttgataagaaactgctgggaaaacttatctaagagaaaagagtacaattcacctaattcttcgttcaatctttctagattgattttgggtacttgattttctatatcaagaatctagaatgagtcagcgaaattctcccccttaattttacatttttctaagtctcattatttcgattcctcggacacacctattcaaaagaagatgtcaataatgagttagtaaaaaaatatgcaagatttccacataacttagttggttgcttctatacaattcatgtatatagaaaagcttggagttcatgtgattaatgagctttgcttcgcaagttattcatttgcatatgcgcgacatatgctgctttaatttcatatatgatgggggttgagatagttttcaaaccactattgttgaagcaggacaaccatctctcaaaaccatgtcgaggctctgaatagttcaaccatacttagttcggtttagttcaattagcgaagtattcgtgtgctgctatgacactcttgtgtttgtgtttgggaattccgtcccattttggcgataattgacttcttcaaaaaccatgcaccttgaacattttctaagtgtggttggactgatgtactagacttccatctatcgcatgcctttagctgtaagcataagcatgatctggattcgtctgaatatttcaaatcaaactcaaattcaaaacaaacaagtttgtttcttcaattctttctacattaccctattcatcctatgttagttcaagacttagtacttcttcatgtactgttatgcaagtgttcgattcaagttcctaaaatgtattaattgattatatcttcaatgcttatcaacattcaggttgagttcttcttttcaacttctagttcattaattccattcaactcctggttgactgccaatgagttttgttgtctaaaaagacattgcccataataggtctcattgccaacttctattggttatatgagactctatgcgagtatccatggatatacaaggagatgcatttttcatatgcttcttctttctgcttaatgctttttgatgtgggcatgtactagcgttagtgtgcactccaactactggttttcttccttgatgggaagatgtggcacgcctgttctgaggtttcgtagcatttgccaggtgtcaacttgcctccacgatctacactccactactgcactaccacagcgagagcaatgaacgagtggaaggccactaggacctatagcaaaccgagcagttgcaccaacgaatgggattcaatgtcacgcccagaaattcccgaatagaattccaagcagaatgtgcatcaaaacccccgtccaggaccggccggggtacacaaacgacaaagttgacatacagatccacgtcttacaaacattataaaaggtcttacataaatgcagcggaaaattaaaagataaatggagctaagccttgacttgaactgcagcgggaacaacactccacaggcatcctcgacggctcggacgaagcctactcctcggagaagccaccatctgacacctactcaaactctgggttttggggaaaaatagagcaagactgagtacaaccaccgtactcagcaaatcatatcggaacaagaggtatgatgcaggatattaccaaaggatagctagagaggttcttttgcataaagcgagcatttataaacagtagttgaaagcagtaaaacagatgtaataattaatcaatattaaccatccactgtccaacgctacaccacgttgcaacaggcccaaccatccacctgaactaatcaattccataagactaagctagggtgagactaatcacggtgaatttggttgaccgcccataaccgcgggcacggctattcgaatagttttactctgatcagaggtgtacaactgtacccacaagacacagccccacgacacgttcccgtgtgccaacatgccaccatgacatatcagatagaggccgtgacagaacttttcgcataaccccctctaaccaagcacaccacacctcaggtttcacccccactcctcgcaaggcaacgggcagtcccctctcgtgcctaggtgaatccggaagccgcataggccgtcgcagggcccatccaaactccatcactcccacccttgcctggatgcgtcagctagaggaaagctacactacacgcccagccgttgcccacgctggcttgtggcaagtacgaggaattcttccagggtttcccgcgaaccggtccttaagtgccatgggcgcgaccatcaaaaccatgcacccacatcccatcatatggtatattttaattgactaacaccagaacagtagctttaatccaacaccaacactagaacctgatgtctaagcattaatgtgatttcccccattgtgtgctagttgaactaagcaaggctaagcaatccctagtccaatccctagtcatgttatatcccaagctaacaaaggagcatggtaccaaaaatagcatggctgtaacagtaggtaaacatcccatagtaacattataaaacaatgcagtatttaagggaaaacggtagagcatttgcaatataggatcaatatgttcaagtgacaagtatgacttgccttgctctgctgctggaggaacctcggcgactatttcaaagtacaccggagcgtcgggagagccggaatctaagcgacatacaaagcaaacaatacaaacatgctataagactactgaaacagagaacaaaaccatttttaatggattctatgcatttttcttgatttactgagacttgaatgggcttaaacggagctcggatgaattagatatgaattttagaagattcactgtgtttttactctaaacagaaaaatccttaattgatttattgcgcaataattaaaatcccgagagagagagggcggcgccgacatgcgggccccacatggcagtgactcgagggggcggtccatggtggaccaggtccacggaccggggaaggagcggcgaaccacgtggtgcacacgtggcgccgacgcggcgcacacgtggctgccacgtggcagccacgcgggtggtggggttggacgacggtgaaagtgcgtggcctgcgcgcacgggcggctcaagccggcccggcggccatggcgcacggcggcgtggctcgacgcagcggcagcacaagtcggtgaccggcggcgaccggccggcggcgaagggcggcggcatcgcggcgacgcggacggcgacagcgtcggctaagcggctcggcggacacgcggcaactaagcggctcgggagagagggaggaaggggaggaggggcctcaccgtcgacgattgacgacggcgagcgacggagggcgatggcgaca

SEQ ID NO: 35080 - DNA, 40573 bp, Oryza sativa
  unsure (1)..(40573): unsure at all n locations
cgtggggtggtgcaggagagagggcgtggccggcgggattcaaaattgaatcccggccgtttcagagtgggcgcgggcgggagagagagagggagtgggcgcggggtcgcggggaaagcgggcgcgggtggagacgtgggcaacgtggcccgtaaagcgtgggcgcgagggggcggaagaggttgcgggatgcgcggcgtcgtctggaggttgggggaggactcaacaggtgggccccacctgtcgacaaccccgggagagaggagggggctcgggcggccggctaggccgtggccttcggccggcccagcggggagggggaggaggaagagaatgggccggcggcccattcgaaaaagaaaaaaggggaaaaaggaaaagaaaaaggaggaaatgaattttcttgagattaaatattgcttgtgcttatttttaattggtttaaattatttctagagctctaaaaattccactaaaaatcttgttaggatatttcgacatgtagaactcaagaaaaattccacatgccaattccgattattatttgcattaatttattagggtttctctcttgcttttacaccgatattttctctaggtgatttataaattcaatttaggcttgagaaagaacttcagggtgtgacattcagccatgcgggtgggaggaggaaatgaaagggtgactacgacggcaacgacaacgcctccataactccagccacacgaatctacaatggtgcctaagcaaagcggcagcccttgtcaacgagaactacgacgcggcgaggatgaatggctacaccagctcgactttgttcaaccaaccgtatgggtattttggtcagatcagctatgaaaaaaaaggagaaaatcccattaaatggtaaatatggcatggtagcgggttgacaacgctacggagtctctttttaacaaaacgatttggtggagtagcattctagcgaaacccttttttaggagtggcgcaatatctaatttctcgttactgcatgtaattgtataggttccatgttttgtttattcaaggaattacaagaaatggagtatcagcttatgaatagctaaaaaatgtcaatgtgcatgcagcaccttagcgttttatatttatattggcaaaaatagtgcaccttagcgttttatatttatattggcaaaaatagataatagacaagaaagcttaaatacacaacatgcatggagagccaactgaaagtcaaaactaaaaacggagagccaactgaaagtcagaactaaaaatttaacaaatctaaaggttgttcggttggctgccgaaggtgcaacgctttattttgccacaagacatacacaagtgtggcaacatgtggctagaaactttagggcgaaaccaaaccaagttgaagtgtggcaaactttgtactactatttggtaaggtgaagtgtgacaaatttagtaggctccatagaggttcaaaaatcaactgaaacacaacttttttatcatacaaactacttatgtatccgcctaacaaccactaataggatacactggcaaaggacttttttatcatacaaactacttatttatctgcctaacaaccactaataggatacactggcaaaggattaagttgatccagatccagagggagaggatctaccctcagtacacacactttctccagctcctcaaatccgatccacctacttggcccagtctgcgcatggttatcccatataagaatctgtagctcccctccacgatgtctgtaaccataacagacaataacgtggttaccatttgtctcactgatcaaatcacagatatcattgtccgtggcccttcccgcaacaagagcgtcaatcagccagacgtctgcagcagttctcaactcagggggtacccacctatagactagttcatcattaactgaggcatcaataaagtggtataggagggacacccgaatgattccaatgtaagggccacccgtgcgcaggaggtgcacagcgcgctctcgtgtgagactacctttttggcggtacatccgccacgatttgagcgggaggagaaagggggctggtggtggagcattggttgtgcgaataccacccatgccctttatctttttcagtaaaagaaccattttctttgattcgactccctcctctgggtgcaaaatatcatcccgtatgcaggccctgcggagcttgcgaggagctgcagcccggcacaggaaggtaccaggaccgtgcagccgctcccactccaaacgatgtagcgcttcaatgcatacagcacatgctaaaatggtgcaggtatctgcaggtaaaacacaaacacaaggcatggttaattaatctcttggcctactttacgaagtgagaaatcaattctggttagtactcacttggtattgtttgtttcatgggattacccattatggaccaccaactgaagtccgcggagaagttacgaaccacagagctcactacagtataggtgctttcttgagcatcagcactaagatccttgtgtccctcacatcttgcaccaatctgacaaaaaaagagtgaaattagtgtatgcaactagaatccatagttaaacttactattttatagtatccataaaagagatttagtcgtacaagacctcgtgtatatcatgccttttttttactagggatgtaccagaaaaatgaacatatccactggttgcgttctgaaatacacatccaaatattcacaattttttaaatcatacactttcatttttataatgagtcaatcagtcaaacctggtagtgtacataaggttgcaactgaagaaatactaagaccaagcattccagaaaacaagaaaaaaaaatgtaacagaggctgaatctttcaacctaacagtgatctaagtgatttactagtggccaattaattccacattgccaaattccatgtacacatttatattaacttcatctgtaacaccatttaacaagactaaaagctcaatcatttgaatgtaaaatttcttatgttgtgatataaacaaataatctcccatgcttttacagttcaacgaaaatgcatcacagtaaacggcaaaccggcttagcgcaatcaagagcaactaaatctcaaatgtttcaacaaagcacaagatatagttgttgcatgtatcaaagtttcgtagcacgtgtttaatacagtcaaaacaaaaggccgatttccacccccaaacatttttcttaagtaatttcgactctactctggatacctaatcatttaaaccaagaaaatctctggattacagcaaatccacaggattgatagaaatgaatgacaccaaaggttccagttccaaattacaacaaaccacgttgacacaagaaccgcatgtaagcaacgtaataatcccaacatttcacccaaacgctaggatcccaaatgccacattcccaacaaaaaaattgacacaggaatgcccagcgtaaactagaaaattgagtaaacttcagcttactttttctggaaatattccaggtgtgcacgaaatctcaagaatagatggcttcaggacttcttgatttcttatcacaaaatatgacagcaataatagcatgaccatgagcatgtacatgtgtatccccaaattacacaggcagccgaattacactaaatgagatatggtttcacctcaacaaacagaaatcaagaaatccaatatcctaatttaacattgcagcaaacatgaaacgcacatgaatcaagaattaaacatatcatcattagacccccaccccacccaagaaaagcaagaagtgaaaaattacctctagaaggtgtgaattgctgagaagagcaaatcttggccactcgcggacttctctctcgtcctgatccaccaccgccgcagcagaggcggaggtcgatgcctcggtgccgcgccctcctgctcctggtcctagctcctcaccgctcagcctctcgaagggcggcgaggacgagctggcggcaccctcgcttgccgcgcacaccttcctctttcccttccggtcgaccaccgggaaggcagcagaggccaatccctcggcgccgcggcctccgcctccggggtggtcgcgggccagcttctcgccgaggcgccgcggcgacgaggaggcatggccgccgccctgagttgccgtggaggtcttctttccctcccggtcacccaccgccaccggggaggcagaggccgaaccctcggcaccgcggccgctgccccgacctccgggctgctcacgggcagactcttggcgacgcgcggtggcggcggcggtcgcgagggcgcgttggcggcggcggcggcgctgggcttatggtgggccgcctcgtagtccccgcgcccaagaacccgttcggtggtgtgcccgtcccggtcttttgctgaaccgggcgccattgaggcgggaagattgaaagaaacggaaagcgggggctaggtcaaaattcttgagaagttgagggagtgaaggagaaaatgcgttcagaggcaagggtatcgatgtgaattatgaatttataggatgtagtagtactaaagagactactaatcaggttattgagtaacgagtaaaataataataataataatagaaaaatctgatcatattaaaaaagtgaggaaaaattagttttgcacaagccacgttatgaaatatagtaccattttctaaaaacaattccatccatattaccccgaatatttttcagcgaaaccgttttgaaaccgttttaaggccacggtgcaccataatgatatgcattttcaccttgtcgtgctataccaatgccaaatgagagtatgagaatgttcgtttttgttccttttagaaaatggaattgtgactcaagcaaatctttttggcatataaggaccaaaattgcttgtttgtccatgtttttcatgtatgcaatttatatttgattaatcatcaagttgagtcatatttagactaaattatacttccaactttggtcatataactactgaatattttgcagtggatttcggtgatgacagaaatttcaaaaaagaaagaccgagaccaaattgatcagtctcaccaaatgcccacccctactcctacatatctgaactaaattagcgtgacaattgatcgggtcgagcagcagatatgtggaactgctttgtataacaatttgtactaaacgtgcatttaccagaaatgatatgaccagatattctgcaaccttgtacggagagtggcacgtatgtctcactacaggaatatatgctgttacacgacgaatcaagaaataaagaaacctatggaacccagtaataatggtcgaaagaattgcatgccctgccctttactcctataataactgaactgaaatggctacccagtagtctcctgatggacaacttctggaaaccgtaacatcagctccaccaatcttattgtgctacagcaaagttacttttttttaccagtgtaagtcacaactgaacacagaagtccgaataccagcaattgcaattttaacgtaaaggaggcacgaggataggtcacaagaaaggcaaaggataaaagttacaagcgttgtatgatactatgatcactattttatcttccatccgacaacataacactcacgatccacagcatgcagatttctgcaaagttgtggcctcagcatcaccctctggtttgttgatcttgatcgtgcgatcctgaaaatcgagcatgttaaataaccttcaagtatcatgttgctaattttgaagggaagagaagatggagatttatacctcagtcttggaatcagtctccgcaagtctttgcttaatatcccttgctattgaaaagaaaacctgctcgacattcaggtttgtctttgcactctgtagccaacaaacaaattatgcacgtgtaattatatgagaaaccgtgcattgcacaactggttacatattattaagacagaagcgcagatattaaaacagattaacaactaaccgtttcaaagaacttgatgccatattcatcagcaagtgcttgcccctttgaagttggtacggcctgtgttaatataatacaaccaattaaaaattaagccaaaaggtgtccaaaataataatttgaagactggagtaatccccaagataacgctatataccatagcaccagaaagatagctttcatacattgagaatggaacaacaaaataccaaacatttaattgcttttattttttgcattgagctttttcacgtcttgattttaattgctattctgcattttagttctataaattattgctactcatcatatatatcattgtgttaaaacagcattatatgcttgtatggaacacatactttgatagtctgtactttcttgcaaaggttatatgagaaatagttactgagcagaacatacccttttgctttcatccatgtcagctttgttgcctaccaaaatcttgttcacattatcggaagcatgttgctctatgttcctaatccagtttcttatatctgtcaataacaccaccaagatcagaagtggaaggtgaagtgccataacagaagattagcagaagtgaaagagtcggtactattaaatgatgactcgtcggtgacatcataaacaagcaaaatacccattgctcccctgtagtaggctgcattgcacaaagtattcagatgaacagcagtatatccatgtaattgttcaaaacaaacttgacttcaactgaaaataaacaaccataccagttgtaatagttcggaaacgttcttgaccagctgtatcccagatttgaagtttaatccgtttaccatccagttcgattgttcttattttgaaatcaatcctttttcaagaattaaaaataaaaaagtttttagatgcactgcaataacttgtacaacaataatccagtcaaaagcttcttttctaacttgtacagcacttacccgatggtggtaataaaactggtggtgaaggaaccatcagagaaccgtaggaggagacaacttttcccaacacctatacaaggatttttttttaaaaaaaaaagaaagtcaggtgcattatcagacatatgattagtcctacaggttatagtatgtttacaacaagcacgatagcgagtccatgaaaaacaacttgatgaagataaagtggaaatgtaaaacggataccaatatacgatcaagtcatacattcaacaaacatatatcatttcacattttccactagaacatctacacaacacttaagctagccagcttggcttcttctcaataattaaaatttagtaaccgtctaaatacaaagatagatctggttttaatgataatatggatatcatatcatatcataccctgtggtaagcaaactgttattttaggcaaagaagatcaaaagaagtgcaaatcaaaaaaaaaatattgcacttcttttttgttacaaacgaccatagaattgttactgactgaaaaagcagcacccaaaaagtacaaaataaattatcaaggacaatggaactagagagaagaagtaagcacttctgtgtttctttttattggcttcccagttcccagaaaactcaattaagtaacattcattgagaaaccagtatatgtatttttcccataattttaatgatggtgtagccacaacgtatggcatatgctactgaatgagatcagcattttacttcatacactaaatgcgcttgtagtttgactaattgttggtcaaaacctacaaattttgactttctggaattaaaatgtccccgataaaaatcacagaaggagtagctagatgatatatcagtgtgacattaactagctaagtcaagacagaagacatactactaagtagtttgagatccgtgttgcagaactgtattaaggaagagagttgaaaaatgcttatcagctcacaagtcgacatacaagggatcatgagtttctttactcactttgattcaactgagtagacgtgacagagctattaatgcattcagagtttgcttaatcaaggataaggaacgaaaggaagcttaaacattcacaatgttttcacatcgcaagttcgcaacaaacaataacagtcatagaaaggtttatacataaattttgagtagtcttactgcagtgatgtctattggtaagataaccgcatgtatattgtgcattttcatgagcaattgaacattgataataaaaaatttcaaagtaacaaacagaaaaggaaaaaaaaaaagctcttgtacagtcaacattcacaattcctgtgcttgaagcaactttgggtcttcagcatagctcctgagtggaacatatgcaacttgtcggtgcatgcacgaaatcactccaggctcatcttgcaccaaaacgtcgaaaatgtacggtaatccgattcaccgaatcgggtagctgttccacgcgagcttgagcgcaaagcaccatgtcggctgatcaaaccggcctcagcgatccaccccgacccagatccccccacccccaaactcacctcacaccaacaatcccaccgaatcggaactcaaattcgcaggtgaaacccaaccagatctcgcgcgcgctgcgcgggatcgatcgccgagcgcgcggcgaggggagagcgagcgggatggcgcagattcagctacgtaccgctgtcgccgatgaggagcagcttgatgaggtaatcgtagtcggcccgagccctcgccggcggcgccgccatcgattcccccaatccccacactagagcgtcccctccccctcaacggatcgaactgggctggcggactggcgcgcgggaggcgaaccggatcgagcgatctcgctacaggcgaaggcggcggcggcggcggcgggttccggcctctcctcctccggtcgccgagccctcgacgctggctgcggcggcgaggggacacggacgcggcgagatcggagggagggggagagagagagagagaaggggaaggaaggaaggaaggagggtggtggtggtggaaccggtccaccgtggacttttaaatcggatggattttcacttatacacgcggacgcgggtgagaaatgaaatctctctccagtttgttggtttgatggagcatggatttatttatacgaggtttgaaatttttgaatttttttagaaataatactatttaatagaaaattgtaaaaatatagatcgaccgactaaaaccatattgttcgataagtacctgtcaaactacggttgttcgtaggtgttacgtgctaaaaaataaaatttaaaagctcatggtgcagtgcacagtctgccattgcagttgggtgttgggtgggaggacctattgaacaaccttgcctcctgcatggatgttctcttttcatatatttttattttttaaaaaatacactaacaaccatatcgaacaaactgatgtggtacattcagtactaatcgtattaaaattgttcgatatgtactctgctgaactttggttgttcaacagggtaataaactcgtgattttagttgagagacctctattttcacgattctttattaaaataatattatttctaaaaaaatccaaaagttttgaactgctgaatcggggatttgcacacggtttgaaattccggactataccctatgaaatcatcaatatgattatatgaatatgaaaaatatatggagtggaaagatgttttcttcaagtgaaatttatatgaaaattcttataataccatatccgcgagtagttcaaatgcccaaacatgaagaagcactagaggtttaattcgtagtgctcgtaaatattatgcacggctcccattacccgtaaatattatgcacggatgaaatcaataggaattagttaggtcaaagattttcatctcttctagaatgcgctagaaggtgcgaaacccagtgggttagatgggttagatcccttgtgtaggtgatgtatccgtcaatagcaagacatccgtaactgttgtaggttcgttaatattaagatatactccctccattccttaatatagggcgcaactgcttcaaaccctaataccaaggaggcttaactgttttctcgaggtgacgacgtatgcaacgcttcgatctgcccgtgtgcagcatgcatgcagctcttcgcatctgcaagagataagcaacccaagaaacgaagcgctaactccacgcattgaaagcgcaccaagtttcatgcttttgttttaatgctgcttgctgcatgtgcatgcacgccctatattctggtgcacttcaaaaaccagttacgtcctatattatggaacggagggagtattgtttagtatgtgctcatgtatcgtgtatgtgcaggtaccgtgtttcaaaaagaaagaatgggctaggaggtatttttataaggtgcttccatggagcaaagtttctatttatttttataaggtatcttgtgatttttttttaaaaaaagggttttactattttagttatgacgaatatttgggctcctattttttttatttttctttgttaggatctttcatcgagattcgtgttcatgtagatctaacttgtagttacactcaatcatagcgcacttagggtatccacaatgtagtgtaaaagtagtccataagcaatagaatattccattcagccacctattaccattgtgcaactagtccatatagaaaaaatagcaaaagatacccatatggaataaattatattatctatctctactcctctctcttctcctaatgataccttgtatctagatattgccatagggataaactatttatgtggtcccatctatatggatcactgtcatatatattggtgatgcccttatacttggttatggagcacttatacttcataacagagcacctaaaaattagattttataactttgtttatctagatttacaatttttgacatgattattctttttttatttcattcaaaacgggatatatgtattggttgaaatttctacaatatctaaggcagtgtttggcaaatgggaaagggaaatgatttcccacccatctttaaatcctaaccatttattctccatgatccatttaatcctaactcttcattaatttcccaatcccaatcccaccccccatttcccattatccaaacacaccctaaaactccaaatctattgaaagataaatagattgtcctcaaactttgtgaattacgaccaacaaggcaacaattagatttcaaagtgttttcatatatttatacaaccatcacaaatatgttttaagagaaataatcggtcaaagcttacgaagaagacagttttaagttaaaataagtttgataaaaaatcagcagatagtgatttacacaaggaacagaaatgatatgcaggagtaatagggagaagtcatctggcacaacaatttagagaaaagaagggtcgttttggctaatggctgctgcaatacaaagaggcaaagcgagaagattaaaaaaacaatcgggcaggccacaaaaatttgaaaaaaattagcataaactttccatttgcctacaattggcaatcaaacaaaaaagaagtgctcaactagacatccggtaaattatccgcaaaactgttacatcggtagaatctcacagctaaccaagatcatagttcaacagttgtcgagaaatagaaacttcctatgaaacttctgaagagattacattttctgtatcatgtcagagatatacttcacaatccaagggtgatgcaagaaaaaactttgcaatctatcagtcgtctctctttggcttacgatatgtttcctcaatatgcttggctaggaacatgtacgtgttgaatagcttcttgacatttgggacgtcataattctgagctacatagacaccacatcccattccaaacattaatgtgaagctggtcctgaagaaacccattgcaacaaaacctggcaagtagcaacaagcatgaattggtactatcatccaagatacagatttaatgcacccaacaagcatgaattgattgtgagatcagaataaaaactgatagcattattatatttgttgccagaatatttttctccaaatcatattaatgcaagttgtgtaagctaaacaaactcatggcataataacatatttaagcataataaaattaagtaacaccagtttagcatcaagaagacctgaaacaattccaacaggcgataagtttcttagcatctacagaaacatatttatacaatctgtgaaagctaaaaacacaccacagtataccccatccaagcataagagtagcactgatttagcttttcaactagacttgaaacattccctacaggcactaaattcactagtattgtggactgtggagtaatgctgatattgtatcaattatgcttcatgggcaagccaagatcaggcatgcttcatgggcatcccagctgggcagatgcaatgggcacaatctgtcaggcacactgttaatcatacccagaaaaaattgagctcagtttctctaaataattcataacgacctgaatcccaacagggtttaggaaaccatttacaacatatagtacatacataccgaatggttatagtgtaattcaagtaaatcgtgacaagattctgggcgctggaatacaaataataaatcatgtttttggcatttgaacttgcaaatatgaaatggttctggaagttcttgtcaattaacataagattctgggctcagtcctacagaattttttatgaaggaaaaataaaatccttttcctagttaaggcttacagcacagggaagcacatttggattgttgggcctatagtagtatggaacacaaggaattcattatggtttcttttatcaggaaattcatacatatttcataggaaataacttattttatgcagaaataggtaaaaagaaaattaagtctccagggttcaccgaaataaccatatcagtcagtcccaggacataataaaaaaaatggaagcataggcctcaatgctataagaaaccagcacaccgccactccaccagcattgagaggcaaagttgggaatcccacagccaaatcgggcaacaacaacaaaaaaaggtgaagtgcagatcgataggttttgttaaagcatagaagaacgacagatcctttgccaagtattttcttgcctattggatttagaggcccttctgctcaggtattgtgatggacacttgggcatgaacttcatatgaaatagtgaatactttctctgtgcatggcattgaccagaaaaagcagagcatcacacacaaccaaaatatatagaaccaatctagaacatattgctgagaaccaattttagatcccctaaatatcatagccatccatgggtcaagaaaaagcaatcacccagagctgcggtgaaaacgcagccaaatcaatccactgataaggatggcaaaatctactcaatgatctacaatccggtgcttgaatcgtgcaaatcggattgcaatgcagtctgcgtggctcacagcacacacagcgattcacacccnccccccnnnnnnnnnnnnnnnttnnnccaatcccttnncttttaacccaacttttttttctttttagaaacttcacgacttgctactagtccactacaaggtgaaggttaaaccttcataaaaacagctcgataaactttgccttgattcaaccgctcgcaactatcctagggttttggttcaatcaaacaacgtggggagagagatcgttactcacttggaatccgccgccgccgacgccgccgctcctgctcaggctgctggttcacctcccctccctccgccgccgccgttgatatttcctctcgccgcgattccccaaccctagaatctggagacttctctctgctggtttttttctgggttctctcgttgaagcagatttttttttaatttatttttatttcgggtctcgcacacactcgcctcgctttcgccccgatccgttccgttcgaaccgaactcgtaaaacggaggtcagagggatcgggtgagaagtggaaaccggatcgtaaaacagtattcctccaacacgaataggtgtgcagaatcttttttacttttaaaactttatattagaaaaaaaaaatagtagagaacctctttttgatggtcaaatatttccgttgcaccgcggcactgcattgtcttgccatgctaccatggttgacgttgtaaacttatagaaacaaacttaaataaaataaaccgatatataacctttagtacaaacgcgagataagtattgggctaaaattccctttatatgaaggtttgcacttaaccgttaaggaacttaaaatatgaaataggaaaaacactagagggtgaggagagtggagaagaagagaagtatgtctagcctgatggctcttacctaatcctcttcaaattatcaattggaaactcaagcatgattggagtaaaggtttatcaaacttcgtgagttcattgagaagagtattatatttgagtaaaggtttatcgacttaggtctacatattttagtacctatcctattttatacaatgtgagtttatgaggtcaaacaatatctaactgggttaactttttgatagcttgaaaagaaattcatagacgatcatttttgccaagtttcgtgaagaacaaccaagaacccataagacctctttggcacatctccgaattcaaaatttgttggacctgcctatttaaaccacataatttaatatataaaatttaaatctatcgtggatttaagataagaagctgtattaaataggacctaagatagagtacatgaaattaatgttacaggtatattcttgaaaacaaacggttaatctctcgggatgattttttgaaactaatctctagagaggattactggcatgactaccttcctctgtcagatttctgaaatgaatgcctatttgtctgctctatattccgtaagcaccagaataacaatggttgcttttatgcctttatccaccttagcaaaatcttcaaaacaggctaaaattcctccctttctcctgtacacaggcctgatataaaacagacaaattttcgcacacaattccatcgagcagatagtacactgatctagacgttacatgaggaagaaagcagagttagatcagatatgccaacattctcagacggtaactgtagtctggagaggatcatcagatatgcctacattttcccaacaattgcctgtacctgtatgacccaatttagtatcttggcccagagatctaagcattctgcaccaagcaaaaaagaaaactcattgaacaaataatgcataccaaccatcatctttgcccataatctcattccaactgacgatatttctgatcatgcaactgccatctgaaaattactatttgggtggactactagatcatgagtagcagcaacacaggtatgtgcagatacagggtgcaaagccatatatatcggcgtagctggcattactacgattgttcttttcatgtctgaaataacagtccccatctcagcactaaatagagaaaaatcttcaaaaccttttctttcacttcatcagaaagattggtgcaactgtttacttcatcagaaagattggtgcaacagttgaaacagtttagttcatttccatcaatttgtgaagcagttgaatctgtaagtaacggatctaagcaagattatggatgaatgtattctcctagttgggttttgtattgtctgtcttcaacattcatccaaagacttatttattcgattcgctgtatctcgaacagaggtatgtcccgtttcctcctcttgcttttggttagtggctttctctttttagaagtatcatattcaaagtttgtttagaagaagcatgccaaggggtcaaacatttaggagagataaaaacgtgagaaagaatcacttaatgtggcaaaatttgtgcttgtcctgtatcagggcatctaacatgacatatagctgcttacctgcttgtaggaatggaaagagaacctaatgcacagaatttactaatttcaagtgaataatttttgtaaaaaaaatcctttcaatgtcagcattttggtaaaatcatatacatagacacatagtagaaaaacacaaagtagtcagaacagcatgtatggtttgtatttacatatatagatgcaagagttgtatgtcaaatacaattctactttcacataatcatttagtttagttgcacgggaaattcagctaattatctttaaaggcataaatctctactcaataatttttacacgcagaacctatgtttgaacaaataaaccttctgccatttagcaaacaaaaatggactatgccctatgttgaacaaaactagactatgccctatgttgaacaaaaatggactataccctagtggccatccttgcatcattgacaaatagcaatcccacaacattaataatgttatttactcttccatggtgccagggaagcttcttcatggccatgatggtgcaagtatgtgacaaaatccaaccacatgacaatatctgcacgagggttcataaaatgtaattggcatacactcccatcgatcccgactatcgttttgcagaaactaattataacatcatgctcttaccatgtaaggaacagcatagagctttaacatcttaagaggccccatcacaaaggtaaccagcgagaatcccaaccattgctagccagttgatgttaccacatccttcttctcatttggttggaacagcccactgcttgggttcaagtgtgaaccttccctggactccttgcaaactgcagacatgaccccaaacaaggaatttactatgacattacaaaataagaaccttcaatacacttgtcaatgaatgtcaagaagctcttgtcctaaccaagaaaaatgagaatgccagcatgggaaatggaatggtgaacctcaagcatagtctgtacagacgcccaggcagttgcagattgttacaactatagaaccatcaagcataattcgcctgtcccctatgcagaattcctcacaaaccacccaaatacaaaggtgggtgatcttctggcaaagctgagtcattacctgcttggacttcgattcagcttgcaggatcgctagtacctccttatcagggttgacccaacacctccctgcacgttaaccacagaacatgaatcaaagcttctgtgttcagagaaacagaaagtcagaaagcaatggtagatcagctacaaaacctgttaagctttctgcgtcagaatttgttgaacaagagaagcagcagtcagaatttgctgaacaagagaagcagcagaaaaattgcaatgcctctgcatgtgtgagccggtgctcttccagagctccttgtggctggcatctgctcctctgggaaggacatggatcaggatgatccagttgctggccttcaccaggttatccaccgcctgcctcaccacagccttgctaaatggcgagtagtccatgccgactgccgatgataatggttcgtaggtggaggtgaggatgtctggctcatcaaggtgaggtagcctgttaatgcgcttctccgcagatgaggaatatacttggcatcagatggctaataaggaattctccttaaatcaatatacatttgagccacaatctctagtacagccatgcacgtgcacgacgcagtacataacaatcttcagttactcagttagtcatcatgaatggtcaacaaaatttcaccagaaatcctcacaagaacaactagcatccttgaaatgatgaaaccgatacaagtcacgaacaactatttccctacctgtggccagacttatgtacttgatcgcttcatggcaatcctcacaaacacgcagattcttgaagatcctaagtggagtcccacttggagtgctgatgatcccaaatgcaatggccagcttctcactgtggaacttaagagctgtttccctttgttcatcctctacatcatgaacaacaagatcagttctacttgtgtacccaatctccttcagtctctccaccagcttctccaagtaagcataaatttcagctgattgtgggtgtgacgcatcccctgcaacaaatgtatgcacagtattcttcaggtggatccaagatcgaccaggctgcttcctgaccttcctttcctgcattgaaactctaagctcaaaagtgtcgtgccatttgttgttggttgcatatatgtttgacagcataacatatgatccagcatcgcattgctccagttgaaccaatttttcagaagccaattttgcatattcgttgtgctggtgaagtcgacaagctgacagtagcgtcttccaaacaatagcctcatggttgatgttgttttcctcaatgaagttctttgctttgtcaagcagtccagatcgcccgtaaagatcaacaatgcaattgtagtgctcaatgcttggaacaattccatactcctcttgcatctgcttaaagtaaagctctccttcactgaccaatccaacgtggctacaggcagatagaacaccgacaagggtaatctcgttaggagtcattttttctgctgtcattctttcgaagagctcaatagctatcctgccttggccatgagatgcataggagcacagcattgaagtccagacagcaatgtttttggtgcaagctctgtcgaatatgctacgagcatcttcaagggtgccacacttagcatacatgtccacaatggcagatgccaatggtgcatccaatttgtaccatagcttctccacgcagccatgcacttgccttccttgctcaaccatcccaacatttgcacaagctgcggctacactagtgagggtaaaccgatcagcagcaaccccttcgcgcagcatccttcgaaagagatcaagagcttcttcctccctgccattctggacatacccagcaaccattgtgctccaggcaaagttcatgtctctagtgagtggtgaccaatgatcaaagactgacgcagctgcctccaataagccgcatttgcagtacatgtccatgagagagctccgaacaaatgcatcaccctccagtgcagcaatcaaaacacggccatggagctgccggcctaggtctggcaagagaagcatgccggccaagacaaacgctgtggagtaagtgtagtgattgaacaccactccagcttgcgccattcgacgcaggtggctcagggcgtccgcagcatgcccactccgcatcaggccgctgatgattgtgttccagcttgtagtgtcacgcagcggcgattcatcaaaaagctgcatcgacccaaggatatcaccggactgtatgcatgcaccgatggcaatgttccaggagacggcgtctctctcggccattgctccgaacacccgcctggcacgctcgaactggccacacttggcgtacatgtcaagaacagcattgcacagcaccacgtccagatgcaccccgttcctcagcatccacccgtggacgcgcttgccggactccacatcgcccataccggcgcagcacctgacgacggcagcaaggacgaacgcgttcggcgtggcttcaccttcggccagcatctccgcgaacgcgcgcattccgtccgcataccggccgcgccgtgcgcagcccgagatcgtcaacgtccacacgggcgcggtcctcgtgggcctttcgtcgaacaccccgcgggcgtcgtggaatctgcggcgtctgacccagaaccgcaaaaccgaggcacgctcgtggggcaccgtagccaagcgtgcctcgagggatcccccgcgggcggctcgtccccgcaggaggagggccgcagagaagggatgcgtggaagcccgcggcgagagcagccgagccgcagctttcctcgccgcgcacatcacgagctcgctggccgccggtggagccgtggaggcgagggaacgatgcgatcaaggccgcgcgcatggaggcgatgatggcggcgctggagcgcgcgcgacgaggcggatgcgagcggccgccgccgcggcggctatcgcgaggaggaagaggagcgaagcgaagaagctggcgagaggggcgcgacgtgggccgggaaaaaaaagcaattcctaggatgaaaatgatttcgattcaaatctgattttgtttatatttgaataagatttcaaagttttataacaaggataggggctcatttggtcctaagaaatttcatataaatattagggctaatttgaaaagcaggattctcaaaacataagaacaagaaaaaaaaatgcaagattaaaatttcatcacaccttaaattctaagaaatggaaaacacataaaaagtatataagaaaccgtttagatgctacacagaaaaaaacaaaggatttgaaagagagatagacagtaccaagaggttagatcggacgcgttttgatgttgtgctaaatagtcggtcctacgtttccatcgtgcgggacgtatatattttcgcaattcttctaaaaacatctatataatcgcaaaaacttcaaaaacaagttatattttcaatttcttttttctaaaatgatggcagaaacaagttatattttcaatttcttttttctaaaaggaaaaagtaccttttaccctctgaactatttgggtcgttcgaattacccccttagactctaaaaccagttattttacatcctaaatttttcaaaccggccaaattacccccctaagtcaatccggggtggtttggtttgacgtggcgcacacgtggcactagtttgattgatgtggcagtccaacatagaaataacaataataaaaatggtgggccttacctgtcagtcacctattctgattatacgagagagtgagagagggcagaatgggtgtgggcagcggagctcaaggctaaaggccatggagagcggccactggcgtggatctcgtcgcaccggccgccgaatctctctcacctcctctctctcctcttcctctctctctaactcttcctctctctcttgcgcgcggcagcaggcgggcggcacggaggcaacggtctctccgcgccatcgncaccggcacccgcaccgggttacggtcggacaccacccgcgtgatggcgtactccagctcggcgcagaggaggtcgccacccatgatgaggcccatgccgagcgcacggagggcggctcgtcggtcgtcgtgcagctgctcccatgccatctccctcgctgcctccggctgtcgtccttgactcatcgcccgcggccgcagctgccttcaccccctccggccgcagctgcctctgcctccgcgccacagttgcctcatctgctcaccgagagagagagagaggcagagaagcgcttgctcttcgcgacgccgtagcccgctgcccgcagagccgtcgtcggctccagctccccctccgccgccgccaaccgcccggccccgcgcgctgccatcacccgcacgccacacacgcctgctcccgcatcggcgccaccgccgcgctctctaccacggcatcgtcggtcacccactctacctccgcctcagccacccgccgcccggggagctccacctccgccgcctgctgctcggggagctccgtctccgtcgccggtcgcccgctctgcctcagacaccggccgcccggggagctccacctccgccgccggtcgcccgctgccttgcccgagtgtgtgcgtgagagagattgaatggttgagagattgtcagattggtttgaggataggtatgacaggtgggccatgttttttttttgctggttagattgccactttggcgccacgtgtgcaaggtcaagtcaaaaccactcaaaacagtgttcaggggccttatttgtccggtttcaatagttgagggtatagaatgtctggtttttgagtttaagggtgtaattcggtcaactgcgatagttcacgggggtaaaacgtactttttcctttctaaaatgatggcagatagtgaagccagaggaggggccgcctaattatttttcacatgaaattaccccttcatatgggacaataattttttttctccaactaatgtaatttggaccaataaagtctcccttgatgaccgaggcagctagaagatttttccatgccatgtcgacgctaaattatgatcatacaacaaatatagacggtttccccctaccgtttgctatattgccatccgatggatagaaattaatccctcgcactcgtagttacagtgaataaggaagtctaatttgtaaacagatgctacactatgaaaaaagaacaatatcttccatattaaacaagagttgtttatgttggtgatattttaggaatcaccatggtaaagaggaattgaagacgaatctgacgagaaagagtcgtagatctagggataggttttagtgccacggtgtacatggtggggctacagtgtaataatcatgaaaactgccaaactattttcacatgaaattcccgctccaattagtagattttttgctccatctgatcaagaggtaatgatccacattcgacctcccaatccaacataatcaacctagtgcctctccacctcccaccgagacgctgccaccatctcacatgcagggtgtggcacacgtgccttctgtcttgacgctggaggctgccggcaacggctccccaccttgccgttagattgccatccgatgaacggatattctgtatatatgtttgcagtgtattgcaaacatatgctacgctcttacccaaaacaatccaatctatattcaatacattttctccatttgtatttaaatcaagagctgtttatgttggcaagattttagtagtcaccatggaaaaaagtgaatacaaatctagcgagaaaacgtgtacatctagggttagggttggtcctacgatgtagacggtgaggttatagatattaggcttgatgggatatgaagtggccgaagagggtataagggtcatgctacatgaatttcatctaaaagtgacagaatagcatctcagctatctaattttctatcttgatgagattttaggattcaaagtggaagatacattttttaaatttctaatagcattattttatgcatgaattggattacaaggagatttctaattcccaagaagtaaggatttcgagccactttcatcttgtcctttagtatgttgacttatattctgatgagattttagttaggactaaaagagggaaatacactttttttcaaataaaattcaagtaggaatttcgaggcactttcatgttgtccttttgttatgctgatgaacatctatgaataattaatgcgcttggtgttatgaaatatgaaaacggtatgaaactatccagctaatttgatatgggccacaaacagcattcatgaattgtcatgatcactactaagcgcctacgaagctgttgacaaccaaatttggtaggtcatgaaccgggttcgacattgggatcgaggcagattcgataaagagattgatttgaaaaatagagtatgtatcggctgcgaaggcatcggctggagtctgcatcgactgagatggatcggacagaggataactgatacaaccgataaaggtgatgcagccgattctgataatggtggtttcaaagatgtttctagaatcaatcaaggtgcttcacgaagattgccgcgatggagatagggctctcggataggcaattgcatctattaattaggatatttcatgtaacttccttacagatatgtttgggcaaaagtcagccgcaaagacttatggtattttagagtttgttagagataagtgtcgtgtccggcaaggacatattttgtatctcgagtataaatatgacccgaacccatgtaatcaattaacaatcgttcaatacaatctcggcgcatcgccactcttttactttcatttacttcgacgagttcttgctttcgggttgagctgcatcgattcgatcttcaactaaaggtaaagcttgttatggcggcttgcgttctcagggttaatgcttccatctttatgatactttaaccctgtttatgtaatccgtcgagttatcatatacatgttgcaatctacgttaatagcgctatatgacttgttatcgagtagttcttatcattaggaaacaaccggtagagttatgttttgttattaatctagattgtatcgtgtatctaccatctcttgtagattttcatcatcctgcttagatctcatacttatatttatgcttaatgctgcatcgattgagttcgatctattaagtagtatttataattgtgatatctggcttgttttatgattatcgatagagatagtatcgaggtttcagccgatcttacctgatttagctttatgttttatatgcttaattgatatgctaagtctgccctttatgttaagatcttgtcacaataaattatattaggcttctatttgatatattctatctgttttaatatcttaacgtagagtggtatcaaagtattagccgatacatgctagatctatctgatcggcaatgctataggcatttataatcttcatgttgatgtacatttcgacctaagtggtttatactgtctcggcatggcgaccgatctatcccaatcacttggtttaaatatacatcgacagaaggattatatagcgttaatatctacagccgatcgaatagatttagtcttattttgcttatttataactgccgatcgatttacatatgacatcggctcaagaataaatgatatgtcatcggcggctggccgatcggctatcgtttatggatttaaccacggtttcttttgtctttgtttcttgttgattataggatcaaatcaactggcatgctcacgaacctaaaggcaagattttggacctgcactgaagttaagcagatcttccaggccagtgtatgttttttgcatcaacatatccactaaattgaaacgtctgctttctatagttccgattggtgaacaattgcgtgtagaagtacaaattgacatgtacttctttaatactagcaatatataaaaaccagcaataaatacttagtccattctgtgatgcacacgttaaaataaatcaaactacaaacagagtcatacgcaagactttcagaatttgcacctccaccatgctagaatccacaagcacatatgcgcaacagtacgaaccacctcaaatcggaattaaatcaatatattttagtactaactcatgctagaaagctccagatctgaaagagttggacaaggggaggcgaggtggtggcgtcggctgtggacagtgccacttggcaccactgtgctcgccctccaccttcgaccgcctccatcagctgttgtgtgccgcctttggacctgccctcaaccaccgtgcatggagatgggaaggagacatggaggagggacacacaaggaggtgaatcctgcgtgttgccgcctgtttctcggcggtgcaccaccaccgctgcttgctttctcctcctccacctgctcttctacctcccccgcttgcgttgctctgttatgtgagagatgatgttggaggaggcatgacgaaacggtacgaaagggagggatggagggatatggcagtgttattttgcaggtaattttggctaaaagctatgtaatgcggtcggacctggagccatggagtgcccaaaatgctactctacctcgcttgctctgatctatttttttggtagatctggaccccgtttggttggactactccagctccactcaagctgaatctaggagctagagcaccgccaaacaagccctcgacctccgattccaacataatcaacccttgcttcttccaactcctacacaaccaccaccgccatcttagacacgtacggtacgtggcacacgtcctcctccctagcttgatgacggaggctgctagaagatttttccatgccatgttgatgccaaattatgatcatacaacaaatatagacggtttccccactactgttagctacattgccatccgatggacagaaattaatccctcgcgctcatagttgccgtaaatgaggaagcctaatttgtaaacagatgctacacactaagaaaaaaaaaacaatatcttctatatcaagcaagagttgtttatgttggtgatattttaggaatcaccgtggtaaagaggaattgaagacgaatctggcaagaatgggtatcccatctatatgtatgcagtgtatttcaaacatatgctacactcttacccaaaacaatcatgtctatattaaatacattttcgccatttgtatttaaatcaagagttgtttatgttggcaagattttaggattcaccatggaaaaaaagttgaatacaaatctagcgagaaaacgtgtacatcaaaggctagggttggtcctacgatgtagagggtgaggttataggtattaggcttgatgggataaagtggcagaagagggtataagggtcacactacatgaatttcatctagaagtgacagaatagtatctcagctttctaagtttttttcttgatgagattttaggattcaaagtggaaaatacatttttttaatttctgacaacattattttatgcatgaattggattacaagggcatttctaattcccaagaagtaaggatttcgagccactgtcatcttgtcctttactatgttgatttctattctgatgagattttaggattcaaagtgggaaatacacttttttcaaaaaaaaaaatcaagtagggatttcgaggcactttcatgttgtcccttgttatgctgatgaacatctatatatgaagaattaacatgcttagtgttatgaaatacgaaaacggtatgaaaccctgccgctaatgtgctatgggccacaaacatcattcatgaataatcattatcactactaagcgcctgcgaagtgatgcaccattgaaactaagcagctgctttctatagtgcgactggtgaacaattgcgtgtagatcagtacaaattgacatggtgcttctttaatttaatactagcaatatataaaaaccaccaataaatacttagtccagtctgtgatgcacacatctctactattataaaaattgaagatgtttttgccggtactttggtacgtcatccgtgtatgagtcggtttttaagtttgtttacttttagaaatacatatccatatttgagtgggttttaagttcgtttgcttttagaaatctctttaaaaaaatcacattctaacttacacggtcgggctccttactgcaactcatgattttttttaaaaaaatatatccaagcgaatttctacagtgaaattcacattaactaaaccatataacaataataaaattaaaatagcattcacccgttgcaacgcacaggcattttctctggttagaaaaaaatcaaactacaaacagagtctttctgatcattcgcaaggctttgcagaatttgcacctccaccatgcacataaaaagatgattttgtcctctaacacaccctccccccaaaaaaatattactgataacagcagaaacactaaaattcatctttaaaaagaaacactaaaattgtggaattgttttgtttagcccaaaataactttgctgcatcagcctgtcaaaaaagttcacttaatccccaaaggtattcatctattagactcttaagtattgaattccttgtaaacaaactcttaagaatatagatatactctctccattaacaaataactagcaataatcacgcgctacgctgcgtgctcgataacaaaagcaagacaaaacatatatagttgtcaatattccgtgaaaacaaactggcatacacatcaggttttccataaagattcaaatatgaattgttcctattgatctgtctatgcactatttgtacaatcatatgcatttcagcaaaattagcaaccatacaatgaacaaaatgctgtaaccatacaatggagtggatgggagaactgaaacggtgctataaccacaatcataaaaaggtggttctttatttgcaacatcatcgcatacttctcttcatcaaccgttgcaatcttttaacatagcagttgctttgcaatcaataatatgtaagttctacatggcatatatatatctccctcttccaaaaagggttccataaaacatttcatggtcagaagatgatatcttaatgaaattatactggcaagtgaatctataatgaatacttaataattatcactttataaacatgtccatgaaagcaaaatctcaattcaaaaggatagatcagtagcaaattctaaaagcaggaaaacattagagcaggaaaaccacatcacatcagcaatgttgcctgtaagaaaaaaaaaagccatgtgcaccctattggaatatataatagaatgccctattgtaactcaattgaaatgaggcagatattttagaaagttgcccaacacgttcgaaagtaatactcaagtagaatcacattaattatactgaatcaaatgccagcatataatcaaggcattgatcttttgtgtggtacatatactctttccatgacgagaagttcaacaatactttctagggctgcaataattgtgggttaatctatgcattgatcctttgtggttagctggatgtgaaacacctagagatgaatgtaaactacagagtcaatcacactataataggatcacatagtagatcagaaaatgttatattgttgcatataacttgaactgatttagtgaaagaagacattaaacaatattaatgtagttatgttgacctagtaaaattttgaccaatttccaaatctttgatcgatccaaacaaccagagatggaaaatttgccgagagaaatatttaatttggttgttcatttgcattccctgactataaggtgaattgtacaatctatatgtttggtttgacaaagatattagccataatacagagcatgtgaattattttgagctaatgatcttgtctgtttttttttcagatcatacagccattttagagtttatttttaaaataattaaagaaaacttgggagaaaaaaggtacagagacctctccttgctcaaagaagaaaactccccgttgtagatcacctagcttgcacggaatataagtaactttctcacttatggaaacaagttcaaattgatctatgcaaacaaaaaatgaagaaaaagggtgtattactccacattggaattcagaccactacctcatgtaggaagttattacaccatatttgcatcagaagagcagcaagagtactgcgtttgtttcttgcattgcactgagctgtacatgtcaactattagcaatgcataaagtaatcatacgatgagataaagaaatagaaaaatgaaacgttggagaaaattttaatatcagtatgtgtactattatagtcagcatcatctaaaatgcatgaatcatataaaagtatatgactatatggtaagggagatcacattaatattgtagcttttgtcataaagaaatagctgaacatatcaagttaatatcttcaaaaatcaatcttaagccaaggctagagcgaatcccatcttctatgaacctagaataactaaggttgctatctctgaatgcgtatagaaatcaagaatttaagtaaacaaaaaggagatgcaaactaacagtacctatactcctatagggtggtcagattcaaaggtatgatgttataatatattgagattgccacattttcagagtcctctatgccatatgtatcaacatcaccaatgtaagattgtccataatgaacatcatcgatgcaaatgctttctgtcaatctgccaacgacaatagcggcaagggattaagaaaatggaaggcagcagaggacattcaatagatccaacactaaacaaaagctaattaatctgatgaacagcagatgctagcatggaactgaacttaaataatcttgatgagcaatcacacaaccatacagtacatcagctggtagaaaacaacaaaagcgcatcgacaactccaaatagatccctatatatttaggcactgaagccagtacatgctgaaaaataaatcaatataagccgaagctaattaagaaaaaactattaatgtataatacatagacctggaataagcttgctactacatagagattaaggaattaagttaataaaaacggtaaatacttgctattatatacagatcaagaaattaagtcaaaaaatggagaataaaaaaatggtacctccagagtggccaaattgaaaggttggatgtgatagtatgccaagattgtcaggtatacatagaatctttcgtgagaaccattgccattgtaagatcatccgcaaagaataccatcgatgcatatgtattatcatcctgtgtacaaaaatagcgggcaacaaattaacaaataaaaactgctcatagcaaaaacaactaaacctaaataggaccacataaatcattcatgttgaactaataatgagcagcaaacaaagaacatggatcagtggcttagatcaaataggtacatgtgcatataatagatggaaatcgtagtacaacacaaagggaaaaaatgttcattgctttaagtagaactgcataccaaattgggtttagccaagtcatcgccatacgttggtacagtcgtggccgagccaccgctcccaatctcccttctcgtccccggcgtcctaaccatcgctcggacctggcactgaacgaagcagagagcgattggaatagggcgagggagagggaggcgatggtggagtggagattgaagatgagaagatggtggcgacgactcgtgtccctcgcttccctgtggacagatccatcggtgactgatgcgacagcctctctcagagagagtggcggtagcggtagcggcagcggaggcgtggtgaagatggctaggggggagtgaggaggcacgcgggtgaggatgggtggtggtggcaaaggcgcgcataggggaggaggaggtcgaggcggtgcgtgagaggtagggtggcgttgctacttgtgacgacgcgggtgagaagaggaggaggagggcagctagggttttggtgcggcgtggcgacatctgcgccgttcattcccgagccaacgatcgcatgagtgcacgactaaggaagggcagccacaattggacatgtggacggtcagatcgacattaggcgagatccaccgaacgaaggcaatggagcttgacatgtaattaacaaaattgcaggggctttttttttggcaaaattgacatatgacgtggcaccccttactctccagcgatcccatggtgtttaaagaaacaaatatatatgtttttgtttttccccaaaattaccattatacacttctcgtggggaattcacaaacaatggacaattaaaatagatataagtggctcaacaattatgtgcagaaacaagtactaccattgtcccattgtctagatattgccagaaatgtgttctttttagacggatagtaataattttctatttgctaatatattttcataaacatttggtgcataatattatttgctaagaaaaaaataccacacattgcgtctttgtgatttcagttacatactcattctttgcaatctcagctaatgttagggttttcttttttaacgtagaaaagcctacccttctcatacacaactctttgcagaatttgaacgtccactttgcaaacaaatgatgaatccgcacattactccaaacacaccagaattagacattatatatattttagccaaaaataactttacttaatttgttctttccaatatggttattcacttagtccaataatgtattctgctatacactcttttgaataactattggattccttctgagtatagtctacaatgaatgtctgttacatatgttctcttctctatcttttgtttttttttattttcaaatgctaactccattcgctaccaaagacattgtcttataaattacctatgagcaggaaccattttgaacatgttgatgtaaatatgtaatgttacgagggtctacttgtaaaatgttttaagaatagaaggaggatgaaggggtgtgcagtgaggaaccccctgagaaattccccaaaaccaaacaacaatatggtatcagagccaaaccctagctcaccggcgatctgcggtgcagggtgaggcagctgggttgcgtcgggcctagagcaggaggttgcgagtatgcgaggaagatggctgggcccggagcggtggtgtcgctctcaggcgcgcgcgcagaggggcgcacgtgaggcggcgatggggcgcgtgtgcgtgggccgcgctgggcccggagcggcagtgtccacagcgcgcgtgaggcggcggtgtccacagcgtgcgtgcgtgcaggaagaagaggagaggaagaaggcaagggaagaagagggagaagggtgagaagaagaaggaagagaagaagaagaagaggagaaggagaaaggagtattatcactggtagatttgggattttgctgttgtgtgtggtttattttgctgttgtgtgtggttgctgcttgctgctggtagatttgggatcttgctgtagtgtgtggttgctacttgctgctggtaaatttgatgttacttgctgaagagaggagagaaggagaagaaagaaatgttttcagcggttggaaaggaggttgtagatgcttcctcacttatctgatgtgaccatggctactacggatacaaccattgcttacatcatggatgaacaagaagacatcaaggtcaaggcctccaagtgctagaatccaattcggccacctgctgcactgctgatttcaaacagccgccaaatctccatacgagctccgtttttggcccgtaagtacttgatggaaagctctcggagtcctctttccaacggatctagcctcatcaccaaattccatcccagtcaaccgcagatgaagaaacaaggtgcagcgtcacctgtcatgggcctttgggcttataacttcgtttgggaccccggcccaagtggggcccatgtggggtgcgccccaaccaggtggagcacgaccctaggaccctcttggtcgttctcccacccttataagtagctaggtaccccttcagggtttctcgggttttgatagattaaagtttagatattgctccttgcttgcagcgcacgtgtcggctagaccgtccgtctacttgttctttggaaccccaacttatcatttgtattcaattcctatttgcaatatcagattgcttttatcctgttcttgcttgtttcttcgatttgcttgcaggaatagggttgatttgcaccggcaagatcaacaactcacggagaggtgtatcgatcgctaaggcgcaacacaacatctcgtacggttgtagtcggattgtcaacgtttctcccaaatcgtagttatcatcaactcaccgaaagatcaggccaaacaactgccttgagtgtcgagaggaacttagggttcatcaggtggtatcagagctttcgttgctcggtgaatttttatctacctataaccataaaaaattgccatacaaaaaaaattgtatcctgtaccaagccatatattgtgccattgcattgttcttttcagtttttgctttgctgagtttgcgtttcatcgtcgagtcgtgttgctggtctagtgtttagttcgtttagagtttcgagttctggtcacattttgtaccactgtcatcgtcatcgtcgtgtgcttgttgtcgtcgggatcttcgaaaacggaaccgcctcgctgccagtgttctatttttttagttttcagaagtttttgtcggtcagttttggagttgcattttgggtttcttttgtgtggtcgccgtgcgcatgtggtgattcggtcgttttgttgcgcgtgaggaagctgcgcgtggagattagattagattgactagtttggtttctatttagtgccgagtctgtttctatttatcacctggtacctttccaaaccgaggccgagtgagattccttcccttgcgtcatctcgtggccgagagttgtgagtccgacgcacactccctcatgattgtttctgtccgggttggtcaaacactttggtgaaattttattatggtgtcggattcaagatccatttgcaaaaaaggaaccgacataacttgagcattccatttttgtatagttctgatttttgtttggaattttacagttgagtccctgtaatttttatatctgcaattgagtccttgtgatcttacattgaggtctttgagcctgtttttggtaaaagaaaatcaaaaaaaagaaagaaaaaaaggcagaaaggtgcataaaaaaagaaaagaaaagccgcaccaaaaaaagaaaagaaaaagaaaagaaaatagaaaagaaagaaagaaagaaagaaagaagcgaaaaagaaaaattagttgtatctttgagtttgccatacatcagagtgtgcttgagttgtttctggtgctattttgtggtaccgtttgtgtctaggctcgcgtctctagtactatctagcctaggaccagcacggtacttgagtttgaacaattattcaactttgcattatctgagttgagcatttgctattcctttgctacatatttaagcctacccagagctccacagatttaattggagccatacagcaagtgtttgccaaggcatcgatacatccaaactccgttggggtgcttggttgagtcggtgtatatcaccattccgcttgcattggtaagatcttgtaagagcttggttaaaagcttgagtgtgtgtgtaatatttgaggtaccactacctagtagttgataggagcgtgcatatatttgtgtatgcttcttgttttctactaacaatggcagggatatgcaagaccattggagatgacctagctcaacatcgacatcttcgtcgagacatgcaagaaaaatcctaataacatgccacaaacttgggatgcgttgaaacgggtcatgcggactagatttgttccttcttactatgcacgtgacttgctaaataggttgtaacaattgagacagggtgcaaaaagtgtagaggaatattatcaggagttaaaaatgggcttgcttcgttgtaatttagaggaaactgaggatgctgtcatggctagatttttgggtggtttaaatcgcgagatttatgacatcgtagactataaagattacattaatatgacccgattgtttcgtcttgcttgcaatgctgaaaataaaatagaggaggacatgaaaaagaaacatgctatgtctttgcctccaattactaaccatttgcaggaagtgcgtaatcacaaaaaggaggagagagacatgaaagagccgccaattccattgttcacactcaagttcgaggcacctccatcatctgaagaggacatcaaaggtaaagtaaatggtgctgaaattaatctaggtgagtgtgttgttaatgaagtaaatttgtccacttttcatgctaaagtagagcaaccgttagtggaatcaaatgctgaaattcctttgtcacaagtggatttacttgctgttccttgtgataaagaagagttgtgtgataatgctttacttatatcaatgccacaacaagttaatgaatttgctattcctaatgttaattctgctaattttaagcatgttgttcacattgctcatgaagttcaggaacgtcaattgatatcttctttaaatactttaggctatgttcagtttgatgatttttggggagctcgataatttgaaggagaaattatttgttatgtctgatttgccatgtccaaccgatgttacttttcatatctttggcgaaaataatgatgttggagtatatttggtgcatagagtttacatatattcggatttagaacctcctgtacatgtggataaaacatgcaagctagagagaaatgttattgctaaccaaattatctcgagtttggcttgttttgattggaagaaacaggttgttgtaaatggactacataaagagcaccatatggaaaaactgaggacggttttccgtgaagaaggggaggatgatgtgaccatggctactatggatacaaccattgctcacatcatggatgaacaagaagacatcaaggtcaaggcctccaagtgctggaatccgattcggccacctgctgcactgttgatttcaaacggctgccaaatctccatacgagctccatttttggcccgtgagtacttgatggaaagctctcggagtcctctttccaacggatccagcctcatcgccaaattccatcccagtcaaccgcagatgaagaaacaaggtgcagcatcacctgtgatgggcctttgggcttgtaacttcgtttgggaccccggcccaagtggggccatgtggggtgcgccccaaccaggtggagcatgaccctaggaccctcttagtcattcttccacccctataagtagctaggtaccccttcagggtttctcgggttttgatagattgaagtttagccattgctacttgcttgcagcgcacgtgtcggctagaccgtccgtctgcttgttcttcggaaccccaacttatcatttgtattcagttcctatttgcaatatcagattgcttttatcttgtttttgcttgtttcttcgatttgcttgcaggaatagggttgatttgcaccggcaagatcaacaactcacagagaggtgtatcgatcactaaggcacaacgcaacgtctcatacggttttagtcggatcgtcaacgtttctcccaaattgtagttatcatcaacacactgaaagatcgggccaaacaactgccttgagtgtcgagaggaactcagggttcatcattatcactaaggatgatatgaaagatttgctagaggatttgttgaagatggacatgataggtcagaggaatgtagcatgagggtttgaactaaaactagaagtgatgccaagtaagttgaggttggaagggagcaaaaattatttgagttggtgtaggagatctcaactaatgttgagagcaaaaggggtggatcattttttgcaagagggttgtgaagagccctctgataaggagagccaagcatggagaacatggaatacaacaaattcaacagtggtatcttggttgatgaccttggtggctccttctattggtaggatgatagaaactattcagaatgtagcaattgtatggaagacattgagcaacatgtattctggagagggaaatgtaatgatgatggttgaggcttagaacaaagtagagaatttgaagcaagaagggagaccagtctaagggtatgctagtgagttgcaatagttatgggtagatcttgatcagtatgatcctctacaattgaagcatgaggaggacactttgattggaaataaatggatgcagaggcgaagactcattcatttcttgaaggggctgaacaaggaatttgaggatagaagagcggctatgttccaccgggctacattggcccactatggaagaggctatttttgctatggtgcaggaggagatgagattgaaactgatgagaggcacaaatcctataagatcaacatacactgttgctgataatagggaatgctacaactgtggacaagtgggtcatgtgagctacaattgtcccactccttggaacattggcggcaaggggttaattcgaggatggcatggtggatttggtggaacctgtggtggatttgaaggagaccgtggtagctttgggtgacaccgcagtggtagaagaggtgaccgagggggtcgtggtggaggtcgtggtgggggcaaaggtgctccttaggccaatgcaaccattgaggagggtaaagctattaccctaacaggtgaataggtgacacagtgggaagaatggcagaataacaagaccaataagagctccaacaccaccactcactttggtaactttgccaactacgcccaagtgggcgaaggtactcaggcataggcacttcatctacatatagacatcctatagattggatcatagactcaggagtattaaagcatgtcacaggattgcataatactttcacatcatacaccccttatatccactctgaaactatccaaatcgctatggtacatccaaacctattcatggtatagggttggtagagtgcacatcatcaatgaacttatcttctgttctgcatgtttcttcctttccagttaaccttctctcagttagttcggctattgatcaactcaagtgcattgttgtatttgatgataactcttgtctgttccaagagaagggaactgagaggaggattgggactgcagtcaggcatgatgagttgtggtacatcaatcatgaggaactgggactagctgcggtggttggagatgttgagaaggagatcagtttgcttcattgtcagttaggacatccatcttttggggttttgagtaagttgtatccagacctctttagtagagtggatatgcatagactggtgtgtgatgattgtgagcttggtaagcatactcgctttacatatgttgggcttggccttcgtagctatgaaccattcatattaatacattctgatgtttggggaccatgccccgttacttctgtgagtggtttcaagtggtttgtcacctttattgattgtcatactcgtatgacttggatttatatgcttaagcacaaggatgaggtccttcgatgcttctaggactttcataaattagtgacaacccaatttgatgcaaaagttaagattattcggactaataatggcatatagtatatcaataatgaatttgtgtcatatgtctcagatgaagggatcattcaccagactacttgtcctggtacccctcctcaaagtggtgtagctgagaggaaaaatcgacatttgctagaagtggcaagatttctaatgttccagatgaacgtgccaaaatatttatggagtgaggctgtgatgacaactgcatatcttatcaatcagatgctgtctaggatacttggtatgaagtcacctgttgaactttttttgggtaagcgagagtacaaggttcctctaaaagtgtttggttatgtatgttttgtgcgagatcatcgaccctttgttggcaagctggatcctcatgcagtaaaatgtgtgtttgttggctatgcttcgagtcagaaagggtataaatgttgggattccattgggaggagactgtttgtgagtatggatgtgacattccgtgagtttgagccctattataagagttaaggagatctcgaccaatttcttgaggaattctcgactgtcatggaggatgacagccgagagggggagacagagggaggtgatacacatgaaaaaaatgttggttacaagaatggagaggcagtggtagttggatcaataccatgctcgattgatggtgtgagtaaagaggtggaaaaatttgttgaagctacacaagacaaagatggagaattggttcttcatgagagggatggagaagtggtgcttcatgagggagatggagaagtggttgtagggacaattccatgtcctatggagcaaaccgaaaaggtgaaacaaaaggatatgctagtttaccaaaggaggaggtttgataatcatggggagaaaagaaagaaatcagtgcaagatcaagttgaaagttgccacacccagaatacccagtcccagagtcctctcagagcctctctcctccagcctccttggctcctcttgagacaattggtaacacttctccatctcttgaacaagtagaattccctcttgcacatcgtagagagactagatcaaatgctggtaaccctcctatacgtcttggttttgagcattttagttgtatgcatgacatgccaacttatatctcatattctcatgtttcaacgccatacaaacatttcattgcatcattacagacagtgtccataccaaacgaacggaagtgggcaaaacaagatccaagatggaaagatgcaaagaaagatgagctgaatgctcttgtgaagaacaaaacttgggaacttgtgagacttccaccaggtaaaagagcagtgggatgtaagtgggtctttacagtgaaacaaattcctgaaggaaaggtggataggtataaatcaagattagttgcaaaaggctataatcaaacatatggaatccactatgatgagacatttgcaccagtggcaaaaatgggcatagtgaagactttggtatcttgtgcagtaaactttgggtggcctcttcatcaacttgatgtgaaaaatgcatttcttcatggtgatttacatgagaggtctatatggagatccctctaggatttgggaatagccaggc

SEQ ID NO: 35081 - DNA, 11030 bp, Oryza sativa
  unsure (1)..(11030): unsure at all n locations
agtaagtgttatgagtagatatatgtatgatcccagaactggtcacttagatgttgttcataggattcttagatatctgaaagggaccccagaaaaggggttatggttcagaaagaatggacacctaaacgtggaaggatattgtgatgctgattgggcaagtagtatggatgatagaaggtctgcatcggggtattgtgtgtttgttggtggtaatcttatttcttggcggagcaagaagcaagcagtggtggctcggtctactgcaaaagtagaatacagagctatggctctgggcttgagtgagatggtatggatgaggggtttgttgtctgagcttcgagtgttaagaagtgatactgtgatgcttcattgtgacaataaatcagccatcaacattgcaaacaacctagttcaacatgatcgcactaaacatgtggagattgataggttcttcatcaaggagaagattgatagtggggtgcttgggctagaatatattaagtcatgtgaacaactagttgattgtctaactaaggggctaggtcctagtgaagttcaatcaatatgtaacaagatgggtatgattgatatcttttgcccatcttgagagggagtgttggtgtaaatatgtaatgttacgatggtctacttgtaaaatattttaagaatagaaggaagatgaaggggtgtgcagtgaggaacaccctgagaaattccccaaaaccaaacaacaatagaacacatctaatttcatgaaatttcgctataattaaggtcagttcctatgaaaatcctgtaaaattcctccaagatgcatctttctattttgtcggttgatatatcgagggtattttaggaattactggctcattctaaatgcgggattttgcagttcaattgctctgaaattcccacgaaaaatatgagtgctaaggacctaaggtataccctttatttccttcaaaatattcaattctaaatgaaacggacgggttatataaagctaaaataccaatacgcacacatgtagaactagggcatttaatgttgctggggcctgggtttttttttttactaatggaatgaaacactggggggttaacgacgatgaacaagaacgctgccgtctcttcccttctcgtactgtcgccgttgtacgccactgcacatggcagtgtcgtgaacgtcacgtagctcctcttggacgcgggccacttcggcatgttcgcattgccgtggcagcgctctagcaggagctcaaggtgcgccatcgccaccgtgaccatcgcagcgcgcttgcgtgtacgggagcgggatcagcaccttcacgccgtccgacatctccttcgcccaagcgagcccgcgcgcggtggcgcgactgctggcattcgagctagcgcatgttgctgccagagctgatggctgtggagcggccagtgcagcccacgctcgtgacggagcacgacaccatgaggttcacgcaggtggacgtcacacttaaggctggcagtggcgtgtgtgggtaggggtgtaagtgggtcagctgcgaactcacttataggtcaaaataagtgggtttgcggcttattttagcctataagtgggtttcgcgggttagccacttacatccctatgcgtgggctgatgcagccgctgggcaagcccgcaccacttacccacttacccacttaggccaaatggttgatgcggcaagcccaccgcgtccggcggcgccaccacagcccacatcgagggagcatcagaaagaggaggaacgaggagtcaaagaggatgaggggaacaagttcgtcactgttgtggcttgaaacctagtcgctgtcgccatggattcgatgccgcctcctcctccgccccctttgccaccgccaccgccgctgttcctggtgatcttgtagacctccgccagcactgccgcctccaatgcgccctccaagggaccttcgtactgaagttcctgagaagttcctgaagaaagtctgaacattgaggttttgtgctgaatgcagcccccaaattgtctgaatgttgatttattttatattctttgccatgaattgcccacattttttttaccaagttttggttataccattctaaacttcctatgcagaactcaattctcaaaaattgcaggttgttttctctctttggtacctacaaaaaggaactctttggtacctgcagattcttctgattctttatggttagcaggctgcttgctaatatcctgggatcctgttttttttgctggcagtaccatatttttgtctgaactagtgcaagcaacatacatcctttgttctttcaaatattcacgaagtggtgctttctgatgaaaaactcatatataatcattatttgtcaatatgcagaatctgaggatttgcaagcttcaacaccattaggcattgaagtagagcagctgcaatgtacagtcttgtgttattgatacaatcgttactttgatcttcattaggatattcataatgtcctattattccactcacattaatattgtaaattcagtgagcaatgcaacggttctgtgacttctttcattctgtttgccatcttcaaaatcttggatgaaatttcgttgtttgggattgagtgcttattctgaattcttcttagcaagctgattatctgatcacgcatgttcttttaatctgggcaaagtagaaccagcgggcaggcgggcaggtaaacggatcctgcagcaaggccgccagaagtttgtgggcttgcgtgcggactactcggcgccactaacttgttgcggacatagcggtcgcggggcgggcacgccgcagccgtgacactgctcgaccacgaccgcagcggctgcagtggcggctctccgtcgtggccgtgctgttccctaaggagttcttctcgccggccgtgatcaaaagtgctacggctaagagggtgtttgggaaagagggagtaaactttagtacttattttttgagagagggatctctcccaaacaccccctaattcgtgcctgggtttgagtggagaagctcattaagcgtcattaattaattctctgatattatactccctccgttcacatttgatggccatattacaagcgtgcagcgagaccaatgctaagaaaaactcttccattaatcagttaatgttgtcttgtcccttcagtttcatatcagatattaatactagtcgtttttcatatcaaattcccctccaatcagtagattttttttcctctatccgatcaagatctaacgatccacattcaacctcccattccaacataatcaaccctttgagctgccatgtcttttgatgcaagaagtatggtttccccctaccgttagattgtcatacgatgaatggagattcatccctcgcagttacaatggattgcaaacatgtcctacactcttaccaaaaaaacaattttgtctatattaatgacattttggccatttttatttcaatcaaaagttttaagttggcaagattttaggagtcgccatggaaaaaagaagtgaagatgaatataggaagaagacgtgtacatctaggggtaaggttggtcttacgatgtagaggggaggttgtagatgttaggcctgatggaatgaagtggcaaaagagggtataagggtcacgctacccacgaatttcatctgaaagtgacatatgagcatcccagctatctaagtttctatcttgatgagattttaggattcaaagtggaaaatacactttttaattttctaatataggggcatttctaattcccaagaagtacagatttcgagccactttaatgttgtcctttattatgttattagattttaggattcaaagtgggaaatatacttttttaaaattttcaagaagcagggatttctatgcacttccctgttgtcctttgttatgcttatgaacatatatgaataatgtgcttagtgtcatgaaatacggaaacggtacgaaaccgtcctgtacgttaatgtaacttaaaaaaaaggtgcctgtgcatcgttcaacatgacaaactaaaattaggatgaatattagatttgtaccttgaacttctccaaaaatttgctcaaactcaattcagaaatttgagagcgaatccaatttttccgttcgaattactttctttttttattagtatttccttgttcaaaatttgttcaaattctcatatatcaaaatccacccaaacatgcaaaaatccttatcacgcgatgccaccgatgatggatgataaaagaaacacttcaatatttttctataataagtaggtagtgaagatattcctcaattaccctagaaaaggatattcctcaatctgtttttataatttggataactctaaccattattaatatttatttttttcatttaaaattttgattatacaatcaatcctactttatccccttactcaaacgcaaacatatatataacgttcttcttctagcttcctggcttctgggtatgagtcacgggatggacacagggtgggccgggtagcagttcttactccttctgaccatgaatgatctttctagttttgaaatcagttaattgttcaacacacaaatttatttccattacatgaagttcaaaacatttattaaattaatctatgagaaaaatcatttacaaaattaaatacaaaaataaaaacctaccaaacattatggaacccacgacatgaaaaataaaaagcgtaaccttaagcaatatatgcaacactttaaatgttgtagaaacatacctaagcaataaatacaacactttaaatgttgtagaggaataccttaggccctgtttggctaatgggatagggaaatcatttcccacccactaaaagacatctttaaatcttaaccattcattatccctcttccatttaatcctaacccccacatttctcattatccaaacacacccttaatgtttacactttaaacttcaagcttcaaagattgaccttaacattaaggtgtgccataagagaataacataggatccttttattgattcacagttcacaccagttcattgggtgatgaacccgaggggtacctaaattcgatttcacaacctttaactgttgtagagttggtactaacttatgtcacttgcattaggccccacccttacggtcatcgttgcacatacattgagcttgcccttatagaataaactatgtggccatccaccaaaatggtttggcaagttactactacccgttctaaaataagcttatttttcatctaacccacacattctagtataaaagtggaaaaataatactcttcgctttatcaattcccctcactttaaccaattccaatgcatttgtcccatacttttcacaaaccccaatgtaatgatttctaaaaaatgaacttattttgagataaataagagggagcaaagataatcttattttaagacggaggaagtacatcatgaagtgtggcgacaaacacacaacaatgttttacatacttgggtgcgggagtgttgtcctgccacaccaataaaaatagcatatcttgaagattcatagagagtggattctaatccctcgagggaatgtcatttgtgtactttttttcctttaaatttgatacaaatagttgtagaaaaattctaaacttttttccactgtagaacatagtgatatctatggtaccccaaaaatcaagttcaaattcgagctacacatcgagaaaaaaaacaaatttagatgtggacaatacactactattcatacgttaaatttatctcttttatatcttgatttgtgagttgagtttagacctaagattctatggagatatgttgtacgagtgctgcaaaaaaaattcatatccgtttggatggtttttaagtaaacaagtagacatcccctcaagggatgaaaatagtttcccagattcatatatgtacataaattttttggaaggcttatttagaaattgagatgaaaagggtttaaaaaaatccaatgcaacatctcctagcaacaaaatttcaattgcaatgagttttttttcaaacaaattgattttaggcacactgattctttacttcaaaggacattttttgttaacgactcgcacaagacggtgcgaagttctactgatagagcagaaaaaaaaacaagattacaaccctagaaggtcttaatcaggaaaaaggaaaaaatataccaccacatacacatcgacagcgccaacacacaggtccgagagaagactagcactggaccggccgcggctaagcgtgaccgaccgccgctaggccaacaaaggaacatagacgagaatgctcaaaagcccttacaacctacacaaagccaactctatctagagtgtgcttgcaccaatcgttcgagtggttttgacaaggggatgcctaaacgacgtctccaaggagataagcgacggaaaaccgccgtcgctgtccgtcggggactcaaaagagccaagattgggcttttgcccgacaaacacccttgagggatgagacggcacgacaacgcccttaggagggggaaaccattgttgtcggtccgggcaaggccgggctaggttttcactcgccgctcacctccaagtccacggctgatgcaccgatgctccaccactgctcaacctctgccgacatgtgggaccactgcaccggcgcctcccgctggccaaccttcgtgcgccgaagaccgcgtcacaccccccgcagctcctcctcacatcgtggtcgcctcctttaccgccggccgtgcctcatcgcgccgcgccgtcctcctccaccaccggatgagcctctcgcgccagtccggtttcctgccatcggctgtgcctctcacgccatgccggcctccttgccaccggccatgcctctcgcgccttgccgacctccactgccaacagccgtgcctctctacgccaagccggcctccgacccctccaatcactgccgcaccggccaggtgcggccgtctgccacgcccccggctagccttccgagaccgccatgcctcaccaccattgcagccactactgccgatggccacctcgccgctaccgcgaccgtcgccacgagctccgcgccgttgtcgccgccgtgagtgcgccccgttgccacagcagccggcagtgccgtctaccaaccactgtgctgtcgccatcgtccagccgctaccaccaccttcgccacgagctccacgccgttgccactgtcgttgtcgcgacgtgctcgacgccatcgccgccgacgccgtcgccgcgagtcccgtagccccaccaccgccgtgagcttgccccgcactggatcggccctcgggggggggggtgtccgccttcggagcgaccgagccctgcccgccgttaccatcctcgccgccgccttccatccccgccgccaccaccgccaatcgccaccgcctcaccacgctgacccatcgccggcggtctccctgccagatccggtcatgatggcctcgaactgggcggccttcgccgtcccgtgcggcccccacccctggcgggagggagagacgagacgaagcccctccatcaccatccttgcggccgtgcggctttgccggcggccgctcgggcggcggcgaggcggagaagaaaggagggggggagcgggcgacggtggtggtttccacctcctgtgtcttccgtgagggaggacgacgcgggggcgaagaactgataatggacatttcttaattcgaacaataatgatatcaacggcatttcggtgccttgtgtttaataccctgatagataaacttctattaaaagcaatcccttccttccagcaatcaatgccagggtgaatacgtgttgtttattggctagctaataatctagtgctataattagcgcaccaataaaagccagaagctctcgtcaccacctgttcgaccggagtcagattgcgcgcgccgtcctcccccaccgccatggcgccgccgtcacggcatgtggacgcggtcgccgccgttctccctgtcctcctcacgatccttctgccttccgccgccgcaatcggcgtcaactacggcaccaagggagacaacctgccgccgccggccaccgtggcgaagttcctcgcgaaccgcacccgcatcgaccgggtgaagctgttcgacaccaacccggacatcgtcaaggccttcgccggcacgggcatcacggtcatggtcaccgccggaaacggcgacatcccgacgctgggcaccaaggacggcgccgccgcctgggtggcggcgaacatcgcgccgtactacccggcgacggacatctccctcgtggccgtcggcaacgagatcatcaacacggcggacaacgccctcatcggcggcctcgtcccggccatgcgcaccctcagggcggcgctcgtcgccgccggcttccggcgcatccgggtcgcgtcgacgccgcactccctcggcatcctgtccgtctcctcgccaccgtcggcgagccggttcctcgacgtcctcgaccgcaccttcttcgcgccgatgctggagttcctccgcaagaccaagtctccgttcgtcgtcaacccgtacccctacttcggctacaacggcgacacgatcccgtacgcgctggcgcggcgccccaaccccggcgtgctcgacccgggcacgggcatcacctacaccagcatgctcgaggcgcagctggactcggtgttctcggcgatgaagaagctggggttcgaggacgtggacatcacggtgggggagaccgggtggccgaccaaggcggagcccggacaagccggcgtgagcgtcgccgaggcggcggagtacaaccgctacctcatcggagaggccagctcggggtcggggacgccgctcatgccgaagcggacgttcgagacctacatcttcgcgctcttcaacgagaacctcaagccgggtcccatcgccgagcgcaacttcggcctcttcaagcccgacctcacgcccatgtacgacgtcggcctcatgaaagacacggtacgtacgtccgtccgtccgtccgtacgccgcgccgccggcgagtgcaatgaacgttgttgcgtaatgcaggggaagtcatcagcgtcggcgccggcgccggcgaagggcggcaatgccagcggcgccgccgtgacgaagcgtgactcggagtcggaggccgccgcgccggctgatgaggcgagtgcgcccgcgccgtcgtcggtggggaagaaggtctccacgaaggccaccgcgccggcaccgtcggacgacggctcggcctcgccggagccatcggagggcgaatcggccgacgagaagaatccggtgcgtgccgcgcgtccgtgctcgacacgatcgacgctcattgtcgccatcaccatgcatggtttttgtggctgccgacactgactgacatatcgttgtgaaactcctttgtggcgcatcttgcaggaggaggaggaggaggaagagggggatgatgccgccgcgacgacgacgccggggggcgacggcgactcgccggagacggaagccgcggtacgtacacgcattattcattcatgatccatgtgtccatgctcgtggactgcatcgaaacgagaccattgagaaaatgagagagatgcacgcttgataatttctctttgccacctatttcgacatccttttgaattttcatagacatatatattcaatttctatagtaatggaaatttttcatggatatcttcaagaaacccttagttcattaactatttttcttttgttgatcttgggcagggtgatgatgctaaagagagcgagggaaaaaacaacccccatggccatggagattcttcagaagctatcagtgttatgttctctgtaccttccatgcttacaattgctctgtctgcaatacttcttcatctctaacttctcctcaactcatggtgtaacaatagtgcaaatactaacattggtttttgccaaacactgaaaaactgcttctgttattctcctctgtgacttctcctctgttctaaattatagggtgtccttatttttagaaaactcaaacttaaaaaaaattcactaataattacattagcttatttatactaagtattatgcatgttatataactagatttatattttaaaataattttatgtgatactaatttcgtaggtgtttgataacataacatgaaataaatttaggtcaaagcatgtcattgaagccagtgtaaacttataatttgggacgagaggagtagtatagtgtcctttatatatactcctatgaaagacacaaatgatggtggtggttctactgccatcaccctctgcccagtgtgacagtgaggcccatatacggtaaatgttagttagacattttacatgccattttatcaattatataaaaaagaaccaggctataaaagtaaaaagaaatctgtaagaaaatttaatatcaactttaaattatgatgatgattagcaatcattttatagctaaccaataaaatttgattgatgaaagtatagtttcatgaatagacaatgagaaatgattttataaagatgaatatctcttttacaactctattgtaacgcatgtgcatttagctagtgatataaaataattgtagcacttattgttaatctattatattttgcaaaaacgataaggtcaatacaaacacacatggtactaagtttgtacatatataatttaattattatcgaagctttcatggagcaattttaaatgcaagccttcctaattaactaaaccatcacaagtttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35082 - DNA, 801 bp, Oryza sativa
  unsure (1)..(801): unsure at all n locations
nnnnnnnnnnnnnnnnnnnnnnnnnnnnnnnnnnnnnnnnnnnnnnnnnnnnnnnnnnnnnnctatttttctaattactgattcgaatttactatttatttaactttgaggttattaattattatatgaaaaaaattcggagtactagagcctggggcgcgccgcctggatacaattcattcattagcagctaataatagcgatggatatccttgttaacagagtatatttagagcattaaagcagagttagaggatgtgcaattgtgatgttgtagtgcaacatcataatagcacataatttggtgtactgaaataaatagatacgtagctcacttgttagtgatggctatgactattgacaggacatgtttacagcaaaatttgttagggacaatacatagaggacaagcaacagtgtgacagcgtaataacataatatgtttaggcaaaagatgcaacagtgctggtgctatgaaagaaggattaagatttgtttgatcagatcaaagaaatatcaaatggtaactttataacaccgagggcaatggtgtactgacaaatgttgcacacccagatccaagtttatggaagtgacctcaatggtccatatcatatctactggctatttctttaaagccacagcttgtataatcgngaatagaataatagaacaaactaacaccttacattatggggatacccagaccagaaatatcaaatggtacctttatacaccgagggccatgacagggaggaggaccacagaggaaagattttatgtcagtagcacagggacttt

SEQ ID NO: 35083 - DNA, 1156 bp, Oryza sativa
tggcgcgacttctgaaagccgaattcatccgtgaggtcatccatccgaagtggctgccgaacccggtgttcgtccccaagcgaacggcaagcttcggatgtgtatcgactacatcgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacatactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaactctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcc

SEQ ID NO: 35084 - DNA, 669 bp, Oryza sativa
ccctaattggttacccaaagaaattcgagtagtatgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcgatgtagtcgatacacatccgaagcttgccgttcgccttgggaacgaccaccgggttcgccagccactccggatggatgacctcacggatgaatccggcttccagaagtcgcgccacctcctcgcggatgaaggcttgacgttccggggcctcccgccgcactttctgccggaccgcccttgcgcccgcccgcacgggaagacggtgctcaatcaccttcttggggaccccgggcatatccgcgggtctccatgcgaagacgtcagcgtttgccccaagaaggagacgagcgcgtcttcatatttgccgtcaagaagaccaccgatccgtgtggtcttggacgggccgtcgcccaggggcaacctccttgaccgggacctcgtcgcctgtgatcatccgctg

SEQ ID NO: 35085 - DNA, 640 bp, Oryza sativa
  unsure (1)..(640): unsure at all n locations
ctacctttgttttcggtttatgcctcctggttggctgggtacgtttgggtaggagattttgcttgccagactcggttaattactgagacacctcctgcccgctgcacatgatttttttggttggatgcggcagatttggcggcactgaggagctccgcggtgtgcaggcacgcgtcgccgcgggcgtcgtggtgcgcagagaaggagaacagtgggcagcgtgacgcggcggcgaggacgacggcgcccaagcccgctcgtcccgcgggcgccgcgaagaacttcatggcgccgacgatcttcgccgccgccgacacgtngtcggccgccggaccttctcttcggcctcaccccgtcggtctcctccgggatggccggggacgagaggcggagcacagcgcaaagtgagaggccgagggaggtgcgcgttcatgacagcgcggcgaggtcgaagttggtctcgtagacggaggtcgccaggcttggccccgccaggcccgacggcgcgtaacggaagcacgcccgcattgccgtttcgcccgcggcagncttcttacttgaaaagagaaagagggagagagggaaaaagagaggagaagaaaaccaacgtgccgctgatcacatgtggggcccacgtgtt

SEQ ID NO: 35086 - DNA, 870 bp, Oryza sativa
gatgaatagcctgtgagtctctgtgagagtgatctcttgcagtgaaagtgtggacagtgtttcctatctcaatccagctgcatgctgggtcttttctcaaaccctgttctgtcatcttggttctaatctccttgacattattccacttgcccatttcggcgaaaacatttgatacaaggacataattacctgggttatctggttccaactcaagaagtttatcagttgcaatcatagcaagctcatggttcttgtgtatacgacatgccccaaggagtgcacaccacaccacagattttggttccaaaggcatagatttaatgaacttgtaagcttcttcggtctgtcctgagcgaccaagaagatcaactacacaggcataatgttcctgccatggttgtaacttgtatttgcttaccatcatatccagataaaatttaccctcatcgacaagttttgaatgactacaggcatagagtagagcaagaaaagaaacatgatcaggagatacacctgtttccagcattctcttgaaaatatatatggcttgcttgccatgcccatgcatcccagtagcattaatcatcgctgtccagagaacaacatctttacacttcgcctcatcaaaaactttgagagcgtagttcatgcttccacaaccagaatacatgtccacaagggagctaaccacagcaccttccacgggaaatttacctctgataaggaaaccatgaatttcctttccttttgtcaaggatgacaatccagcaattgctcccagaataccaactagtgctacagaatcgggttggatgcctgcattcagcatcttgccaaacaaggcaacagcttcatgtaacagcccattct

SEQ ID NO: 35087 - DNA, 661 bp, Oryza sativa
tgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttgcctcccagagatggcacgttagtcatctggtcagatatatgccaggcttcatcctaaccattacaggcaagatgttgtgtgaagaagggcgagcatgtagaatgctaagctgacacgtggtggacaagaatgaccgacgtgactggtctgataccggtcatgtcgtcagcagacagccacgattccacgtcgcaccagctcccggcgaaagtggaggtagttgtgagccgtctcatcagatggtgactcggacgacaactatacaaatctccgtccatttatgaaaaggtggggtaagtccccacaaaaaagagagaaatggtgcatgtggtatccccttaagatataaaaggaggaccttgcccacttagatgggggactggacttttccagattagaaacccaaaacaagggagaggctggctgatactttgtagctccttcatacacagatctcccaaaacacaggagtagggtattacgcttctcagcggcccgaacctgtatacat

SEQ ID NO: 35088 - DNA, 1011 bp, Oryza sativa
  unsure (1)..(1011): unsure at all n locations
tattaatagaaaaagatataaaaaatttactcatgtaaatttgatgtcactagttttatcatttacccaacctctcataataggcatttctttttattaaaaaatctttttttaaataaatattgtgggtcaaagtatcatctcaagactgtgtcagagtctaaaaatacttatatttgggactgatggagtaattttttcagtgaaaaactaaggcaaatcacgcgttgctacgggagcaatgcaagtgggcgtttggtttttgtgaaattagggtggccgagtcagtaagtccccacctgctccaagcaaactaattaagctgattttagctaaactactaggaggccatccaggtcttcctagtctacaattcatgtcgctctctcaaaggccgtagagatatacatcgatacattatacatgcgtgttttcagtagtgaagcagtgctgtgcatgcatgactccgccgctaaagtcaatgggggcgattaaggtaattaactaaccgggttaattttattcgttagattattggatagtttactagtaattgtgtgtataaaaaggaggttctctccctctctctgcagaatgctgtgttaggcaaggtagagtacactagtcccaaggctcgctctcttgcttaagcttgtgagcttggaaaagagtagtatattgagctgttgcttcgcttgctttagtttgcttgcttaccaggagaaagatatgagggtatgtatgtgtaattgtatatggtcttgctgctcatctgtcaatttttctctgtttcatcatcagtgaaaaatctgttattttgtgcaaagatgtaagatttatgtttgttcccgctgctaatcgttacaccgtttgaaaccttttgcagaaggaaattgtcatcaggctgcagagctctgagaagggccacaagaaagctatcaaggttgctgaaaaagtctccggtaaaaattccttgcannnnnnnnnnnnnnnnnnnnnnnnnnnnnnnnn

SEQ ID NO: 35089 - DNA, 7570 bp, Oryza sativa
  unsure (1)..(7570): unsure at all n locations
ttactggatgagatggagtcttgaacttggcactcaagtataactcccggttgatgacaggtgacttctcgtccagttctctcactgacaatggagagcggaaccttctctgctttccagatgatgagcttctgatctgcaaatggaacaaggtagacatatgttcaaattagtaatcttttgtatactgtaatgtaacttgcaagaaactgcttctagtatgtggtacctcgcttgtacaagtgtctacactggaatcctgaccagcttcaggtttcgaggacaaggtggtggttagaggtgacctcgttcttgcatttctcttttcagaggccacacggttcgcgatatctcttagctttgatgcttcacgttccttgtcgtctaatgccaatttcaatttagaaatctgatagacaattacacaccatgagttacagaaacaaagttccgatgatgatcgtgtaacatttaaaacaacacaatatcatacctcttccttcagatctttgacctgcccaacttccttattagcatgagctgcaccaagttctacggtggctacacgctctgcaaacttgagggtactcattgtttcaccaaaagcatctgcttcaggattcatgtggacaaacatcaatgtcttcgcctgaccacctacatcacaagacaagaaaacataatcagctggcattcttgatgaaacacatccaggctcttaagagattctgtatacctaaggcatcttgtagcacttgtgttagcttgctatttcggtatgggacgtgggagctcttttgggcaagtgcagctataacatcaccaagtgcggacagtgatttgtttatatgttttgcttcgtttaatctttctccagcggcctcggacttatccacccgttcacttcccgcaagatccacaagatgaaggcatcctcttagagttgaccccgaagctatctccttgccttgaacatgaactgtcaacacactacagaagagcaacaaaattacagtatgtagtgagtatgcctgttgctcagacgatgaaagaaaaatattatgcaaagatattatactagggagaagggacattctgagaggaagtcgttttttgcattagttttgggatacctgtgtgagcgactacttcgttcattaagagcagtagacccaactgccctgttcctgtggccaactctcatcaaatccaaaacgtcctgtgcacacttcactggaactaaatttgcatctgggatgttcagtccatttacatgagaactgtttcgtatctctaatgtgttcatggttaagaacaaccccggaaggaaatattgttaaacaattttttgatgctgagagcaataaaagataatttatttcatgtgaaaacatatagaagatttttgcaagtaacttcatagaggaaacatcttatttgaaacaatgttttcaatcggcaacttgagaaaaaataacttttgcaaccaaaaggatatcttttgtttgcaccatcaaccatcaatagatctctcacttgctcattgtatatttcgatcatctgaactttcacatcatatgtggtagtatctgctctattttgcgaaatagcaaatagatcattaagtgaccggtagttcacgccccaggtttcctctgttgtaatatctggaccgctctgagtaatatatgcaacaaagatatgttacaacatcataaagaaagaaaaatacaaatagattgaagcttaatgcagacaagtagcatacaaaagagcatctgtttttattattgttcctagcagtaaatttctttattttttttatagtattggattcattgatttgagaatttttcacaaaagtaattattgaaactttagtacatttacttgcaaagaattaccatggtatatgtttttccagatcctgtttgaccgtatgcaaatatgcatacattgtacccatccatcacagatctgatcaatggctgtgtatcagcaaaaacctcagctgttacaaagaaaaaaaaaagtcaaactataactctcaaaataaatatcagccagccctccaaaatatgcaccattcttttcttatgaaaccgtatgcaatttttatcatgcattactcaactaaatagtcatattttcaatgaactgtttaacttttgggataaatgcataactatcttgtaagtcatcactcaattagaaactacaagatggaatgcaattaatttgcagtaaatgagaaatgaaaaaaaatgagaaatgtcgatgatgtacattgtgaagcattaggcccgaatattttgttgaatgagaacatcttccgcccttcctttccttgcttttgagggttcacaatcattatctcaccattctccccaatatgatcaacggtagatctttgatcagtttgcattttcaggaaaggtttcactctacaatatacacgaatgctacctaaaagatgtttcaatttatcagtacaaatatctcactgttagtgaaatgaagttaatttattcgcatattacctttaagatcttgaacttgattgtacagcttacgattttcctcgagtaacttgtggtaagcattgtgattatgagcctcaaaataactttctgcaatattaagcaaatgtttagcgatcaaaggacaaaatgttctaaaacatttctgaatccattactcacctagcctcctcaagtcttcctcccactgagatcgagttgattcaacttgaagcttcatctcgttgaaagacacttttagcttctgcacatttcaaatttgaacagaataatcatagtcagtacaagtacacagtaatacttgttaaaagtattaccaacgtcttcatgagaggagtgtcaaaagtgttattttggttcattgtttcgttaatacttgttagagaaaggttcctgacaagaaaagcatacaattgctagttgttacaaaacacaacatgcggactgacagtgatgtcatatagtctatgctataatgaaataataatattgttgggctttctgtagacattccaagaaataacctcaacagcataattcttgaacagaactttctacctccagctcttcttgttggtgttcaagtcctcctccatcatccaattgtttgcggcgaccacaaggtaatcgcagtgaggttaagaaacactcactagtctccttcatagacttcgaaataacttcaatcaattcctgtttggagtgagcaccattttcatctttcatcatcttccttagaagtgatctgacctgttacatatgatatgtttagaaataagttccataggaatacacagccagcacaaaactgaatcatagaacaaaattgatcaataatcatgacatagttattagtttttgcaattgcttgcggcggggctaccattgaaaattgaacaaaataccctattaggtaattcacaaacaatgaagtacctggtttcgatgggaagcaagcagaatggtgaattctttacaggcttgttcaagtattgtttcaaggacctgaaaaaaaaaatcaccagcgtgaggaatttaacacatttttttttcttttgtgtcaaggctcagcttgtttggtgagagcaccactaaagaaatcaggtggtcagcgaatattatacaataataagtagaacttacctaccatatcatctaagggcaagccctcagcttcaccccattcctgaaggaatgcccgcacaactcgaagcacaaattgctggaaaagtgaatgctgagattctccaactctagattcctcaagggagacttcagacagaaggtgcacaaattccagcatttgttggttcagatcagctgaacctcctcccctggatgaatatgaaggcaacctcttacttgaggatgcaattttcacaatgccaccatagcgccatatgccaatcccaccagagagcttccattcgtggtatgctttgaggcaaagtatgcaatcgacaactttcattgatgaacctccctgcaagtgttcatttatagttcagatttcagaagtttaagaaagtgaacagtaagatcggcataagcttaaaatatataatcaaccatctactttgttctagcaaatttctctgggtttaaagttgccatattttctttatccatgcaatctctcatgaaaataaacttgagtgcgttctgaaattctgtgttagtgaactaaacatcagttctcaatatcacagtttccaaatgaagaactttggcctgctttttggcaaaatgggtgatgaaatacagttctaaataagccatgcaatttagctaaccaggttagtcataatggcagtacagaattgtcatcatttagtaaggttgaccagtccagagttgaagaaatactcctacaagaccgtaccttctctatgtcggaagcttcaaacgtcaagagattcatctcgctaactgcaacaaggaagttcctcatgttctcgaaatactgaatcgcagactgggccgccacatcagacgactgcaccgcaacaatgggattctccacgacctgtccgcaaacgagcactcgttagattccaactctaccacggatacggtgcaaatttcaaaaaaaaaaatgacttccaatccgatcgattttttgtttgggtcttgaactcttaagcaacgcaccttggggacggcgcccgggttgacgtggttgaggacgttgcagaggacgagcccgttgcgcagcgccacgcagaactcctcctccgacggcctctccggcagggactccgccgccgccgcctccatctgccgcagccatcgcgccgcctcgcacctccgcgcggctgcggcaacagatcacaacagagtcagcggaaagccacatcggcaacaggggcagtttgcctcgcgattcgtgcagaagatgaacatggtctctccccccgtgatgcagatttactttttgaattctgagtcaatcggaaacagaagaggcggagattttggggatcctgaattcgagctgcatttctttttccaccatgctttgcgcgattaccaaatgaccaaatgcaactcctgattattgattaaaccgacgagaatgtcgcgtgtactactaaatgcatctcaaagttaacttcaaccaaacgcaaaccacccaggtcaatgctcaatgcttcaaccacactcatggcgcatgcaagagtcttaccatatgcaggagccttaattgcaacaagtagcgcactaaacaaatcacaccaatgatctcaacccaaatctcgcacgctgccaccgcgcatccgccgacgcggcacgcgcgccggagagcaggcagcacagtacaccaggtgaggtgaccgcccgcgccgccgcgtctcgcctcaaacgccatccaatgatccagacgccagcacacacacacacacacacgcacagcacgagcgcattgcaaggcgcagatcgcgcgagcgagaaaaatgccacacccgagagacggggagagggagaagagacgaacagctgctcaccggattcctcggccttgcgcagcgccatcccctgatcgtgcctcccgccctccgccgccgccgccatcgccgccgcgactcccgagcgagctcgccgacgtcaccgcctacccactcagatcgcacgcagctctgcttcccttctctctccgtgtggctgctgcgcaagcgcaacggctccctctatttgaaaaacttccggggcccgaggaagacggtgtggccgtgggccacgcggcatccacgaggcaaagcttttcaagtttcaccccccgaactcgtaggagtaatattttgaaacttcagggggcaagccgcgaagttgaccgagctgcatcgagcgcggaaagataggcagaggtgcacgcgtccatccgctgcgggaggccggcgcagcaacagcgtcggcggccgacgggatcgtcacacgtgtcaagatttggtcatcggagtggctcagagcaaatacaatagcagactattagctagctatataaacatattttattaagatagaatatgagagagaagattagtgggctacatatttgtagccagctgcagcacggacttcgagacgtaatgtatgtatgacaggtagaaccatatactaatagtataggaaacaactattttataaattggttattagattggctataaatgaattggacctagacacttagcagtgggctatactattaaacttgctctcatgatttagaaatgggttgtgctagtcttaaaatataatccgatggaacaatataatccgatggaacgttttctaatagaagtaatacatatggttgtgtttagttcctaaaattatggagaagtttgggaaaagttggtagtttagaaaaaaaaattagagtttatgtgagcaggaaagttttgaatgtgatgtgatatgctggaaaattgggagtttgggaaaagtttggtgtgaactaaacatggcctatatatataaacctctatatacattttatattttgtgcggaagagtagtatggatttgctatttgggccagcgcatgtggggggcacagtagggtggtggagtaattactgtactggaggttttttttttcccctgtgagcccaggagattcaaacgcttgttgagttgttgttcggcttgtctttaaccttttctttattgtctggtttttatggatggggttcaaacggttcgatacgtttagatccggcatgttgcaggaccgtggcagtggcagcctttaattatttagatgatagtagttttgtaatcgtacgttcgtgccgttggtacattggctcattggatgattttgaaatgagggtacgaatttggcgtagttctgttttggttcctgcacttcaggctgaacttgttgtccactgttccaattgttagcgtgcatgaaactcatcacggtgaacttccttggcaccccaaattcacccgtggaaacattttttttttaaaaaaagttagattactcactccatcccagaataagttcacctagcacacgatgtgacatatgatattactatgaatatgaacatgcagatatgtcacatccatatacttattttgaaacggagggagtaaggatttgccattgtcttcatctcctttggagaactcgagggtttgtatgcaatgtacttaagtatgtgcacatctagcttatgcaccttatgcactacacctactatttggttgatgcctaaccttattatactaaacttaggcaaattactaaattagggtatgatgacgtaagtgtggctacgaaatagttgatcacaaatgtggtatggttagctataatccatctgccatccaccgattggtcgagctcggaacgtaaaccacacacgcacggcgctggcgcggggcacatggaaccatagcacgattagcccggacagccgcccatactcatcgaagaaaacttcattaaattttaatatttttgattnnnnnnnnnnnnnnnnnnnnnnnnnnnnnnnnnnnnnnnnnnnnnn

SEQ ID NO: 35090 - DNA, 9067 bp, Oryza sativa
  unsure (1)..(9067): unsure at all n locations
nnnnnnnnnnnnnnnnnnnnnnnnnnnnnnnagcacaccacatttgacagcagcgctgatttgtgaagaaaaaaaagagagcgaacaaataaaaatgataagaagagctacaagatcgagcagcagctgggccgtctcccggccctccggcgccgaccgccacgggcaacggcgccgtggtcgtgccgctccaccatcggcgagtagttcgccgggtggcttcgcgccacggcgaggccgtcgcgcacgcccaggccgccgtagtagtacgcgttcggggggttgcgggggtaatagagcgccgcctgcggcgaggacgacctgtactgctcgccgcccggccaccgcgcggcgccggggctcgccgcggtggccgtcgtcgtcgtcgtcaccgggtacatgatgcgccccacaccgggcacgctccggccgggagtggcggggtgcccgtgccagccgtggtacggcgacgactgcgcgaacacgacggcgccgccgcccttgccgttgcgggcgccggccgccgtcatcagctgcagcgacgccgcgcccccgccgccgcgggagccgccggcgtccagcgtgcgcagctccagtatctcggcctccccgacctccctccgcagcttcttggtcagcttgctctcgtccacgccgtcgccgatcaccagcagcaggtccctgtccctgccggccaccgtgaccgactcgacgcctggccattttttcacgagatcgccgtgttaattaacaaaacgttttgcatttctgaagattcagaaagctgcgtacgtaccactgactgcagctgcgaccttcagtgccttgtgatggcatttgtcagagtccggcctcatccggatgatgatctccttctgaaaattttttaccaaaaattcaggtgttagcacacacatcacagataactttcaaaacagacaaaaacagcagcagaaaattggagctagatgaggccttcttaccatggttgttggtctttgcatgttccaaactgtttcaactttttggaagaattttcagaagccaagccaataatagcttgtaactgtagtggaggaagaaacaaaacgtctttgctgttgctgtaccgtgtacacagaatacggacaggacgtgtactgctggcgaccagtcatatatatttcccgagcaaaggagaagtatttttattttctgttctttttattctggtcagaccagcaaactgacaaccgctcgaagactctcgtggcaagaattaatcgccggtttataaaatcttcagaaaaaaaagaagtgttgcttcagagttcaggtagtgagtgtacattcgtcgaaatcacatctcaatccatgcagattagtttatctagagtatccgaaaatgttacgctactgaagcaagtgacgtacgccattttcttcaaagcaagaagcaagaaatatatatatatatatatatatatatatatatatatatatatatatatatatatatatatttaaaaaaaaggtatggtgagttatagtgactagtgactagggcacaccaagcagagcaaagaagaaaatttctgcattgtgcacttaattgaactagtggactagtggtgcatagccagaaacgcaagaaacaatcacacggggttggaaatttatatgttgacctgaaagacaatgctgctgctactagggaaagaaaacagttcctaatctgggggtttcagtcgttactcacttgtcagagcagcacatctgggacaagatacctgctctcgttcacggctagtcaatccatttggctcattttccatcagaccatcgatcaatcgatgagacccaacaccaaaattcgttgtccaccatttgccatattttaaggctatctttggaagatggatttctgtagcattagaattgtgtgtaaaataataagctcagccatgtctaaagaaagtattctgtcatagtccttgctgcatcccaaagaatacgggacatctgtatgtacatggtatagtccgccgtgcgagcttggattagaaagactctcggagcagttgagacttgagaggtactgatcgtatatatgccacggtccactggtcaacaccaaaccggccggacgtctgcggctggcgtaagcgatgcactgtcacgagcgcgtcatcactttaaacgcgtttacaacgggaaaacaaaatggcggcactactgatgagtgatgaatactcgctccgttttatattgcggtatttgtaaatttgccactggttttttcagttttacgaggatgccacttaaatgacagtttcagtagtatttttataattttctagtggcagttttacaataacgattcaaagcaatggtaaatttacaattgccttttttatattacaagtcgttttaacctttttcttagttaaatatttttaagtttgattaagtttatggaaaaatatagcagtatttttaacacaatataaacatactatcaaatatattcaatgatacgtaatttggtgtgatagatattactagatttttattataaatttactaaatagaaagaaatttgattaaaaaaaattaaaacgattataatataaaatagaaggagtagtagcgtatagttgttgtctccgtatactatgtgttaactcgatacgacatttatcatacggagttataatatacggagtatggaataagtttaatctcctgcgggacgactctagaggatccccgttattgtatactcctaggtgaatagacaacgtcatcggtccagtagtaggacgacgacgtctatagtaggactggaggactcggtagcagaacaaccacagaaaccaaaactgccagcagaattgcagaaacaacgtttgtggccagacctcaacatatgaacagatatatatcacggagcagaaaccgacgtagaaacaaaaacatggaacatgtggagataaaatataaggaaagaagaaaaagaaggaacaacgggcgatgcacatatattccgtcttggatttcattagcacgttttataaactgctaaaaggtatgatacgtttcgtgtgaaaattttttatataaaagttgttctaaaatatgaattggatccactattttaagttgaaataattaaaacctttgattattttctaattaatttttcgttttacatgggctgcttgccaagtttagtttcaaatttttattttcatacttttaactttttcatcacatcaaaactttcctacacacacaaactttcaacttttccgtcacatcgttccaatttcaatcaaacttctaattttgacatgaactaaacacaccctatctcaaacacctatggttgcatggtgcttgttgcaaacctttgcgctttctatctaaaaccaataagccgagccatatatgggcaaaatatgtgatagaaatcacatatatagtgcaaacttggaaacttccgttggataaaaaaaagacattgaagattcgtccacgtcaacacgagtaagaattgtactcacggatttattcatgagtaaaaaattttatagcgagtaaaatttttactcgtgatgacatgaatgaattttaaacgttcattttatccaacgttagttttcaggttccctccacctcatattttcccagatggatgaatatgagaactgtcactgtcagacatcgatatccatatatgagatgagcatcgggtgatcactgctcagcacattctattccctccgtcccaaataaaattaaccttaacatgaataagacacttaatagtttaacgaatcttgatatatattatgaaatgtttcatccgtgctaaggttagactttttttttctgtgacggatagagtacgtgttacgtcacggcaagtcgatgcgcgtgatccgatcgacgactagaggagactaacgtacctcttgatgcgctcatgtgtttgcatttttcgtctttaactgttggccactgtcttttttctccatgcctaaaaggacagcaacaacgaacattaatggtagctacagtataccggacgctaacgaatacaaaggattactgtagcaggtacatttttctccagctataatactatctccgtttcaggttatagacatggtttatatgggactaaaacttttaagtccctatcacatcggatgtttggacactaattataaatattaaacgtagactatcaataaaatccatccataatcttgaactaatttgcgagacgaatctattgagcctaattaattcatgattagcctatgtgatgttacagtaaacattctcaaattatggattaattaggtttaaaaaatttgtctcttaaattagctttaatttatgtaattagttttgtaagtagtttatatttaatactctaaattagtgtctaaatatagaggctaaagtcaagatccaaacaccacctaagattttctagtattgtccatatatatatatatatatatatatatatatatggggcaacatatcctatgcacacaggccctcacgtgtatacaggtgcacgccaactaaaaaatgtcaccaaaaaatttagaaaaaatcatacacatactttcaattgtattacacctagggttaaaatcttaacgtcaaattcattatattttagccgtaacaaaaaaaaatctgacagttttaaggttgcaattttgtcagaattttattttttttattctctatgtagaatgaatttgaagatgcgactttgcacgtagatgtaatattattgaaagtacatgtatgaatttttctagaattttttgtgataatttttagttggtgtacatggtgtgtacacgcgagggcctgtgtatgaatttttctagaattttttgtgatatatatattaatgaatgaaacagaggaagaggaagtactagttacgtatatctttgttgtagttcggatgatctgtacatatgaactggcctataataatgattcagtccaacggttcggtgtcagcttggccttaaaacattcggtttggttagatgtgatagaacttgcttatttaggctctgtttagttcacagcaaactttttctaaacttctaactttctatcacatcacattacatccaaaacttttctacacacataaactcagaggaagctactcatcggacgtccgatgccccaaaaaaatcggatggtcaaatgtcgcagttgaccaacaagtgaatcattaagttatatagggtgaaacaaaaaaatcagcaactgaaacatttaaatattttatgaaacatggtgaagatacacgttgtaacatgtcgttgtcacgtatgaaacaacaagtattaacggattgaaacatgtgtttttcttttaacaaaatataatcatgcgatatcttgttgtaaagatttcattaaaacgaatacaatggtgtgatcggatcatggattggataaataatttaagagaaaaatcattttgaagcttgctaaaatacatgtatgcatgtgtgtatagatgaggtggagagagagtagtagcaggtagttttaggaattttatgaaacacactaaagacgcacattgaaacatatcactatcacgtatgaaacattttattttaacagtttgaaacacatgtttttcttttgacataatataatcatatgatatcttgttgtaaagatttaattgcaacgaatacaacggtgtgatcggttcgtagatcggataagtaatttagaagaaaaaatatttaaagagaggaggaaaacatgaaaagaaacagatatgtatgtatgatgcagcgatagggtaggcgtccgatatttctgttttcataaacttctaacttttttttccaaactaccaactttcctcaaacttcttcacaatttcagaaagtaaacacagccttaatttatatttttcgacttaatatgagtgttcgtatttatggttcttttattagtatcacgatttgaatctgataaatagaattatacacccacgattttaaagcaccacacacacggatagtgcttctccgtatatagttggggggcacaatattatacttggagatggtaagatttagggaatatattcccagcaacaaaaaagatttagggaaaatataaatttgctcttcctttttcatagcaacgggaaaaacttattttgagagaaaacacttttccagaacgatgctgccatacagaaaataatcttattagaccccggtcttacatataaaacctagggtctcatataattattttccggtgcgtaggatatattctataggagcctaaccgttcgatctgcaagtctgcaactatggacgaatcaccaagcgagcgtgcatatgctgccactattgtatcgtgcagcagcttggcacgctacggcgaagaagcttgcggcgggagcagcagctatgcgccgggtaatggccgccgcggccggcgtgccgctcgatcaacggggagtagttcgccgcgtggctgcgcgccacgtccaacgtgtagccgccggccaacggcgaggagcggtagcatgggctgggatgagcggagtacgaggccgcccagctgccgccgacctcgccggcgcccggccacagcgccgccgccggcgcggcgtggctggcgaccaccgagtgggcggtgacggggcatccgacgcgcgcgaaccatggcaagccgccgtcgcccccaacgaggccgtggtaccgcgcccgcacggcgtcctcggtgactgcggcggcggctacgtcgacgggcggcacggccgtcgacgacgacgtggtgagctccactatctcggcgtagccgacgtggttcctgagcctcctggtcagcctgctggcgtccaccacgccgtcgccgatcaccagcagcaggttcctctcctcgccggccaccgtgacagactgcactcctgctcggccaacgcatgcgtgccattcatttgcaaggaaacgatcggatcaaactcgggaacaagaagaagaagatcgaagacattaccgttgaccgtggatgccactttcaaggcttttgatcggcatctctccgagctcagctgaatccagataagaatctcggtctgaaacatcagtgttattaattccgtcgaattaaaccattgctagcacacgagacatactagcacgtagcattagcatgcatggaaattactagaaagtaacagagcttagtcgcccataccctcatggaagtgatgcaaatatacaactgctttattactaggagccaattgaagggattggttgctaatctgcaatgacagagtaaacaaatgtttccagccacctttcaatggtacagtagtactctactttacatggtaccgacaatgttttgtacttcttgcaaggaccagtgcacactgctcacttgctcagtgacatatataggccgagttggcgcttgccacgactatttgtcctttgtactgtactaacttagaccacggaaagcctagttttggtggtagcatggaatcaaaaagaaatactgtacattttcttcctgagttgaagagaagtccagacttattctaagggtcccagtctgttaacagtgaaatttggttcgattttctcgtcaacacagtcccagaaaacggccaaacatgacattgtgccatttttcaactaattagggctcattcggtttataggtcttccatatgattttttttaattaggattgacaattcctttgaatttttcacttttcatgcattcagttcgctggaatcccgtgtaggaatttcggaggaatactgtaacaaccatgtgaaaacataggaatttcttaggattcaaaacatctacgtactccaacctcattttttggttaatggctggcatagagtgaacgctaattcctgcgttttgtatattcatgtattccgaatgctcaatatcaccaaattccaatgcttttcaattatatgttttgcatatatgtatcatgtgtatttttttctatcgtgtgtcgttccgaatgatcccttaataggcaaccttgtttgattccatttcagttccttctcacagggacaaatcacaacttttaatttactgtaagtgttggcatgcatgatgccatcatttccatagtttgttcaaccgtggatttagataacttgcattactagcacacaaacccaatggggccggaataggcagcgttagtcaagactatcactgctggttgctcaatcgaccgtgatgtccctcatagagaacaaaaaccaaaaagtaaaaggaaaaaaaaaaaggcttggcgacgatcgttgagcctttgccactgtcattgttgttgcaaagccacaactgcggtcatggttgtcgaagcgcggtcattatcgtcattgtgctacccaccaccgagacaataaacccttacgatagggagtccgggcatgctatatctaatattggggtggcaatggcacgtgttccctagtctccggcactttggagcaccagagatcgcccggcaaagaggctaatgatgacaccaatcctagccaccttgtagccaaaattgtacatggaagacatcggtcagcgaaagaggggtaagggagcaaagagcaagagcagtggtgtcgggacggagagggacaagagaagaaagtaggagcagcgactcgctacaaatataatagccagatttcccggccgagtggttgtgctctctacatgcgtagccttgacctacttgctgtcaccggcaaatgtggaggctactagatagaatggtggtatcgggtacatgtgaatatattttgaaaatggaaatatattaccattctatacttcatttttaacaaatcgacttgtttcttatcgtttaagctatggttaataagccatggaagaatgagcgaagaaaaaaaaacttatataattgtatcggcagtttaaatggcaatataaaagcttagaatacaatgaaaaacttcaaatcaactccatgattaagttgtaaaaatt

SEQ ID NO: 35091 - DNA, 7163 bp, Oryza sativa
  unsure (1)..(7163): unsure at all n locations
nnnnnnnnnnnnnnnnnnnnnnnnnnnnnnnnnnnnnnnnnnnnnnnnnnnnnnnnnnnnnnnntgttggcatgcatgatgccatcatttccatagtttgttcaaccgtggatttagataacttgcattactagcacacaaacccaatggggccggaataggcagcgttagtcaagactatcactgctggttgctcaatcgaccgtgatgtccctcatagagaacaaaaaccaaaaagtaaaaggaaaaaaaaaaaggcttggcgacgatcgttgagcctttgccactgtcattgttgttgcaaagccacaactgcggtcatggttgtcgaagcgcggtcattatcgtcattgtgctacccaccaccgagacaataaacccttacgatagggagtccgggcatgctatatctaatattggggtggcaatggcacgtgttccctagtctccggcactttggagcaccagagatcgcccggcaaagaggctaatgatgacaccaatcctagccaccttgtagccaaaattgtacatggaagacatcggtcagcgaaagaggggtaagggagcaaagagcaagagcagtggtgtcgggacggagagggacaagagaagaaagtaggagcagcgactcgctacaaatataatagccagatttcccggccgagtggttgtgctctctacatgcgtagccttgacctacttgctgtcaccggcaaatgtggaggctactagatagaatggtggtatcgggtacatgtgaatatattttgaaaatggaaatatattaccattctatacttcatttttaacaaatcgacttgtttcttatcgtttaagctatggttaataagccatggaagaatgagcgaagaaaaaaaaacttatataattgtatcggcagtttaaatggcaatataaaagcttagaatacaatgaaaaacttcaaatcaactccatgattaagttgtaaaaattgaattttattggccgcggctaatgagctaaaatagacgacctgccaaattcggtcatcgcatgacactctggcgaattgcattgcattgcattgcagtcagtcagtcagtcatcagccggtcaccgggctcgcgcttcttggtgccactgggaaagaaggcgccaccgtccctcataaatgctcatgcaacttgcgagagacccgttcgaccgagcaacatcatatctcgtcgtcgtcgcgcgccgtcgcgctcgcgcaacagcagccactgggcggttcatgccaatcaatcaaaatcatgtacgccgtgacgccatgcaaggcctactccgcggggcgcgcgcgcgagataagctagcaatgcaacaacgtgcgtgcgaactcaagcaatgtgcgtactaacatcatgtgcttgcagtatagtagtaggggggggggggggtgtttggatgcaggggtgtaaagttttggcgtttcatgtctgatattacgtaggatgttgcacccggacactaataaaaaactaattacagaatctattagtaaaccacgagacgaattgattaaaccgtcattagcaaatgtttactgcagcaccacattgtcaaatcatggaacatataggctcaaaagattcgtctcgcaaaatagtcgcaatctgtacaattagttattttttaacctatatttaatactttatatatatatatattcaaacgttcgatgtaactggggaaaaaaattataggatgggatctagatagaagcctaaaacgtacgtacgcgcgcaagctaggcgacggtggcgactaccatgcgcgcggccatctggatatgtactacagcctatagctagagacgcgcgcgtcaactgtgaccaagacgtaccacccctcccgtcgcgccgtgcccgtacgtcgccggccggccaggggatcgatctacttggcccgctggccgcgcgcgcgctgcgtctagatacctcatggcgagcttgcattattgtcgtcgctcgatcgactaatcagagccatgcgcgcgcgcggggccggggagcggagcacgtacgttcgtggtcttgtgccgtcgtcgtcgatcgatcgcgatcctgtcgtcgcttgatatttggctgatctatctgcctcgatcgatcgatctaccgggaaattgtgcattattagcgatgagttcgagagacgactcacgactttgactactacgtactcctactacttattaatcgatcgatctacgtgtggtgtgtgtgcaaggcgttgacgtaggcgtgtgcatgcgcgcgcgcggccggggtcgtcgtctatccatacgtacgtggcatatgatccacgtgcatatggatatggaacatatgggcggccggatttgaaggagagccaagcaacacatgcatcgattatggcaatatatagcatgcgtgccatatatacagaacgaggggggtcgaggaaattgtcatgggagaaccgaacagactagcttaataattagctagcatgcagcccgcaacacaaaactttgttcatctagagccatccttctagagatcactggcttggactaacagtttactatcggcttccatctgtattctccatatgcattcctcttgttaactagcaaatcgtacttgactttggggtgattgctattttaattagcgcacgtgcgttctcagcacgtatttttctaaatatttcgttcaaaaaacttttattatttttcaaaaaaagttgtgagttgtgaacgcacatattatatatatatatatatatatatatatatatatatatatatatatatatatatatatatatatatatatatatatatatacacgccaaaaacatatagtctactagttataagaaccttaatagtactttaggtcctgagttcgactccccatgagagtgaactttccaggatttaacggcacagtgctgtcagtagcgagatgtctgtggtgactttgtcaatcttaaggatttgccagcccaatctttgaagatgctcatagaagcatgcactactagagaagtgatctttgctggttcaggcaagcgcctgtggtgacttcgtcaatctcaaggatttaccagcctaatcttcgaagatcctcataggagcaggcactactagagaagtgatctttgctgggtcaggcaaaaatcacaatagtcccggttcgaatagtcgaaccgggagtaaaaatatcttcactcccggtttctttgctgggtcaggcaaaaatcacaatagtcccggttcgagtaggaaccgggagtaaaaatatcttcactcccggtttctttgctgggtcaggcaaaaatcacaatgtcccggttcgagtaggaaccgggagtaaaaatatctttactcccggttttaaagcctatgggtaaagatggttcaataattgctaggcccctaagggcaagtactatgagcctctacacattgtctctaaatttgccacataagattagatgatgaggtggaggagagaagttaggagagagagaatgagccacccctcatgcaaggggcaacctctacacaatctccaagaaaagtgcaagatgatgtgagagtggactaatattggggtttgtgtattagatgtgatatattgtatgtgttgcctcttaattaatgagaagatgacatgatctaaattagatgtggcatccacctccactataaaacttgccctaatgagcccctaatgagctttaattctagttgatgttaccaaccgggagtaaagatagacggttgatcataccaaccaggagtaaccggttcaatacttgctaggcccctaatgagctttaatccaactaggagtaaagatagatctttatcccggttgatgataccaactgggagtaaatatcactaattcccccgtcatccccctctctcgctctctctctcgccttatctcctcgtatcgtgcgcactcagcctcctctttaacttctttctactcctccactccgcctcctcctctcttatccactcctctctttcttctttccttatcttctttcttactatcttctcttcgtcggcgcagtcaatggtagacgcccgggggcgcgtggggggcagcagtaggtggcgggcgcgccggagggaggcggcgagcggcgggcccgccttagggaggcagccggtggtgggcgtgcctggatgggaggggattgatgattttttttgataattttggggatgattttgtgatgtaaatttgtgaatgatttttagatgtttttgtgaatttgttgatgattttgagatgtaaatttgtagatgattttagatgtttatgtgaagttacggatgaatttgtgatttcaattcatgcatgatttttgtgatgttttttttttgtgtggatgattttgttgttgtgtttggtgcgaaatcaatattcaagtagaaaaaacaattaaaaaaagaaaaagaaaagaaggtgacagtcacatggcgctaatatttttactcccggttggtaaccctaaccaggactaaagatggacatctttagttctggattcaggatcccggtttgcaatccgggagtaaaagggttgcaaaccgagactaaagcccacttctcgagtagcgagggtttacgtgcatatattcataggggtgagtgtgcgtgtattgtactgtgtactaaaaaaattttgagtcagcgtcgtctaattggtagtaattaatttgttcgtaattctccgtaatcttcctatctgcgacttgctgaagtggatcaaaaatcctactgggcgcgctgggcgatcagggcgcgatcctccctcctccacgtggtttccttttttggcaccgcattactttcctattttagtaaatttatgcacctaaagtttgtacaccttaagtttacacatctaaagtttatacacctaaagtttagagacccaaagtttataagtcaaaagtttatatatcagatttaaatttgaatttgaattcaaatattctttatatatagtatttctatacatttaaagtttatacacctaaagtttatagaaccaaagtttataagtcaaaagtttatatacccgatttaaatttaaatttgaattatatacgattcaaatttgaacttgaattcaaatatttttttatatagtatttctatacatctaaagtttatacacctaaagtttatagaaccaaagtttataagtaaaaagtttacatatccgtttcaaatttaaatttgaattcacatattttttatatatagtattttatatacatattttttctaactttatttttattttttttaaatttatggtgcagtagaaaaagaagaagaagaggagaaagagagagagagagtagcgtatagggggatagggggtgatcgagcggtcacccgtccgttagccacacccgaagtggatacctacatcgtacaggggatcgatcgaattaagatagatttatgtggaagcggacaaatcaactaccactactaataaatttgtttgttttggcgttttgggagatccggagataacgcacccaccaaattaacctgtgttgtcccctgtcagatgccctcttgccggttaaatttgtcttttctaataggagtatctagttgaggggctaggatcgatcgacatgtcatctttatctgttagcctagtttggattatctctggtgtgctttaatagcatgtttatgagatgaacaacatggcgccaatgttaaattgttaattagacatagataagcatcccacgtatgtaaacattattctgagtaaggggatcatcccccattaaatcatgcttaaaactagtgaaattcacactttttttttgggtggggtggggtgggggggggggggttggttgtggtttgtaaagcgtagtaagcaaataccgtagttaggttcgtgtggcatattcctgtagtttagacatacatatgtgggtctgccattctttgcttgtcgccttgtcggttacaattaaaatttaaactttcaagcttaatcctaattttatagttaattttaaagtttaatttttcattgcttttattttttaagattagcttttaaatagttgagaacacacacatatataattatccacaaactatttgttgttgttctattcatttattcataattattaattattcgtgtattactccctctatccctccccaacaccaccacacacatttgaaaaagatgcaattgtaacattcaaattttatatatcaaaaatgcaattctagagtactaccttctctcaattttatatatctatgttttcttcattacaataaaccagcgtttttctatctctataatattgtatagacatttttaaaagtacagcaagcaacttctggttggcgtgttttcattacgcaaatgaaaaagacatattataaaatatcttagactatgaagtactttattgaaaatgatttaaaaacgccttcccaagaaggcctacccatatgagattattatcgtgaaattgtttgctgatgtagacgtagatattttaaacatacatattctcatactcttagaagttagaacatcagtggttgtacttatacatgtgttcattggtgtaactagactcgtcactagtagtaactatccctccatttttaagttatatgacgttgttgatttttaaacataagtgttggcgtttatttctgactaacacggactcacctaaagatttatggtgttaacggagtcgtcaaccatctcgatatagaaaactctaacctaagatgggttttgaagattaaacaagctagagaagctaatttagagatcaaaagcagcctttaggccgatttaaatcgatttggagataaccaccctgtcagggttatggataccacatacctaatagtagttgactaaatctcggcaggactgtagcgcccgttccgtcgtggcgcctagcgggaaaattatctcttaaaaaccctaattgcgaaatttgtttctttgctgttgtctagtgtctgtgccatctcagatctcaaatccccgatctatcgtcgagttcaattccgaatccaatccttccaaatcaaattcctccgcaaaagtctatttttcctccccgg

SEQ ID NO: 35092 - DNA, 1462 bp, Oryza sativa
gacattgccgcccttaaagccctggcgccctccctctcttctcctcccatcgtcattgttgccgccgtcttccgagctatgtctcgcctccgccgttcatcgccaagcgccgggagagccggtgcgttcgtggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctctcctcagttttcggtggtagcacgagtagcctccccgtagctagccggcgccgccccgaccgttgccgtcgctcgccgtgtgctcgccggcatcgccgcccgagctccgtagcacccgctcgtcgccggcctcgctcggcgtagctccgcccaatccgacgctagcaacggattcccgtagccgcgtagatgctctctccgccgggaattggcccctcgtgacctagtcgccgtttcccccttttctctccgccggttgccaccgccgcaatccgccggcgatggactccctccggcgaatccaagccgttggctcgctccatctcattctccctcgtcatcccagtgtacgccccgtcgcccctcatcgtcgcaaggcgccccggagaaaccgccgccgcccgccgtccattcgcggccggcgccttcgtcttcctcccgccagcccacgtggcagccacgtagacgccacgtcggcgccagctcggccgagatcgggtcgggccgaccccggtcagcccctcccgtgcgcgtgttccaccgcgagccgtgaggctgcgcgtgggcccgccgcatccgttcctccgcgaaccacgcgcgtgcaccgcgtcccagccctgcccgcgcgcgtgcgccgcgtgctcgctccgcacggtgaaccgagtcaccgacaagcgggtcccacccgggaccgcgcgccgtgagcccggtccaccggctctctctcctccctcccgcgcgcgcgccttgggccggccggcccatttagctcggccagaccgccccaattctctcgggccgcgccctagccaccgaggagaagtctatattccctccctcttttcttttcttttcttttcttttccaaaaaggatttaattaaatcctttttcctttagaccaaaaatccaataatcttagaaattcaatatcttcccaaccgtaaatccgtttgactccgtccaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctagatctcgagcaaggcaagccacctttgaacatcttgagcctatatttgaaatttaattatg

SEQ ID NO: 35093 - DNA, 9357 bp, Oryza sativa
atcgcacttaatctgttgtcccgtctgcaaggcagattggcggacctacctaatttgtttcatttgatccttcctttgttaattgttatatcatgtccccttgtaaccatctagttgcgtctcgatattcgtgcaccctgtgcgagtatcgacggacgccttcaaaacttaaaatctgattaacaacttgggtaaaacttgggttttacaaaagacttggaaaacccgacacctgggtcggtgcttgcgaactaaatgaatttccaaaactgcggaccggggaacgtaccgggtgtacggtttcccgctcttgcacttaaggaccgtttccttggaatttcatccaaacataagacaagtacgatcacatgggtggaatgggacacccctggctgagtaactagcttatcaggggagccttgatgccgagagacatgtggattcgccggggtggtgtcggggaggacccctgggcttcctggcacagtatggtctaggacctaacctgttgttggtctgggacccctctcgtcggcatatggtaaacctgtgtcggctttggaaataccttgtcatgaaagcctggaggtctcccgacgtggctgatccccacgggctgggtgatccgagttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattactgttgaggaaaggggttcgatgtttgaaaaatctgcagctgatgtgatcagctaggcccgggtggccgtttgaaagttgttggcccgggtggccgtttgaaaagctattggccgggcgccaaccttgtttcaattctaaggactgatacattgcacatactccgaccggacgagacgcactgtctcatccgtgtcgtttgagaagcactcacttagttgttttcagaaagtagttcaaataaaatttattgcaaaaacaacagcctttctttgaagcctgcattaaacacttatttcccatggcttgctgagtactcccgtactcacccttgctctatataaataatcccccccagttgctgaagaagatgaagcggaacctgctgatgaggagttcttccaggagcaagccggcttcgatgagttttagggtttcggcctagttcccaagtcgtgcctgtgttgattggtccaagtcctggcttccgttccccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagtccggggcgtgacaaggacccaccacataccatgtcctatacggaaacaacctgcggatctaggaggagttccggataagaaaagacaaccagagttctacatggaaaccacaaggactactcggattgtatccatattggtttccctagttctacttggacaatgggacacctatgtgtataaatacaaggccccctaggaggagagaacacacaatcaacagacaatcaacagacaatcaacacccaccatggaaaacacccaccatagaagaaacgtacaatagatcaagacacaagatcaacatacaagccaacatacgccaagacaagacgccggatatcgacttcagggataagcacagctagtcccctacggtgtctccggatactgtcaggagagacgaaagcgttatctctgatctcgccgggcacgaacttgaggaggaagactaccctgttgtcgactacgagtcagaccttcagaccgccatgtcgacaacagttagataggctaccccaaatattacactggtgtgattatgtaacgtcccgccttcccccaggccgggcccgcttatatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctggagttctttggagattggcttccggaaaaaaagttgcaatttgttgatatgagtattctattaatcctattaagccctagagcgggatgttacaccctcacccccttaagagagatcgacgcccccgtcgatcaaccctaggccaggaacgatcgacgcccccgtcgatcaaccctaggccttggccacgtccatgtgtccagtgccagcgcatgtgccatactgtgtaaccactcccggtctacaccagccatgcgcaccatgcctgcgcaactgcgacaaacgcgcccgtgaaaccgcgagagtcggctctgataccattttgtaacgtcccgccttccctcaggccgggcccgcggtcggtcacccatcccaaattgctccaagccgagcacgcttaaccctggagttctttggagattggcttccggaaaagaagttgcaatttgttgatatgagtattctattaatcctattaagccctaggccgggatgttacaccctcacccccttaagagagatcgatgcccccgtcgatcaactctaggccaggaacgatcgacgcccccgtcgatcaaccctaggccaggaacgtcctctcttggccacgtccatgtgtccagtgccagcgcatgtgccatactatgtaaccactcccggtctacaccagccatgcgcaccatgcctgcgcaattgcgacaaacgcgcccgtgaaactgcgagagtcggctctgataccattttgtaacgtcccgccttccctcaggccgggcccgcttacatctgatagctttcataggtcatttttgtaacgtcccgccttccctcaggccgggcccgcttacatctgatagctttcataggtcatagactgccctcacagaccaacacatatcttttccgccttccctcaggccgggcccgcttacatctgatagctttcataggtcatagactgccctcacagaccaacacatatcttttctgcatactttgtcctcactcgtgtgcacccgggaagaatttcccggtcggtcacccatcccaaattgctccaggccaagcacgcttaatcctggagttctttggagattggcttccggaaaagaagttgcaacttgttgatatgagtattctattaatcctattaagccctaggccgggatgttacagattatggtgaataagagcaataccggcttcagccaacaggatgtagggttattacctgacaattcaggggcccgaacctgtataaaaatcctcgtctccatctcttttacctcagtctcgcatatatcctagtaccgacgatccccataccatgtaaataccggaatcgcgacatcaaacgtcgacagtggcgcgctaggtaggggattttggtgcttcaggatttcgacgatatggttttaagagatggattctccaacaacaagctactcgatgacttcggctgagggagagatctaatccgacccgagtatgtcccccgacaagatcagaatcatcgccatcaactactcgatccgacgagatcgatcaagcttcgaaatgtcgcagcggcataggaccatggtatcggtggcatccaaaactgatccgacaccaacccatcgacgtgcgggacgccaaccggtgggaggcatcggctggccgggtccaagccagactcggcatcgatctccatcaacaaaacaagcacgtcgaggagttctgtagtttgggctagaatcaaatttctagtcgacaaacctaactactcgtcctgatgacgcaggctaatagcaacgagacatcgatccaacaaatatgcctgctcctgacacgtacagtacacatgcatatgcatggagtcagtacgtgtccagccacccatgatcaggtatttagtagattgagtttttaaaattgatctactaattccgtagatatatccggcatatatctacaaaggtatacaatattttatatacaatttatcttacctatttttccaatctatacaatattgtcaaataaataatttattatgtttacctagagcatgtcttttatacaatatctattgtgcaagtgtctctgatgttaaatcgacaacggtttaataccgggggctcgctctattttcttcagtataaatcatgcttgtttacggtttacataatgtgtgatatttaatctgctcgctatatcctgataatactagaagttcatgcagttttttgagttcatactcgatattctctgctatatatcttgtcttctagaaaatatttttcaggaacaatagatcactcgagtaggttgtggtcgagtacaccgtattatcgagaacgatctcgacaaatgcagagtcgtcgcgcccaacctaccaacgaagaccgacgacctatctcatcgcaccggccgtggctggactatttgagaaaaggttgttgacggataattcgtcatgaacgttgtcggcttgatcactcgatatgattgcgaacggacatccggatatgctataagtttggtatgtgagtcatgctggtcacatgagatgcacatgtaataaaccaactctagcgttctcgaaccagtacgtagcaatctcccgcaccgcaaacttccattggtgttcgagagatgattctactcgctcgctggttctcgaaccagtacatagcaatctcccgcaccgcaaacttccattggtgttcgagagatgattctactcgctcgctggttctcgaaccagtacgtagcaatctcccgcaccgcaacctccattggtgttcgagagatggttctactcgctcgctggttctcgaaccagtacgtagcaatctcccgcaccgcaacctccatgggtgttcgagagatggttctacttgctcgctggttctcgaaccagtacgtagcaatctcccgcaccgcaacctcagatggtcgaggtacgactacagcaataacgcagcggtcctcgtactacgacttcaaatgatcgagagacacctactcactggtcctcaaccagtcaattgtagcgatctctcgtacatttacttctagtggttgagttacgactactacctggttcttgactagaggtgtagcgattctcccattacctctacttcaacaaagttgatatcaggtgcataatatcgccaggtgttttacccagagatcccttaccacaaaagacacctagcgttgaaacatatcctaatgtccctttacgccgtcttgacaaaacctctgaggaacctaagggaacttcggctggggacacccagagcggataaggctttgtcggatccttcagagacgaaataccatgtaagatctggtcgtgtaagagttctcgccgtacgtattaatcaagccgtgtaatcggaaatggattttccaacttcacggctgggggctaggatcagtgctcgtccaactaaggcaggtcaaaggtccaagaaccttatcatccgagaacgattctccgacgacaaggctgggggctagggagagtgtataactcaacaaactgactggtcgaagtcggtaaaagagtagacgctcatatacaaaacattggtttgtaaacctaattcattttcagttttccatacattctataacatgttaccctttgagcactcgctcgggggctatttctatctaatattcttttctgaatattgatttcaggaaaattctattcggcattatcgaagactccatgtctctatggctctgtacgaagatcgactaaggcgagtacgataaatgttgacaaagctccgtcgcagtctctgcgccttctcgatcgctcgagaacggttggtagataccgacaaggaatacaaaatgaagaaatggtgtacccgccgagataaaatttcttgacttcaatccaaattctcgattacagcaagacgggagacttagtcgtatgctctgtactttcttggttgacgtcggagattgactcagacaaaccctttaggtgcccgcacgaggctgataaaggaagtcaaacgttatctctaaactcaccgagaacgatcacgtgagctcggtaacagttcctccaaggtctgcggttgagaatatgaacctgttcatttgcattgaagtcgggggctactgtcaggattatggataccacatacctgatagtagttggctaaatctcgacaggacccaccacataccatgtcctatacgaaaacaacctgcggatataggaggagttccggataaggaaagacaatcagagttctacatggaaacgacaaggactagtcggattgtatccatattggtttccctggttctacttggacaaggggacacctatgtgtataaatacaaggccccctaggaggagagaacacacaatcaacagacaatcaacacccaccatagaagaaacgtacaatagatcaagacacaagatcaacatacaagccaacatacgccaagacaagatgccggatatcgacttcagggataagcacggctagtccccttcggtgtctccggatactgtcaggagagatgaaagcgttatctctaatctcgccgggcacgaactcgaggaggaagactaccctgttgtcgactacgagtcagaccttcagaccgccatgtcaacaacagttagataggctaccccaaatattgtactggtgtgattatggtgaataaaagcaataccggcttcggccaacaggatgtagggttattacctaacaattcaggggcccaaacctgtataaaaatccttgtctccatctcttttacctcagtctcgcgtatatcctagtaccgacgatccccataccatgcaaataccggaatcgcgacatcaaacatcgacacacccgttttatgggccaatcggaaggtttacgagacaaacactctcgtagcaaaggcagatgatttacgacgtaaatagacaaagacatatgaaactagggtaaagtagaaaacatggttggaaagtagaggtaaaagaacgattcgatatattgtaatgattgtggtcggggttagagtcgaaatggcatagcctttaaaaaagatcaattaggacttaagaaatctcggattcaagcaaggaaatacacaaaattgtcttaattggacttggactcagggccgccggtctagctaactggccgaacaactgcggtctgactgcccttgtgccgccggtcggaccaacctcgtgccaatgatcagactggccccacatagatggcttgagtactttttaaatctggccatgttttcctatttttcttctagatgtcaaatttaggtgttaacaataagtttgatattttattttatgaaaatgattatatgaatgttatttattttattatgatttggtctatcaataaaatcactttaagtcttgcttatattttttttaattctcttttagtaagttaagtggcctaccatatgtttaaaagttattaatcttatctatatatctagaaatagaagtagtaccgactactacggagtagtacaagtccatgtacacaagtgttatactccctccgtcccataatatgagggatcttaacattttcttgtactgtttgactactcgtcttattcaaaaattttttgtgtaaatataaaaaacggaaagttgtgcttaaaatattttagataataaagtaagtcaaaataataataactagcctggtggcccgcgcagattgcgcggctagcatcattatattttctctcatataatagcatatttgttttctcattatattattcaaatatattaaaatgacaacataattttaaattttgcaataactttataaaactactaatgtgtaatattcatattgtattttatatacgtgttagttattaattatttttaataccaaattttagttatttgtaaattataaatattcctatatggactttagactcgtcttttaatatttctttttttaattccgattttttttgtaaattatatttctatatagactctatgctcttcgtccaatattatttatttttatttctgaatttttattatttctaattgtatttctatgtggattctaaactcatctttcaatattctttaatttttaatttcgaatttcagttattttctaaatgtatttctatatggactctagtctcctcttctaatattccttatttttaattccgaatttcagttattttctaatcatatttctatatagactctagtctcctcttctaatattccttattttttaattctgaatttcaactattttaaattgtatttctatatgaactctagtctcctcttttagtatttcttatttttttaattccgaatttcagttatttctaaattgtatttctatatgaactctattttttctttttctccgattaatgtgagaatttctaggccatgagagcgaacgtagaggtttttttttctattcctttaataatataatagataattttaaattttttttaataagacgaatggtccaacagtgcaagcaaatgtaaaaatctcttattttaggggacggagggagtaggaaaaaagaaaatgtacggtacagaatacagcaagctctctggccaaagagggaagaacagcaagctctccgtactacagaattactcactttgatgaactataaagtcgcatgtacagatttaatttgcatgtacaaatgagcacactttgatgaactataaagtcgcttgcaccttatatatatctccctagtacacctaatttacacttgcacaccgtatacacttggaggccgggagcagctactacacatatactactgcacatataacgttcagacttcagagtttcagacaacaggtacgtacctgtctgttgttcagtaatcacacggaatcaaatcggcctcatcatcacacagaaaattcaaggtatatctacgtactttgggccagttatcgattgggacaatcagctactagattcggtcgcaatatgtcctccgatcatccgatcatcgtgacgatcgagacgacgacggccggcatgctcgcgcgcgagcagaagcagcatcgatcgtacactagctggtgcagctacatgatggcgcagctgtccgggtcgttgttggcgtactggtggtgc

SEQ ID NO: 35094 - DNA, 4745 bp, Oryza sativa
  unsure (1)..(4745): unsure at all n locations
nnnnnnnnnnnnnnnnnnnnnnnnnnnnnnnnnnnnnnnnnnnnnnnnnnnnnnnnnnnnnnncacagaaaattcaaggtatatctacgtactttgggccagttatcgattgggacaatcagctactagattcggtcgcaatatgtcctccgatcatccgatcatcgtgacgatcgagacgacgacggccggcatgctcgcgcgcgagcagaagcagcatcgatcgtacactagctggtgcagctacatgatggcgcagctgtccgggtcgttgttggcgtactggtggtgcacgacggtgtgcgtgttcgtcgtcgccgccgccgccggcgggtagtacgacgacgactgcccgtactgcgggtacgacgacgactgcccgtactgcgggtacccgccgccgccgccgccgtagtagccacccgtggccatcgtcatcggcgtgtagtagccaccgccgctgccgccgccgccgccgccgcgctggtgaggaggagggtacccgccgttgccgtagtacggggccgggggcggcgcgccggggtagtagcggtacgggtactggttggcggcggcgacgcgcatgagctcgtcggcgtcgacggtgcgcagctccaccacctcggcgtggccgaccttcctccgcagcttctcggtgaggtcgttggagtccaccccgaagccgatcaccagcagcaggttcttgtcctcgccggcgagcgtcacggattccacacctgctccatcggttcacgcagaacaaattagtagcatgcagtctgatcagtctcatgcaccgtgattattacatcgattacagttaaattactattagttcttgatctctcaagaaaaatatcaccatctttttattatatatactttcgggtcgactctagagtatcccctgtgattattacatctatcatatagttaaattactattggttcttgataactcaagaaaagcgccatctttttattatatttcgctgaaatatgtgtttgggtgtgcaaggaatttttaccggagactgcagcagcaaccttgatagctttcttgtggcccttctcagagctctgcagcctgatgacaatttccttctgcaaaaggtttcaaacggtgtaacgattagcagcgggaacaaacataaatcttacatctttgcacaaaataacagatttttcactgatgatgaaacagagaaaaattgacagatgagcagcaagaccatatacaattacacatacataccctcatatctttctcctggtaagcaagcaaactaaagcaagcgaagcaacagctcaatatactactcttttccaagctcacaagcttaagcaagagagcgagccttgtgactagtgtactctaccttgcctaacacagcattctgcagagagagggagagaacctccctttttatacacacaattactagtaaactatccaataatctaacgaataaaattaacccggttagttaattaccttaatcgcccccattgactttagcggcggagtcatgcatgcacagcactgcttcactactgaaaacacgcatgtataatgtatcgatgtatatctctacggcctttgagagagcgacatgaattgtagactaggaagacctggatggcctcctagtagtttagctaaaatcagcttaattagtttgcttggagcaggtggtgacttactgactcggccaccctaattccacaaaaaccaaacgcccacttgcattgctcccgtagcaacgcgtgatttgcctcagttttccactgaaaaaattactccatcagtcccaaaatataagtatttttagactctgacacagtcttcgagatgatactttgaccaacaatatttattaaaaaaagatattttaaataaaaagaattgcatattatgatagtttgattaatgataaatctagtaacatcaattttacatgattaatttttttatttcttttgctattaatagttaaagttaaaaatgattgatttggcactatgttaaaaatatttatattttgagacggagggagtaagcagtaggagacaaggaaaacgttgtctaagctgtaatgccggtacgtacagtgggcgactaataatccttctcgtggttgtttttctcgcccggaatttggaggattcgcggtaaaaaaaaaatagtgccacggagctgtcagtgctcagtactgtcagtacttaattaattacaatactgggtaatgggaagtaaaccggctgatctatcagtgacgagtgagtgagacggacggccgagatggcgccgtgctgcgccgggagagctccgtcggccgttcgatcaggcgggtgagctggagaccgaccgggcaagcgttcgtagccggcaaggtgaaaagggcttttatgtggagatattcacagggatgacaggaggttgccgacttgcagggtgagtgaattgaacaatgaaacagcttaagtaaacacaatgttaaccctgacaaaaaaaagggttaaggcgacaatcgctacgcgacttgtttgtttcttttgtgcgcagattttggaagtggagctgtcagtgttgtcagttaattacattggagaagtaaccgatcaagtaagtgagtgtaaaccgttaatttttttggaaacatacttttatttttcatattttgtatttatatacatgtccaagattaacttacaaaaatatacccaatccgcatattagttgcacaggagcgccggtcccgcaggacaggcgagcgacaacacggtgatttgcatgcggagctctgccgcatattggatataagggaccgccgctcccacacatgtcttttcccaaattgggaatacatgtcccgtccaaaaaacagagcagtacattggcacgtgattaattaattactagttaattttttaaaaaagaaatggatcaatatggtttttttagcaactttcctataaaaactttttacaaaaaatgcaccgtttaataatttgaaaaacgtgcgcgcggaaaaaggaaggagatgagttggaaaaattaggggaataacacacgaaaccggagtgctcccgcatattggatgcgcgggactgccactcccgcacacacgtcctttcctaaattgtgaatacatatcccgcacgaaaaacggagtaatacattagcacgtgattaattaattattagttaatttttttttctaaaaatagattaatatgattttcatgagcaactttagtatagaaactttttacaaaaattgttccgtttagcagtcgtgcacgcagaaaatgaaggagatgagttggaaaaaattgagggaataacacggaataacacacggagccggagactggctcggtaccgtgtgctagaaccgcgggaccacgccggtcccgcatcgccgttatgcggtaccgccgcgctcaccccgggtccagacggcgccatcactcccgcgcatcggcgccgcggtaccgactcggtcccacagtctagccgtgcgggaccagctcagtcgcgcatcccggttccgcgtgaccagctcgagtctgcggttcgccctcgctcccgcacaatcattacacggattaggtatatttttacaaattaatcttacatacgtatataaatgcaaaatatgaaaaataaaactatattttcaatttgtttctatctttatcttatactgatcaagtatatgaaacatcaacaatggtcaaattgttcgaaaaaaaaaggtgactgtaacgggacggctgagatcaagccatcttgtgtcaggggagctcaccgcggccgttgattgatgtgattaagctggagaccgggtggtgagactgttttaagaggtgaaacagggtcttggaccctttttagatgggattaaaacttttaattccctatcacattggatgtttgacactaattataaatattaaacatagactattaataaaacccatccataatataatcttggactgattcgcaagacgaatctattgagtctaattaatccataattagcctatgtgatcctacagtaaatattctttaacttaaaaaaattatctcgcaaattagcttttatttatgtaattagttttgtaagtagtctatatttaatactctaaattagtgtctaaatataaagactaaagttaagtccttggattaaaacaccaccatgcttgagatgttcagagaataagaggaggttgcagtagcttgctggtgagcggatggatcgacagcttatctaaccccagtagtggtaaccactgtcaaaaagaaaaaaaaaagggaaaatggaaaattctaagccaactgaccgcgacgtgtttggacgcgacaccatcttccttgccgggttttccgtcttgagtagtgagctttaggctcgcgtcggcgcgtgacgtaggcgtgccgcactagcttccgtcatcagactctgtgttaagttgtcaacttatattatcagtagaaaaattgccagctcaaggtccatggggaggtggcttaattacaggcctaacgataacgatatacagctagcctcgacgcaattaaattggacgaagtgtttgaggtggatcggtgaatttgaaaggctctccgttggagaaatgaaaaaaaaaagaaacaaatcagttttgctctgtgctgttttgtctgagtcagaaaannnnnnnnnnnnnnnnnnnnnnnnnnnnnnnnnnnn

SEQ ID NO: 35095 - DNA, 1645 bp, Oryza sativa
  unsure (1)..(1645): unsure at all n locations
taagtagtctatatttaatactctaaattagtgtctaaatataaagactaaagttaagtccttggattaaaacaccaccatgcttgagatgttcagagaataagaggaggttgcagtagcttgctggtgagcggatggatcgacagcttatctaaccccagtagtggtaaccactgtcaaaaagaaaaaaaaaagggaaaatggaaaattctaagccaactgaccgcgacgtgtttggacgcgacaccatcttccttgccgggttttccgtcttgagtagtgagctttaggctcgcgtcggcgcgtgacgtaggcgtgccgcactagcttccgtcatcagactctgtgttaagttgtcaacttatattatcagtagaaaaattgccagctcaaggtccatggggaggtggcttaattacaggcctaacgataacgatatacagctagcctcgacgcaattaaattggacgaagtgtttgaggtggatcggtgaatttgaaaggctctccgttggagaaatgaaaaaaaaaagaaacaaatcagttttgctctgtgctgttttgtctgagtcagaaaaatgggtttagctgatgcggtgtcctagaggaggcaagcatatgctggtgaggtctggcatcttaaaaatacaagaacaaatttaaaaactccggtctgtggatgaccggatatagattattttgagtcacgatacagccgtgctaccatcatcgcaagattcctttgaatctttgaccagcaccatccaatcaaatcatagcacacattcagttattggcaaagccggatcgatctatttgatttgttatctaaaaaaacatacagtagtttgccataaaaaaaaaacatagcagtacaatacatttgtcgtcgtacagttttcttcattttgttgtcttgctagatagaagtagcttctaaaatcccaacacaacgttttttccggattttttagtcgcgctttggttaatgaaacaggtggggggaaaatcatagccccggaacggtattgggctactggcgccaacgtgcgaataagtccattttgtcaccctcatctattgcgcttgtgtgaataacatctctcaacaggaaaactgggtataatgcctccttcttctttgaaaaccagagcaaatcaccttcctaggtggttttgctggcagtttcgtccgacgtggtgttgttgacccggttgacaagctgactcagcgtggtgggacccacatgtcagtgtgtagctctctctcccccttatttctctctcagccctcctccgccaacgccgacaccctcgtctccgcgtgcccacaactcgtcggccacctcgtccgtctcgaccgcctccactttgcccgcccggtgccccgcgccgtcgggatccgccccgtcccatcctcccacagtgtctccttcgtcggcgacccggagccgctcatcgcccgccccaccgcgaaatgcgtggtgcccagccttgttgcggccaaggaggagaatcgccgcacggcgaaggagccggcgattatcgtgccatcgaggtacaggcaggtcggaagcggctgcggtggcggcagnnnnnnnnnnnnnnnnnnnnnnnnnnnnnnnnnnnnnnnnnnnnnnnnnnnnn

SEQ ID NO: 35096 - DNA, 2268 bp, Oryza sativa
gagagagaaaggccggggagagagataagatggagagagagctacacactgatatgtgggtcccaccacgctgagtcagcctgtcaaccgggtcaacaacgccacgtggacgaaaccgccagcaaaaccacctagggaggtgatttgctctggttttcagagaagaaggaggcattatacccggttttccgattaagggaagttattcacgcaagcgcaagagatgagggaggcaaaatggacttattcctcggtcggaacacttggtactcaggtattgtgtgggcctattagtgggccgaaagcctatgggcccagtggtttggaaactgctaatgcagatcgagtccaaaaggcctcgcaagatatctcaggctgtgtgtttagttcagcgcaaagtttagatttttgttaaaattagatatgatgtgactgaaaagttgtgtgtgtatgacatgttgatgtgatagaaaagaactgaagtttagatccaaacacagcctcaggctctaagcgccctgaatgtctatccattttttgacccataaacttacacgcttatgaatgtatatccatttttttttcggagctgttcgtgggtggcgctttgatctgtccgtggaaccagtataccaccacgggtgacgagacatctaaaaattctcattttaatttctccttattgtgatgtcagttatgtcaaacatttgagagtattttctgtattaacgtgtagtagaatttttctacgcaaaaaaaaaacctcctagatttttttgccccatgaataaaaaactcctaaattttctgaaaagagggcagctaacctacgggataccgtgaaaaagtgaagtcacgggacaatttttatgtgtgattaattagtgtacaacatgttataccataggtactaggtaccaccgtaccaggtatcacaagtattaagtatcaggtgtcacatgtattaggtaccaggtatcacagatactaggtgctaggtgtcacaggtatcaggtaccaggtgtcataggtatcaggtactaggtatcacaggtatcgggtaccagctgtcacaggtaccaggtaccatacaactgataccatactggtatcagctggtatcaacatagcggcggaaaagcgaacaccaatcaaaaagagaaagaaaagtaaaatctatgttacataatatcattgtgtcaattaatttacacaacatactaaatctcaatgtgtttcactcaagaaaagaaacaaagcaagaaaaggagaaaacaaaaaaattaaaaatgattgtggtttatagaagatgtaaatcaagcctacagatgtgcatgcccaaattgattcacatggcccaagtgcccaaccagtgtatctagagtccttgtgctgtaggaaggacacatacacgtggatgtgttgtggagtataggcctgccacttagtaggaaatcgtgccgcatgcatgtacaattttttttgatagaaataacatagaccttttaagtcatccccgttcctacggaatgcccgttatctaaattttctgaaaaacatatagtagaattttcttgtgccgctaattttctgcgtcgcgtgggcctaataatcggccaagagctgacgggccataacggcgtcgtcgcgcgaacgtgccgaatcggtttacttgggcccaaatgtgggcctagaaaggactgagacggtccactagggaggtgcaggcaaccttgccacattcagcccgagtggtcaagtttcatttctgcttaggaataagttcaccggagatccctcaacttaacaacgagattttttttgagatcccttaaccacaaaaccagaaatcttcacccataaactatacaaaaccattcactcaaggtccctaggcattatatatggttggtttcgctgacgtggcatcctagtcagcaaaaaaaaaattaaacaaaacacgtggggcccacatgtgatcagctgcacgtttgatttcttctcctcttctttttcctctcttccctcttctctttttcagtgaggaggctggcggcggccggagcggcgatggcggcgtgcttccgctacgcgccgtccggccctgcggggcccagcctggcgacctccgtctacgagaccaacctcgacctcgccgcgctgtcatggacgcgcacctccctcggcctctcactctgcgctgtgctccggctctcgtccccggccatccccgaggagaccgacggggtgaggcccgagaggaggtcc

SEQ ID NO: 35097 - DNA, 4033 bp, Oryza sativa
tactacctaagagatcagtatcatactgcgaatacagcggtgcatgcatcgtcacacatcatcttcaacctggcttgccgcagccgcgtcatcccgccatgccgctgccgtgtcgtccatcatgcgcttggcttgccgccgccgcgttgtccctccatgcccccggcgtgtaatagaatatcttacagtatgaagtgcctcagtccgaatactgcatcgccgcctcgacggccttgctccccttgcggcctctgcaacggcgggcgagagtggtggtgaaacaccggcggcgacgcgtcgatcgacatgaaccggccggcgccaccggcggagacaacgacggcgaggggggcatctgcaacgaggaggacgaggagcccagcgcgactgttggaaatcaaagctattcactcactcaatctcacaagaacacaagcgcatacacacaagcactcagaacacagagagtttgcaagtgcgtagcactctttttctgtttatttctcacactgaaactgattacattgatctctatttaaagatgcacataacctgcttaagcctaaagaaatgcaagaatcctaaataacaaactcacccatgtctaacagaatatatcctggtcaatctccgatgcatgcgcccatgcaaacttcgaccgcttcttgctcctgagctgatcccttcgccacatttgcatgcatggctaactaattagctagatgtactctcacctcctggcaacacgatcaaccactactcaatgccaatctctctactcactaagccatgcagcacaaccactaagctagcactcatgccatgcaacacacatacatgtgacttctactcagctactaccatacaaataaacatgctgaaaacaaaacaacaagattatacttctaatagcgacctccccaactgcacgctctctagcaggcagcgacgacgaggactccggcggcggcggcggatctcgtgtcccacggccggggcagggacgggagtagcagcagggagaagagaagagagaagagagaaaggagaagaaaagagaagaaaataatatatgcagctgatatgtgggccccacgtgctttgtttaatttttttttgctggctagaatgccacgtcagcgaaaccatccatatatactgcctagggactttgagtgaacggttttgtatagtttaggggtgaagatttctggttttgtggttaagtgacctcgaaaaatttcgctgttaacttgagggacctccggtaaacttattcctttctgcttatgatattctttttccccgattacacatgaaaaattcggcacacaccattacattggacctcacccttatgtcccttttaaacttatgaactataaaactgtggcaagtgagtgattgtctgattgattgcaatcctaataaagtgaagaaattttctccatattctccatataattcgaggctctttcgcagcgctgtataactgtgaggccggggaattcttggctgattctgctttaaatagtaggatcactcgcagtaggcccaaggaatgtactttctgtactaattatggagataacacttcatataacaagaaggttctgcatgttattagtccttgttttaggactttctgttaaccccaattgcccggaaacgtacaaagttaggagtacgtactgccagatatcagtatcagaaggtgcaaaacatgaacatggcaaccttcggtgtgatgtgaacccgttcgtttaacgaaacttccactcatcaaccagcttttacgtgacactaatcatcaccgttcaatagttccatttgctaaattaactacattgcttaacctatttaactatcggtgatatatttctgtcttttggtggatttgatgacgatgttgctagtagtcagcactaaactactcccccgttaaaaaaaaataaatctagaattgaatgtaacatatcctaatattatggatctggacagtagagattcgtagtactagattgattttttataggatgaaagaaatagtctatagatacacgtgcctctcagcttaaatagatatagtggagtcgttctaaaaaaaaagaaaagaaaagaaatgaagaggaataagaagaggaagaagaagaaaacaagagtcatagacaagaacctgtacctttcaacctatctggtctcctcactactctctccggtcaaaattgtttcatgttttggagaactaattaagtttagttcaattcaatatatttgaccaggggaaccgtcgaaatctcccgttgcgtctgtcagctcagctccacgagttgtattcctatactattcttcaaaaacgaaccgtataacatttgaccgtcctatttgactaaaaaattatgattaatattttctattgttattagataataaaatataaatagtattttatgtgtgactattttttatttttttcatattttttaataaggcggatggtctaactttgtacacgaaaacccacaactacacttaaattggaacggaggtagtataataatacaatgcatgtttgaaattatatactactttatttatttatttttatggtgattagcttaaaattgaactaaccaacggtcaaatatttgaaaaaaagaatggagtgattaactgattaggagcagctccagagtgcaattgtccagatcgattgcgaaatacacatctgctagtatgttggagattctgatccttccttttattttacaaaaaactagttcttgaaatttgaatagggggtgagacaatcacccaagtttagagtttactcccttgtacagaaatagacttcatgaaagaaagtgatgcacttctgtttgtcctgaagaagaagaagaagaagaagaagaagacgacgacttggacaagtggaatctatgattgttggtttgacttgaacaagaggaccacattgctgtaaaacattgaccagtagaagaccagctcctacgcaatcactgcatagtaatcgagatttttttacgcacgatctattcttatccagatgtttttattatgattcagcgtagaccaaaaaaaaaagcaaatactcgtgacctaatatcaaataattgtgaggcttcgaacccaggtcgtctagcctaccacctgtggaggtagccaaaaacctctgggtgtttctcagatttagcgtagaccagtttttaccgattcatatatttgaactaactgaaaatttcacatatatttgaaccttaactaattgaaaatttcacatatatagaaagtgtcctgttttacgagcctacccttcccaaattactttaaaaaatcatattaatccaacttttcaagtttaaaataatgaatactcaaataattatgcgctaatggctagctcatcttattttgcctatcttcttgatctttcctcttccccttttctcctaaagaaataatcacgtacataatatcaaatacgattaaaaaatacgcaatgcactcaatagtttgttgaatctaaaatcatttccacaataacaacatacacaatatagaatacagcccaaaaatacatatcaagttagaataatagcaaaaaaaaaaaaagaagaacaaaaaaattcagaattggagaagcggaaagaaatcaggtagccgcaaggttttagttctcgctccttactcatgctcccgtcgtcatttttactcccgtagagttcttcgcactacaaccaccacagctctggctcatgtggagttgctgcaccccctctgtcacttcgtgtcccgctccttactctagttccaactgccaccgctcccactcccgctccttgatgtcgctccggccgccgctactttctgcacttgctcctatgagaaactagacgatgtcccgcactttgttgcgggatatatatattaaatattgtagaaatgattaaatgatttggattgaaatattgtgaaaatgatttgagaatgatgcttatatttagtttagttt

SEQ ID NO: 35098 - DNA, 4621 bp, Oryza sativa
tatttttccagagacgatcacttaagatgaccgcttatgaaaacatgtgcatcttcagaggctgccatcttaagtcaatcgtctctagaaaatattccacatatgggtttatatacgttggctcctagtgtattgtagtttagggatatttgtgaatttattttttgagaaaatagtggacagaaaagaatacgtgccattgagagaaccgcacaaaacatgccaaattttcgtacgactgtagcatgtatggctaaacaatggtgcaggacgtatcgatcagctcggagcaatttataggtatgtcaccgatacgtcaattcacgtgacgtcattctttccaagtgatcgacttttgctaatttgacctctcgtggtcgtcatacgatcgaagctatcgattgcattgcttgctgattggccaaccatggattggcagattagcacattgaaagaaaatcgcatgttactgaacaatcatgaggacgcaatcatgctactgaacattatagtaagttttcatttccaattaagtttggatttaaacaaggcgaaggaagccccacaaagatatagtagtatagtatatctaccactcctactatttctttgtacatagccataccaaatcgctgaagaaatcactgcaaaattcgatcgatctgtgtgactatatatgattacatgatggagcaggggtcgctcggctggtcgccgacggccaccggtatcccaccgtagtggtggtggtagtagcagggatgagggcagtagcacggctccggcttcttctcctccggcttcttctcctccggcttcttctccttcacctcctccacctgcacgagctccgcgtggccgatcttcttgcggaggcaggtgacgaggcaggccgcgtcgacgccgtcgccgaccacctgcagccggtccttgccgtcgccggtgacctccaccgagctcacgccggaggccatcaccaccagcttcatcgccttggaccggctcttctcgcacggcatgctcaccttgatcacgatcttttgctgcaataattcgatcaacggacagaaattaagctgtcagtcgcatatgctaaaaaagatttggtcagaattgattaagctgcatgccaaaattaagcgaccacaatcgaacagttttcccctcaccttcatcgtgttctgcttgaaataaaatgccaacgagaaaggctatcggccgatcgattcgatcgtttgcaatgcggctaagatgatcgagcacgatcaatattcgctcgatcgctgcagctatttgcgattgtagctagctgagcttagccgtggaggagaaggccacgcctgggagctcatttatatagcggcgcatcgccatcgttactactagaccactggcatgagacggcgacgaaagagcattccgcgcagctactctggcacgtacggatcggaacgcgtcagctgtcagtttcagatttaagtctgggattagtcgcagactagtctccgatcggagcgtctagtcacgctgaatggctgagcctgggtgcctgtacgttctctctcgatctgtagtgtagacgaccagtcaacgacttgactaaattgggttcatggtcgacgaccctgaattaatcctgatgggagccgcttcgcgaaggcaaagctctgttaattccagcagtggctgccgcggccagttcagttcagggctaacagcaagcacgaagatacatgggatgatttcatttctacttcgatattgattttatccttattttcaggtttttatttttgtcctcacttgtttgaaacgaaggagacatctactcttgtttttgacggaatttagtggaccttgaattatagagctataaaacaagaaaaagaaggaatactgattttgtatttttctgttgaccttttgtaccctaggcagagaagaaaggaagggagccaggctccgacaccattaccccattcccagtcggaccacagccccatactgtgaataagccaaaggaagggagctccaagcagcggcggtgactctatgttccctcgttttccgcgcacatacttttcaaactactaaacggtgtatattttttgtaaaaaatttctatacgaaagttatttaaaaaaatcatattgattatttttttttaaaaaaaacaaatacttaattaattacgcgctaatgaaccgctccgtttttcgtgagtggtggcaaaacagccacctccctccctagcgaggcggtggcggcagcttcgctagcgggcggagcaaacgaccgtggcgacgacccgatgcggggaggaggcgacggcggcggctgctcggctggtgatggcggcagttcggcgcggagaggaggcggcggcggcggtggtagcttagcgcgggaaggaggcgatggcggcggctactctgccatagcgaaatttcccacccttctttccactcccacggaggctaatattggcctagaacgcacggcccaataggcaggagaagaccagtgggccaccttgccttgtccagcccgagtggtcggtttgggcccggcccaataaggaggagcagaccagtggaccacctcgcctctactggcttccagcccaaatggtagctacaaatagacaaacgcattggtggttttgtagaatgccgcggtgcattatctgtccattaatctgacgtttacgaactaaactgtggcaaagtgataatttgaaatcctataattcttgcataatggaaatgtttacgtcttcgtctttttcttaccgctgtaactgtgatatgaagccgacagattgttgcattggctgatgaatttagcagcaggccctgctgatcctacttaaatactactttctctgatttatattataagacattttgggttttaaatagatttcatatatggttatatgtatgtgttttatatacgtgttcaaatttatatagatattagtaaatctagacgaaaaaggaaggtaaaaacgtattataatatatcaaagggaggaagtatatgtactatgcgatcacttgccttaggccgaagggatgtactttgtgtaccaattaaggataagacttcatctaacaagaaggttctgagtagtttgagagccaattaaacaacccagacttcactagactgcagggtaattctttgtttaggacttgcctttccgaaaagcttgcttttgttgcacgctgatctctacaccgtagaaagcgtgttggcttttcgctagaccaagatgaaatcgttgattctttgattgcgtttgttcactgaattattgacgccattattcgtctgagtgctgcatctatccgtctttgttaaaaattttctggaggttagctgccagtcttgacactctctgactaccactctgacgcttggacttgcataattgagcgtgcaaattgcacaagacaacagagagaaaattggaaaagaagtacagagaaaaatggggaaaagtacaaaactataggtggtatgttacttccttgatcgttcacatttattttgtcagggtgtgatttaaattattatatccagctaaagatgtgtgtgtatactagtatatactaccagcttacagaactctcaacagaatcataaataagaaattgacgagacttggaaaccaacggggaaaaagagataacctaacaccaacaccatgtaaagagaagttaccttttcacacgcccagaaaatcagaatgactgactcatataatgcacgaagttggcgtaattcgttcttaaaataatttcttatggctaagtacgagagtctgcagcactaaaatctgttaagtgctctaagcactttctgttaacccataaatgcctggaaatgtacaaagttaggagtactttcagcaattatcccttattaagaagctgcaaagtatatcaaccttcggtgtgaacacgctcgcttaacaaagctgccacctcagcttctagctttcaataattccacttgctatgtgttaattaaattacttgactcatataactattgttggtttattctgtcttttggtggatttgatggtgatgatgtagtcaacactaaattagtctgaagatgcacacgtctctgaacttaagtatacgtagacaaggacattgttacaagctggaaaattgtttcttacaagggctgtgcctttcaacctatctgaactacttattactactagatgtcacggccatcagatagcagaaacaggcaagaaatggggtaggaatacgcacttttggccaaagtatcttggcgaaaacgaatcgtgtatatatatgtgcatctcatgacgaatggttttcaaacatgaagtggtaggtgtaggcactggattctactcgtattttggtagtcataatataatgtatctttgaaattatataaatgattaggagtgactctagagtacaaatgtcggtacacaaatacaaaatggttatgtccaaatcaactaaatatatcgtcaagtatgttggagccgttcctgttttttttatttcacagagactatgggtgtgtttagttccacgctaaaattgaaagtttgaaaaaaaaa

SEQ ID NO: 35099 - DNA, 6558 bp, Oryza sativa
tgtctctcatcccaaacaccacatatgtgtgtagaaaagtttttatgtgataaaaaacatgaaagtttgaaaaaaaaattgagaactaaaccaggcctatacctgagaatctgaatatctgaagacgatacagaaactattcctgggtatttgaatacctgcattgaatgctgcacctgtacttccgtttgtcctgaaaaagaaaagagactgtggaatctagtatggatgttggttttcctcgttgaatttttataggctcaaaggataaagaaaaaagaaaaccacgtcactgttaaatcgttgaccaggagaagaccatcccctagcctaagaaatcactgtataataatagagcatttttacccaccgtatatttttcatattcagatgttttttacatgggtaattttaccatccttgagaatgtacctagaggtgccatattttctagtgtaaaatttagtatcttaaggtacttaaaaaatttagtgtaaaattttgctacctcacgttactttcttaaggactgtaaaatttctcttttaacattcagcattagatcagttccttgcggctgggttcggaatctcgctatatatatatatatatatcttggagaggctccccatttttttaattctgaactcaccaaaaatttcacatatattctagtttcgtcaaatttggtcaatttttgttccccaaccgcttggaattcaattaaaatttgtctacactttgaatttctccctgcgagatttagattattacacgttctgggactatagttctcaggatgctaaatttttgtacatatgccaccctgggactatagttctcaggatgctaaatttttgtacatatgccgttctgggacacgttctgggactatttttgttcgaacaacgatatgatgcagccggcaggacgtgtcgatcgatacaattcagagtacatatttccacgtttgatttgtttacacgcacgttgataattgtgacttctggccctcgtcatacgtgagcagctaatattgattggcttggctagccatggatggcagattagcacatctgaaagctatagctaggagtagatgagatcgatcgatcacatgcgtttaatttttccgccggaaagaaaatcacatccgtttccgaacttcatgaggacgcaaaccagcattgagatgtacacacaccagtgtcgtagttcgatcattttcaaaagtagtactaatactttattgtgtacagccatccatgcactcatatatggatattaattcatggatatatatggttcatcaattcactcgatcggtgtgtactgctgtacttgattgctgatcgatgaagatacgatattactgcaaaaaattcgatcgatctctgtactgtgtgactgatcacatgatggagcaggggctcggctgctcctcgcagtagaccatcgacggcggcgggtagtagcacggaggaggagggcaccacggcacggggagcgtggcctggcacgggcactccggcggcttcttctcctcctccggcttcttcttctcctcctccggcttcttgtccttgacctcctccacctgcaggacgtcggcgaagcgcaccttcttgcggaggcaggtgacgaggcaggtcacgtcgacgccgtcgccgacgacctcgaggcggtccctgtcgtcgccggtgatcgccatcgagatcaccccgtccgctttcgccgccacccccagcgccttcaccctgcacccgtcgcacggcatgcacgccttgatcacgatcttttgctgcaatcaatcaattaattacagcaattaatatttcaaaatttcaacaaaacgtacgccatgaaagcgatcgatcagtctctctgtcatacgctgctactcctgctgcttcagagaaatgctcaaaatgtcaaaggtataaacctcaccttcatctcgtcgttctactatacgtatacgatacgtgatatgaacaaagagagatgcaaacgcgagcaagatgatctagcttgctgcagctaagctgcgtgcgttgcgatttatttctagcggtggatgcagaaggccagcgccgggggctccttatatagcgcgagaaccacacacacgcacactagctaatgctcgaatatcgccactgtagtagcggagacttgaattaattaaattaaacggcgatcgagttggcgacgacgtagttagaacattcgacgcagctatatcgttcgcccaactaaacaaatatacgagtatatatgcgacctaactaactaactcgatctgacggaaaacgtataatcatctgaaactagctagctaatcagatgggtcatggggggtgagtgtccgatcggagggtgcgcgctagctaatcatcgagctgggacgacgctgtataggtagacgcgacgacttgacttggttctttggttgacgtcgatatatcgatccagatctgagcccgcttccagtagcgtgcatggctagctgcagcagcagctcagtttaacggcgagctagcacaagccacaagctttgcagatttaccgataccgttattattattcctaccagagatatacagatactggattttcatcctctcaagggacaccctcgtattttacatgttatctaaatagttatttaaattttttaaaaatcaataagatagattaatataagatatagaacccaacgcacggagacaaggttaaattcaagttctacaatctgtaacaaaaagaacaaattgatctgaaattaagagtgaaactagtatacatgtattcacaattatatattgttgttgttttataacttgtgcatgtctttaaaataatagcatattttgtagagtggtttatgttatattaatctaactcatatatttttttcaattttttaataatgatttggatgatatcggtataagaactagaggataaacaattttccattagagctaaactttctactactaaattttccatctgatttggcaacgatagatactactgccaggactgccctaaaccaacagcagctaggaacacaagtacccctaataaaagagtgcatcggagaaaaatatatagcgcaaatcgcatatatagagtaaatctagaagctatcataaagatgactataaacgtctgagattttttcacgtcattattagtaaaactgttgacgtgaacaaatctcaggcgttcattttttttatacaatggtagtttctagagttatactatatacattatttgcactacatatttttccatatcaattgacatatgttatagtattacacaactatgtagaaaacactttatatcatataaaatatgtcatcgatattgcacttgaagctttatgggccttcagctactgccttcgcagctgcgccacagccgacataaacagtgccgcactcactatgcgcagccacagctgtagctgttgcagccgacctgcctatgtgaaaagcacaataaaagatcagttgttgtcaattaattggcatatgtcatactcctatcacacgattatgctcaaccaataatgatatagatactactgctaggaatatccccaccgaacacgtacaacagtacgttggcagtaaaaacattaccctataatatggtcttgctggcagcatgtgcttcgtaatcttgtttggtttgctttaatagtaaaatatacaggccgtatacaaattaatgtcggtacaaatacaagtatatatgttcagatcaactagaaatacatctgcagatatatatgttggagattttaacccttctattattttacagaaagtattcctagaaatctgaatatctgatgagtgatgatgatgaccccatctctcaaatctagagatactgccttgtaagcctttgacctgctaagatgatccatgtatatagtaggggccgaatttatacatgaataagtctctctcacaaaagtataagtctctcttataaggattaaaatttttgtgggaaggactaaactttagtcccttctttccaaacaccatctaaatgtgaggattattgtggccttgtggggcagatcgatcctttgtacagaaagtatgtacttcttgtcctgaaagaagaagagaagcccggtgaattttctccggctcatgaggaccaggaaaaccacgcctctgttaaaacacagaccagcagaagaccagctcctacaaaatcactgcataataactattgagcttcattattcaccgtatcttttttttttcaggtcataatcacaaaagttcttacgtcaatgtacagagaaacacgatatgttactgacgagtggttttttaccagatgggaggaaaatgtcctggcattttcaagacggggaccatgttgccgggtcatataggaacatggtctttgacctcgtttcttatggccatggtttagatgttttagtatcatttaagatagatggtttaaaatctcactatctcggatactccggaaatttcttttgaactatacatttgtattttgttctcaaacttggttaaattctgtttgaactgcttgaaattcaactaaaatttgtttacaactcgaatttctctctgcaggatatgattgatcaactgcctaatatgcttcattcgctccattgctgtacttaatcgctgatgatgatgaagaaactactccaaaacaaaaattacatgatggaacatgtgccattcgggctcggctggtcgcagaagaccaccggcggcggcggcccgccgtagtggtggtggtagtagggagtaggagggtagcacaccaccggcggcttgggcggctccggcttgggcggatccggcttcttgggcagatccggcttcttctccttcacctcctccacatgcacgatctccgcgtggccgatcttcttgcggaggcggttgacgacgcagaccgggtcgacgccgtcgccgaccacctgcagccggtccttgccgtcgccggtgacctccaccgagctcacgccggtcgcccccgccaccagcgccatggccttggaccggcacttcccgcacggcatgctcaccttgatcaccatcttttgctgcaaataattcatcaacaacgccaataagaaatccatcggcttcagaaaacgctcaaaaatattgcgaaaactaagctgcatggaagcaaaactcacaccttcatcgcgttctgcgtgaattaaagaggctccgtcgaattcgatcctttttcgcgaacgcgcaatacgattgcacgtctttctaattcgatcgttttgcaatgcacaatgcagatgcaaacgccgatcgaccaatgtgagctcgttcgcgatcagctgaagctagctgcgtgcgtcgcgatcgtagctaaagctgtggaggagaaagcgacgccggggagctccttatatagcgcgggaacacgcgctggcaagccgtgccgcgcggcagctaacactgctcgccaccgtactagctagcagagaggtttggcgacgacgtaattaagaacattccacgcagctaatctcccaattaaacaaacgcgcactaactcctctgacggaacgcgttggctgtgtcaggatcaaattaatgtctgaaactaatcatccatctcttggccgacgggttattcccgattggagttgctaattaatcaggcactgagagactgtgtgtgtgattgtgtacaggtggacgtacgacgacttgacttggttcttgtaatcttgttggttgacgtcgtcgtcgaggatccagatctgatgagctgcgcgagcgaaattctattaattaattgccccagtcgtggctgtgcagcggccattcagtttaacggcaagctcgagcttgctagctagcacacgcctgagctgacagcagagttcagttgtgctactgctacgagcatactatttttttaaaaaaataaaccgaaacgtgacatatctcgtacaaagatgttaatttattttaaaacgtatggagtacgactgccaggactgctgaagtgccgtttagtccaacactcctatgtcctgtttaaacaggaacttctagcagctctatagcctttttcctaaatcatctagctagattccaaaactatgtaattgtatataatccagaaaataaattaaaaggttagaatgtactttctccgttttataatgtaaattactttagcatttcccacattcatattgatgttaatgaatctagataggcatcgatatgaatgtgggaaatggtaaaatgacttacattatgaaatggagggagtaacaaatctatatttttagattacgactagttggctactcacaatctgtttctttagaatctcgaataggatcttagttgatactctactgcttaatttcattttttctataagaaaaccgtggtatcaaaaacgaaaatgtctggtatatgtcacgtggatgcgggtatcagatttgaaatacctgaaactttaattatcgaataatgtcgtctaata

SEQ ID NO: 35100 - DNA, 1813 bp, Oryza sativa
  unsure (1)..(1813): unsure at all n locations
nnnnnnnnnnnnnnnnnnnnnnnnnnnnnnnnnnnnnnnaaagaatggaaagaatattaccattaataatatttttgagttaatgattagagtctttatcgtctcaactattgtacagacacggcctctaaataatcttgtattgtttaagagaccatactcatctttaccattgaacatgcccttatgcttacaattattttaaaagaagttttttcaaggaggttaccaaattaaaccttaggttagaagaatatgacatcttgcttaatttggcagtgatatccgtgtcaccttttctcccacatgattgaaacaaagcaagacaaagatggacactaaatcaaagagctgacgacagaagaatgtgaccggagcacaacaattttcttccttaatttctcagttctcttctagaacagaaactaagtcgattcgttccaaaaaaaaaaaggaacagaaactaagcatgcacagcagttttactgtatttctcaaggaaagacatgtgattattggaaaggacgaacatatatagcaaaaattcaaggtaaatacctgagcacaaacacagcctctttcgaacctagatcttgaaagaaccgcggcgccggccgagaaggggcaagagcagcgggagaggccgacttcgtcgcgaccgcgtggggcactggggtggtccaggaagttgatttgggcccatgggacaagacagcccactagccaggccagggattaataagggagtactatgtcagaaaagatatttattagccagttgactaaagctttaattagtcaaactttaagtgttaggataatgatatcaaagattcatgcatgttttaccgtaaatagagacatctacccacttttgatgtccgttctcagtagccacataactccgatcgatatgcaaattaaataaagtccatcggtcttgttccattgtactgtgaggggctatttggttgacggctaagtttatcatatcacgtttgccgtaagtctaaggggttattttggtattcctattctagtagcgtaaactataaaaaaaaactcactagcaggctagaaaattagctaacatttggagtatagaacaagtgaatgatgaacaacaaaacgtcatttatttttttccccaaatgagtaagacgccatttaattagaaacatctctgtaaaacatgttaacatcttgttgggttataagttcaatgtcgtctctatgtttacgtgatgagcggttaatagaactaagcggagtattctgtaaatattaaaaattcaataatttactggtaatgttatttgtaacaaaatactatcaatataggtaaaaggtatttcgtggcaacccaattgcaaccgcaagtatgttaacgtctctctgcttacacaacatgatgcactagcaaagaaacctcgttagtgccgattctaaaatcctcatgtgtacaggttttggtctagcaccatgaaattaagcagcattagtttttacaaccgatgcatgtaaggtatatatattcgccggttttagttgagtgactaatctacgtgatggaacagaggtgcacttgatagtacagtggtaatataggggtcgtgtggtttcaatctcaatatcttgtgttcaatatccttaacacgttcacaatttcttcttaaaaaagtgcttgaaggggcagcggcagcgtcaagcaccccctgggcggcgtcgagcttctttcttagctccgcctcccagctcccgtattgaaggcggagggtgtcctgcgcctcgttcatcacggtggtggcaatga

SEQ ID NO: 35101 - DNA, 2055 bp, Oryza sativa
ggatacgatcgaccgagctacgcacaaacggctctatatatactacacacagctgcaggtattagctaggggccgggccggggcgtatatatgtacagtacgtgtgcgcaggtgagagagaaggaagcaacacgagcctattcgatcggaaccacacatcgcactccatcgtacagtagcagctaagctccgatcgagctagtaataattagtactcggacaactacgtacgttcctaacacacactgatgactgaccaattaaacgcccgggttctcgggatcgagagctagtgaccatgcaaccgatcgatcgatgcacgcatgatcggaaagtccggacgccacacgcaagaggatttacccgtggagaatattagagagtgactcgacttttgccgagatacgtttgtattgtatgatttttttttaaaaaaatatagtataaatgtagatacaacattcacttcgtgtgttgtactccctccgttcctaaatatttgacgtcgttgatttttttaaatatgtttgacccgttcgtcttattcaaaatttaagtaattattaattattttcctataatttgattcatcgttaaatatactactactagtcaagttcttgaataatattcataaaagtttttgaataagacgaacggtcaaacatattttaaaaaatcaacagcgtcaaatatttagagacggagagagtataatatattttctctaccgatcgatcgatcatcaactgatcgtcggggtccgtccatcggtctaaacgtcgaagacgaggaccgggtcaagtgttcgcgcgcgcaagctaagcacgaacacagatcaacttgcgcgtggcagcgtgcaagattcagctcgcggagcagcaaacgtcatgtacagagctttcaattcagtcgatcgtgcccctaccagggtttaccttatcgcttgggccggggttatcaccaccccgcggtagcgcgataaccgtgataatcgcgtgataatcgtctaaaatcgcacaaaaatcacatccaaaaattcgaattcaaaactcagcggtttcgtggtttcaccgcgataatcgcacggtttaccgcgataaccatgatattcgcacggttatcgcgggctgtatagctgaaagatgtaaatgtaaaataaatagggtaaaaaaatcaaaaatacggttgaatatgtgtagaaaactagaaattgagaataattggaagaatatgtaggatacttaaggcctaatattctcttcctttttcaatttgtaaaccatttttggttttaccctcaaatttgaatttagcttactctatttcaaaaaaattcttcacaattggcaattacaaatcaagaactacatccatgaattttttcagtttttttcaatttttttccggaattttgaattcggtcaaaattcatccaaactatatcgccggtttcccctaccgtaccccacgataagcgcgataaccacgataatcgcgcgattatcgtgcgataagtaaaacctgtcccctactccaccgtactaacaccggagtaggcgtctactctatccatccaaaaaaactcaacctagttaaagatactccctccgtttcacaatgtaagtcattctagcatttttcacattcatattgatgctaatgaatctaaatagatatatatgtatggattcattagcatcaatataaatgtgggaaatgttagaatgacttgcattgtgaaacgaaggaagtaggacatattttactataatgaatctggataacccctattcaaattcattaacgtatcacatccttaagtttttttttatggagaaatacgacgtcgagggaactgggcatgacttgattagctcgtccgctgcatgctcgcgattgacttctggcttctgcaccatactccctggctcgccatctagctagctatagctaggttaattatgctccctggctcgtacgttgactaattaatcaaggagcagagatgcataaacttagcacattgcgaatacatgctatatataaattcta

SEQ ID NO: 35102 - DNA, 3938 bp, Oryza sativa
tataaataagttttggatatatttatctttaaaactaaagattagaaaaaaaaaatccagcgtactgtggacaaactatagtacggctgtcgttgcgctgtatatattcatgggtaaactgatctgcaggctgcagcaacactgcttgactggttcaggcgatgacccgtggcgtttactttccaatttcagaagtacaggcttgcttgaatattcttccgttgcaaccataaattaacccacttgatcattcatggtcgtggaatccggccgttgacctcttctgctaccttcaattcgtttggtacacagttgcgcgtagtagtactgtatcttttgaggcgcatgcaaattgatatgtgaacggctattctaaaatcgatcgagaagcttttcgagagctcaatctaaaagatgcaaattcttcgtgtggttggttacccaacaccgcagttcgactagcttaaaattgcccaatgatgctaatagtgtggatcagctagctatagctagcagaatgtcctagcagttgggtaggcaggcagcatgcatgcataggagcaggtacaatagcaaactattagccgactataaatatatttttaatgagataaaagataagagagaagagtagcgggctacagatctgtaactagcggactccaagacacagtgtgtatatatgacaggtgggactatatattgatagtatagtaagcaattattatatgaattggctactagattggttataggtgaattgcagttagtagtgggctatactattaaacttgctctaagaggctgcaaataattatccctcgtactgtactactatttgatagcaaccagcaatctactactaataagtgctaataaccattgatgggaagtgaaaaaacaaggggctggaacggctcatttttcagggtcatatgattgaattggtactcgatcgtaatgttgacactctagcaatctggcaaaggaagaaaacttccactcttgtagcattaataatcgtcaatcttcccctagcaatgtggacataagaagctgtgggatggtgtgagttaacagtcgctctcgcattcttaaatagttcaaaagtcgtcctctagaataggtcgtcgatccatttctctggaattttgtcgggttttcaactaatatatttgtgtcacatgtcagttatcttgcatatacagtacacatagatatatgtccatttcactgcattaagcagtttgtacatttggtaagtagtcgttagtagacctttttcagtttttttactcatgttaacatgtgtactccaatcacagcgtaacgaaccctggtcgtatatgctccctccttttctaaatatttaacgccgttgatctttttaaatatgtttgattattcgtcttattcaaaaacttttgtaaaatatgtaaaactacatgtatacataaaaatatatttaattatgaatgaaatgatagaaaaaattaataattacttaatttttttcataagacaaacggtcaaatatattttaaaaagtcaacggcgtcaaacatttagggatggagggagtacatatgttttgatactgacttttgtttaaatttgcataaaaaaatttgagcacaagtttctatctatcacgataacatgttaattagtcaacgttcaacacattatggaagtattgttttcaaggtagattttagtccaaaaatacctaacttctagtctagctagctacatatacatacatacacgcgctatatagacacacacgcgcgctatatggtagctccggcatgccagtctatcattgaattaatgggcgatcgatcgaagatttttatgtatctcagctcaccaactcatgcatgatccctgatctccttcgccgttcagtacagtgtatatatacgtagtacgtgcatttggcagcacctgaccgattcaaacacacatgacacatgcatgcatgtcccacggttagagcaaaggttaataatacagccgacctgttggctataaggtttttttagccttctctcagcctgcccatataatagttagttatttacaattaatacatggcccacttgtctttctcgtagagttttttagtttttgtgtccaagccggctataaatttacagcccgtttttcctctctctcctctctttcttctccacctcagcatttagccggcttataccttactattatacttgcacttagaagaagagaggcgcaggctagctggatgcccggatctttttgtcagccaaggacgaagctgcatgcaggctctggctgtcatctgtcaactcgtgtaacgtacagctagaaacaccggctgtcgaccgtgttaggtccgtgtacgtaggcctgatttagttccaattttttctttaaatttttaactttttcatcccatcaaaacttttctacacataaaattttaacttttctgtcacatcgttctaatttcaatcaaacttttaattttagcgttaactaattaaacacacccatactctcttgaactgctggtcgcggcgcctcgctagctcgatcgccccgaaccgcatgcaacgcgacgcgcgtgctgttgtgttgccggttgcccgcatcctgcattcctgcgttacgtcctgcagattttcttcattgtcatgctatacgtccgtccgggatcggagcgcgactatgctagcacgcgcgcgtaggctagggcaggcgaggctaggcatgcgtgcgcgcaacttggcaatttgccgtgggcgaaaggcccgcgaacaacgcctatggccgcgacccgcgaatccgcgcgccgccgcccgcgcgcggatggtgggacgtcggacggtcggtcgcgcgcgcgagtactcgtacgtgtatgtgcggccgatggccgggcttggaatttcatcacgcacacccagccgcacacgtacgactacgaggggggttaggtttgttacgcacgctagctactacatactactatacatacctcgtcgtcgtcgtcgtcactgtcgcagtctcacagagggtaccaacatatgcatggagggaaggcagggagaagccgtcgtccgtgccggactcccggttggaggcacgtacatcagcttagctagtagctagctagccgtgtttttctgacgatggattgcggcgttcaaggcgttgtgttgcttccgttccgtatgtagtaaactaatgacgcgccccgtacgtacgttgcgaccgtgcaagttgggagagactaacacatactctccccatgcatgaacacagattagttggagaggtgtggcatgcagaaaccggggcaacagggaaccgtgcctaaccccctaccatgatatatcctcggcacatttctttcttcgaaaacacatcctctatcggaacatttgcattgtgttgtagagctagctctgcaacaaccaacaagttgttgtgaggggaacaaattaaaaagcgtacgtgtacagtaaaactttatgatatatacaagagaggggtggtttgcctaactagctctagggccgtaccctatatatgctgctagctatatagaccgacgtcgtgtgatattatgtaggccggccggttgttttgattttaatattcgtgtgagatcatattctacaaaacagcaaattgttaatactagctttaagctaggttttagtatcacaattaaacctggcactcgaagctggtttaggtaaaaacacttccactcagaaatggcattaactaattaattccatttctaggtcttgcacgttgtgtttttctgcagtgtaattctcacctcaatatcataaattcatgaaatccttgagtttatgtcttcaatccgctaggctaattatgtgtcattgtttaaagacgtcttaggaggttacacgttgttg

SEQ ID NO: 35103 - DNA, 8035 bp, Oryza sativa
  unsure (1)..(8035): unsure at all n locations
nnnnnnnnnnnnnnnnnnnnnnnnnnnnnnnnnnnnnnnnnnnnnnnnnnnnnnnctctgaagctactatagtttttttgccaacgtgtggagccgatgttctctcctgtttcctgtccaagccaataagactgaagatggcatatttagagggtgtttagatccaggggtgtaaagttttggcgtgtcacatagggtattatatagggtgtcgcatggggtgttcgggcactaataaaaaaaactaattacagaatccgttagtaaaccgcgagacgaatttattaagcctaattaatctgtcattagcaaatgtttactgtagcaccacattgtcaaatatggagcaattaggcttaaaagattcgtctcgcaaattagtcacaatctgtgcgattagttatttttagcctatatttaatacttcatgcaggtgttcaaacattcgatgtgacatggtgaaaagttttggggtgggatctaaacaggccttacacaatcgtcatgtcatgttgaagtggccagagaaaagccctctgggcccaatggtcatagttgtgcgtgttccttttctagttcaagttgagaaaatttgacgatgtcgtacttagacgagttatgccatatttgaggtagtcagagacaaaaccaagctagccaaatgggcgtgcctgtgtgtatatatcatgcccatgtggatggtctcgtagaaacatatgtaatgaaaacctgaaaagttttataggaggtaaaaatttaactcatgataacgcgaataaatctcatacttatgttttctcatcttacaatagtttcagattttcattatatattttctgcatgttcaatgccaatatgtgaatttttttcccctcagtccaacctgagaagactcgatgatatcacatttagactatgacggagcgtggggctcctcaccgggagaccgcgcaggcccccctttgccggttcggccgggggctcagggagagattctaagcactctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccagtcccccatctaagtgggcaaggtcctccttttatatcttaaggggataccacatgcaccatttctctcttttttgtggggacttaccccaccttttcataaatggacggagatttgtatagttgtcgtccgagtcaccatctgatgagacggctcacaactacctccactttcgccgggagctggtgcgacgtggaatcgtggctgtctgctgacgacatgaccggtatcagaccagtcacgtcggtcattcttgtccaccacgtgtcagcttagcattctacatgctcccccttcttcacacaacatcttgcctgtaatggttaggatgaagcctggcatatatctgaccagatgactaacgtgccatctctgggaggcaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgcgttacatgcggcgtgacacgctcagtcaaaccgcaataaatgtagttaggtgagccccactgtgctcacctaacccatacacgcggagcaaaaacccacgaggggtcggggcgcctcggccctcggggccgaggggggtgcggcccgaccccctcggggggactaagaggagggcgaacgcatcaccctcaggcccaacgtccctcgggggtaccaggccacgtgtgcgattgtgtctgcctcaaacctctagtcatgatactcctgatcccatgtcaccgacagtagcccccggcgttatgccagggcgatcgccttctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcacgcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgccgcgccgcttcatgccggagtctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgccttcgacttccgagccagcccccggcgcaggcctccagctggcgggcgccggtagatctgggggatggctatgacgccgtcctcgaccgcctggcgggcctgcgatcccaggggctcacaggggccatggtgtacggtgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaagaaatcctccccctctgcagtgatccagaccgcgcctccatcctgaccattatgatggcggtcggggcctcagaggagcgagctccaaagggccacgacggcgcaggcgggagccgcaggggggaacaatctaccccgagagggggtcgtgcttctgggtcccgtgacaggggtccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcagatcgcctacgggaagccgaggaggccgcccaggaggccgcccgggctcgccaggccgaggaaaccgctcgggaggaggccacccgggcccgccaggccggggaagccgctcgggaggaagtcggatttcgccaggacgaggcgatggcgacttccgaggcagctcgcgacgaggccgcgagcgcgtcgcttgggcccactccctcgggcgacgctcaggcgacaacttctggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacactcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgccgctgcccgagaacagcgggcggcggagaccgaagcggcgtcccggcagcgtgaagaggcccttgaggcgcgcgccatggcgctggaagagcgcgcctgcgtcgtggagagggatctggcggaccgcgaggccgccgtcaccatccgggaagcaacgctggcggcgcacgaggctgcttgcgccgaagaagagttcacgctccgcctccgcgaggacgcgctcaccgagcaggagcgagctctcgagggggccgaggccgcggcgcaacagctggcggttagcctgtccctccgcgaggcagcgcaggaggagcaggcacgccgcaatctggaaggtgcccgcgccgagagggccgtactgaaccaacgggccgctgagctcgaggcgcgggcgaaggagctggacgcgagggcgcgcagcggcagggcggccacgggcgaaagcgacttagccacccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgacaaccagggaggcctcgcccagcgcctctcgaagatggccggggctctccaacggctccccgaggagctcgagaagacaattaagtcatcctcgagggacctcgcctaaggagcggtggagctcgtcccggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgtccccaactccgacgaggagagcaatgccggtggtgcagacgacagtgacgtcgaggcaggcgatccgggcgcatcggattgagcccccagacccccgccattcttcaattttttcttcttttctttcttctaaggcctttgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagattcacatgtcgagactggccaggccgggaacgtggtgaccgagggttatgggtgacccgattgtgggtttttgccgattccccccggagttcaccacgcctcggggcacggctcggttctgggccccgtttggcgattttagccgacccgagcccccgagggcaggactgagcacgagtgacctacttcaaatcaagattcttcaaaaggaaaaaacagcacagatacagcctttaggaaatgaaattgaaactgcttttattgaaatacagatgtaagagaaataagaatatgcatatgtggtagcccccggccaaccctgcacgcccgaggggggtgcggggttggcccgagcccaaaacctgacacccgatcccccctttaggggtagaagcgacgaaggtgttcgatgttccacgggttaggcaactctgtgccgtcacccgtggccagccgaaaggagcccggccgggggacgccgatcactcgatacggaccctcccacattggtgagagcttgctcaatccagcacgcgtttgaacgcggcgtaggacgaggtcgtcgacgcagagtgatcgggcccggacgtggtgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcgatttgcccagagcaccgctggcaactcctcgatccatgaattgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgagccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacaccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccatacttggcgtannnnnnnnnnnnnnnnnnnnnnnnnnnnnnnnnnnnnnnnnnnnnnnnnnnnnnn

SEQ ID NO: 35104 - DNA, 1547 bp, Oryza sativa
cgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccatacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtatgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctctttgctaggggccgcatccctggggcactcttcgtccaagcagcctcgcggggcgcacttgtcttctgtgccgacgacctcggggtcggaggacgacaggggcggccttcccacagtggcctcggggccgtcctgggggtcgggggctcctggcgtcgtcggacaagcgggtaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcc

SEQ ID NO: 35105 - DNA, 2590 bp, Oryza sativa
gaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggccatcatcgccgtcatcgatgtcctcggcgggggccttctgcttggcctcacttcgccgattaccggtaggaaccgcccgggatttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcaaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtagcggccgaatggcgaacagcggctgccgctcgccgcgccctccgtcttgacgatgcggagccggtggtagcagcaccagaggccttggtggcggagaactgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctctacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgtgcctttgctggctcggccattgggctgaacaggaaaagcttggcgcacacgaaagagtgcgagagctcagaaaatccctcgcagagcccctacctggcgcgccagatgacggagcgtggggctcctcaccgggagaccgcgcaggccccccttagccggttcggccgggggctcagggagagattctaagcactctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccagtcccccatctaagtgggcaaggtcctccttttatatcttaaggggataccacatgcaccatttctctcttttttgtggggacttaccccaccttttcataaatggacggagatttgtatagttgtcgtccgagtcaccatctgatgagacggctcacaactacctccactttcgccgggagctggtgcgacgtggaatcgtggctgtctgctgacgacatgaccggtatcagaccagtcacgtcggtcattcttgtccaccacgtgtcagcttagcattctacatgctcgccattctacacacaacatcttgcctgtaatggttaggatgaagcttggcatatatctgaccag

SEQ ID NO: 35106 - DNA, 1671 bp, Oryza sativa
ggggggactaagaggagggcgaacgcatcaccctcgggccggacgtccttcgggggtaccaggcaacgtgtgcgattgtgtctgccttaaacctctagtcatgatactcctgatcccatgtcaccgacagactatcatgccatgttcaggtggaaaaaaataaacatttttggctctagctgtttctcattcatcttcctctcgagagcgcaattgaattttgtatctggtttcctgtcttgaatcttttccttggttccttcctagttcctagaatccacaagcacctttgattttttttttctccctcgcagtaaaatgactgttgatgacattagccacaccacaaattaaatctaagtgaaaattaccgaaggaggaaaatatagtctttctagaatgatggtgttcatctcacacagatgtgattggtacatttgttgattttgcagaacatgatcataagacccagaagaaagttcttccattgtcataagctagggcatgacacgcacgtctcaacttgcgcgacaatggcacagtcgaaccatccacatcagcactgcttaacgaaagcagcaggccagcagccggttaatttctcgctgactcgcagtcaacgctgagtttctcgtcaactaattggacgttggctcgatcaaggcgattggaatgggcccaaaacgagagtgaaattattcgatcaccacaattcaagtccaacgagtaagtctcatttttgccaacagttttggcccaaaaactaattttcagcagaccatggaacaaaccctagagtgacatatgaacgctaactgagagaaggcctctcaactcaagtgattatgaacagtgaaaggaatcagctattgaaattttacagaaaagaatcctttacatcgttttacattttgacgctataaatcacaagtcctcgtgccattcagactcttcctcagttgctctatgatccatctagagatgaaaaacagatggtgaataaactcaatccggaatgggcggcaaacgagatcctatttgtcagggagcaggacaagccatttctctcttcttcttttcttccccattctcagccagttcatcactcatgtgcctttgttctaacctcttcaccattcttgctatcaatgttctatacttctacaatctaactgtctaaggccactcaccagaagtcaccgcaagaacaagtgcctccactgaaatgatggaatctgttggcgtctcggaccacaatttccctttcaaatagcttggacactagcttggtgaactcatggcaatcgccgcaaactctgaggttcttggcaatccttagaggtgtacctgaggcagtgctgatcaaaccaaacgatatcgcaagcctctcgctgtgcctatgcagcaaatctatcttctcttcttcgctcacatcatgcagaacaaaactagtatcctcgacatactgaccttctcttctcagtttttcagttatctcggcaagtttgagatgaatagcctgtgagtctctgtgagagtgatctcttgcagtgaaagtgtggacagtgtttcctatctcaatccagctgcatgctgggtcttttctcaaaccctgttctgtcatcttggttctaatctccttgacattattccacttgcccatttcggcga

SEQ ID NO: 35107 - DNA, 288 bp, Oryza sativa
gcacaccattggcgagggtaggcgtgatggagtatggatgggctggggggggtctacgctgctttcggatttaccaaggcatgagcggggactgcccatcgccttatggggataggggtgaaaccggaggtgggtgtactggttagtggtggttatatggaggattttgtcacgatttatccctttgcagtatcgtggcggtacttgggggcatggtttcatgtgcggaattgtgtcttgtgggtaaagttgtacacctttgatcagagtaaaacaattctaatagcc

SEQ ID NO: 35108 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgtaattaacgcgcgcacgatatgatctatctcgactgccacaaccgcatacccacctcatgcgccgcacgcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgacttcccggatcgtgagcgagagg

SEQ ID NO: 35109 - DNA, 604 bp, Oryza sativa
atctcgacaaatgcagagtcgtcgcgcccaacctaccaacgaagaccgacgacctatctcatcgcaccggccgtggctggactatttgagaaaaggttgttgacggataattcgtcatgaacgttgtcggcttgatcactcgatatgattgcgaacggacatccggatatgctataagtttggtatgtgagtcatgctggtcacatgagatgcacatgtaataaaccaactctagcgttctcgaaccagtacgtagcaatctcccgcaccgcaaacttccattggtgttcgagagatgattctactcgctcgctggttctcgaaccagtacatagcaatctcccgcaccgcaaacttccattggtgttcgagagatgattctactcgctcgctggttctcgaaccagtacgtagcaatctcccgcaccgcaacctccattggtgttcgagagatggttctactcgctcgctggttctcgaaccagtacgtagcaatctcccgcaccgcaacctccatgggtgttcgagagatggttctacttgctcgctggttctcgaaccagtacgtagcaatctcccgcaccgcaacctcagatggtcgagg

SEQ ID NO: 35110 - DNA, 752 bp, Oryza sativa
tacacccctggatctaaacaccctctaaatatgccatcttcagtcttattggcttggacaggaaacaggagagaacatcggctccacacgttggcaaaaaaactatagtagcttcagagaaggaaaagaacataagccaatccgtgtaagcacaaaaatgtgtgaatagacacagttataaagcttgagtgatcttaggattaaactttgagcaattttatagtccttgaggagataccaagtagtaccaccttttttttattgtaaatttggtatctcataggtacctcatggtacctcctaaaggatggtaaaattgctcttaaattttagtgtaaaatcatgctctcggtaccttcagtaaattttggtgtctttcaaggactgtaaaaattcttataatcttgtctcatgtcatctcaagataacattatcaaccaatcgtgtcaacacaacatcagtaagtcatcttgacttggactagaatcattcaaaagtgataaagaagcgcgagatgcatgattgccatgtcatgctcagagagttacaatattgcctaacttgataaggacgagatatggatctgctgcatattgcacaagtatgtcataaatgaaaattctttgtgccatgtcaaagtgcgaactttcgctcgaaataataaggctaatgtgacaaacctccaaaatataaatgtggggtggacatggtaatgcttcatgtgaaacatttcccttactacaagtagtaaa

SEQ ID NO: 35111 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnntgcgtgaacctccctgccattgattaacctacccaaatgacccactgcagacaataagctcacaatgcaagcatgatcaggattgaaaccattctgtaccatttcgccaaaaaaatcgatggcctcagcatatagcctattttggacataacaggagagcattgagttccatgatatgtagtccttgtcaccaatctcacggaatactctgagagcgctatccacccaaccgcatcttgcatacatgacaagcaaggcattgcattggatattgaactcggtaccgcatttcagaagcgctgcatgtagctcccttccatggttcagctgagcaagctctgcacagacctgtagcacaccaacggttgtgtaagaattcatactgaagccgtcgctctgcatccgtcggaacaggtcgagagcctccaagaacatcccgttctgcacgcagcctgatatagccgagttccatgaggccacatccctcccgtcgcgcatccactcgaacacccgcagcgccgaatccaagaggccgcacttggcgtacatcccgacgagcgcattggccacgagcgtgctccggtcgagggcgctctttaccgccagcccgtgcaccttgctcccgaaccttccgtcccccttcgggccggacgccttgagcacggacgcgagcg

SEQ ID NO: 35112 - DNA, 1094 bp, Oryza sativa
tcatcaaaaactttgagagcgtagttcatgcttccacaaccagaatacatgtccacaagggagctaaccacagcaccttccacgggaaatttacctctgataaggaaaccatgaatttcctttccttttgtcaaggatgacaatccagcaattgctcccagaataccaactagtgctacagaatcgggttggatgcctgcattcagcatcttgccaaacaaggcaacagcttcatgtaacagcccattctccgcaaaacagtttaccatactagtccaggtaacaatgtcctttttgtctaacatttcaaatatattaagcgcatagcaaacccctccacactctccatatatatctatgattctattcttcagtatcaagtcaagcaagccatttctaatagcataagagtgcacttgctttaacagtgagatgcttttcaaaccactgcatgcttccaaaatgcttcccatcatcataggatccaccttaatgccctctttctgtgctgttctaaactttccgattgcctcagaataccgagaactttgcgcgtaacaggcaatgattgttgtccatgacacatggtccttaatcctcatcctgtcaaatacacgggcggagcactccacggagtagcactttatgtacatgtccatcaatgtattagctatctgcaaatcactatcaagcctttgcttaacagcatatgcgtgaacctccctgccattgattaacctacccaaatgacccactgcagacaataagctcacaatgcaagcatgatcaggattgaaaccattctgtaccatttcgccaaaaaaatcgatggcctcagcatatagcctattttggacataacaggagagcattgagttccatgatatgtagtccttgtcaccaatctcacggaatactctgagagcgctatccacccaaccgcatcttgcatacatgacaagcaaggcattgcattggatattgaactcggtaccgcatttcagaagcgctggatgtagctccctttcatggttcaactgagcaagccttgcacagacctgtagcacaccaacggttgtgtaaaaattcatact

SEQ ID NO: 35113 - DNA, 8224 bp, Oryza sativa
  unsure (1)..(8224): unsure at all n locations
nnnnnnnnnnnnnnnnnnnnnnnnnnnnnnnnnnnnnnnnnnnnnnnnnnnnnnnatagccgagttccatgaggccacatccctcccgtcgcgcatccactcgaacacccgcagcgccgaatccaagaggccgcacttggcgtacatcccgacgagcgcattggccacgagcgtgctccggtcgaggccgctcttcaccgccagcccgtgcacctcgctcccgcacctcccgtccccctccgcgccgcacgccttgagcacggacgcgagcgtgcacccgtcgggcgccgcccccgccacgggctccgacgcccgcatcgcccggtagacgcccacggcctcgccggcgcccccggacgacaggcacgccccgatgagcgcgttccatgagaagacggtccgggcgggcatcccgtcgaacaggcggtgggcatccgggaggcgcccgcacttgccgtacatgaacagcagcttggtcgcgaggaaccccgcgtcatcatcgcccagggcgcccgtggccaccgcgtgcgcgtgcaactgcctgccctccgagacggccctcctgacggcgacgaggtcgaggacccagccatagtggtccgtgggaggaggggcgcgcccgcgcgccgagcgggcggcgagctggcggagggcctcccgcaggtcgccgtccttgcagagctgcctcagggaggcgccggcgctggcaggcgggagcttccggcgaggggttgggtggaaggggagcgcggcggtggtggccatggaggctcgtggtcgtgggagccgaacgctcatgtcagcgccatggcgaagcaggagaagaggaaaacggattgggatttgggggagaatggattcaggtcgcccgagcaggctgggaagtgggaatgggtagcccatttaagcctctctaaggcctcgtatggataggccacaatagcagcccaactacataggtggaccaagattttttactaaggaaaaaagtacaccgaatgtccatcaacttgtcatcgagataccaaatcgtcccccagccacaaaaccggatacaacacatccttcaacttataaaaccagtgcaaactaggtccctcagcagttttaaatccgattttgtccgacatgacggctgagtcagcgagggacccacgtgggccctacatgtcaggatgccacgtcggcagaccagcctccccctccaccggcgccgtcgacgagccatgccgctgcggaaacgcccaccgcctccggccaaggctccagaagccccatcagaaaccaagcccaagatctcgtagcccactagacccagcgccgcggcggtggcgccgcctccgccgatggttctcccggacagtgtcctcgccgccatgtcacaccatgaggggggatctacaaagctcgtgttcgcgggaggggacaagggcatgtcgcagatgaagttccggatcaagaccggatgctgatgagcaccctcaccaagcacctacgaggcctcacctccaagggtgtcctcaaggtggtcaacagagtccacaagcgtgccgagaagatctacatggacgcccgcatcgacccgtcgccggagatcactagggaacctggtaccgcaacggccagctcgactccgacgccgtcacctccgcacagcgtaggtgcctcgagcagatcgacaggcttggcgtcgccacgacagagtccatcttcgacggcatcagcagggattaccctagcctagcctactcaaccgagcaggtcagggacatcccacctcgtcgttgcctcctcgccggtgaagagtcgaaggaaatagaagtagagaggggagaggtggacgccgccctgctgcacgccgctgccctgccgctcctgctcgcccgtcgtcgtcctcgccgcgtcgtttccccatccgccacaccgcgccgcttccccgctgcgcagctccacccctcaagcccatctcctcaaccgctggccactgcccatctcctccccgtgcctctgccgccacccaactccaaggcttcccccaccggcgtcgcggccctcgcacggccgccgcggagctttgccaagctaccactgttgccagccgccatcgtggcgccaccctcctcctctcccgcctcgccccaccaaccggcctacaggcaaagagagagagaaagagagaggaggaaccgagggagagaaggagggagagatgattcagcctgacatgtgggtcccacgctgactcagttgccacgttggacaaaaccagggtcaaaaccaccaaagaaccaatgtgaccgattttgattagttaagagacatcagatatctggttttgcgattttgtggatgattttgtaactcgttaacaagttgagggacctttggtgtactttttccttttactaaatcccggcctatcgacgtctattggccgggaatgaggcccatcaaacaatgacaaacactctactactcccttcattccaaattatacagctaaatttcttatattttagttggatataacacatcttactactacgaatatttacaccagactaaaatttttatattttgggataagaggaatacgtaatattttgttcgtttcataaaatatgaaaatagtacgaaacgggacatcttccagtactataaatctgaattggtttgttttcatgaacggagggagtagatgattactatttgatcatgtagttttgagtggtttgctcacgtcgcgtggcgatttgccattgttgttatcgaactaatccattagttttctccttaatactgtttacgtggccatctttttggtcgcaacagatgacgccgacgagtatatgacttgccctttgacacgccgcctcctcccccttcattttctcgaagcgcttcccttcccttcgcttccccgcacaatctacaaacgcgccacccgtcgctcataaacccctctccctctctctctggccgacacatggaccccaccgtttccaactccggcgacgccaacggcggcgcggccgccgacgccaccgccccgtccaacaccaccgtcaccctcccgccgctcaccctccgagacgtgcccctgctcccgtcggcggcggcggcgaccgacacgatccccaacccgatctcccgccacccctacttccacccgccggccaccttctacatctccccgggtgacgtctccctccgccacgccttcttcgacctcgcctccgcgtcgccgtccccgctcgtcgcctaccgccgcgcggggccgcgcgcgggggtcgccgtggaccccgcccgcgcgcgcgccgcggtcgtcacctgcggggggctctgcccgggcctcaacaccgtcctcagggagctcgtcgtcggcctccgggagctctacggcgtccgcgacgtcttcggcgtcgccgccggctaccgcgggttctacggccccgacgccgaccacgcccgcctggacctggccgccgtcgacgactggcacaagaagggcggcaccgtgctcaagaccacccgtggtggctttgatctcaacaagatcgttgacggcatcgtcgcgcgcgggtatacgcaggtgagagcaaacccctaccgtttttagagttttcaggttttatgtatttttttggcaaatagctaaagtttaaactgatctcacaaatcatgtgcacgtggaaacccctaagcttctttttacgccaagctggcaaatgaaagctggccaattttgttaagattagaagcacaagaaacatgttacaggtatttgcaagtgtacaatgtgtcatctgaattggcaaggatactatcttggtgctacaaatttgctttagacattttagtatgttggtgtacaatcatgggggttgttctgaattgacatggagtagtacttattatgttaggtgtcattatggaagaattatctcaaagaatttgtctgtccagaatttttctttgtcagtagagtttctttttccaccgggctctttgtcggttagagtggtcaagtactcaagtggttgaagtcttactgatttgatcgatcagcgttgagtcgtcttgctagttcaacatgctaatttgtttcagttattgcttgtattttggcttattaaagtgtctgacctcaaacactttttatcatgactatatcttgctgaaggtttatgcaattggaggggatggaacaatgagaggagctgtggccatcttcaacgagtttaagcgccgtggtttgaacatttctattacagggatcccgaaaactgtggacaatgatatcggcatcatagacaggtcatttgggttccaaaccgcagtggagattgctcagcaggcaatcgacgcagcacatgtcgaggctgtgagcgccgtgaatggcattggacttgtcaaacttatgggcaggagcacaggccacattgctcttcatgccaccctgagcagccgcgatgttgactgctgtttgattcctgaggttgatttctatcttgaaggaaaggggggcctgtttgagttcttgtatgaaaggataaaacagaagggacatgctgttgtcgttgttgctgaaggtgctggtcaggaattgattccaaggactgacgatcaaaagcgggagcaggacgagtccggcaacattgtgttccttgatgtgggtccctggttaaaatctgagctgggtaaatggtggaagagagaacacccaagcgagttgttcactgtgaagtatatcgatcccacttacatgatacgagctgttccagcaaatgccactgacaatctgtactgtacattgttggcacattcggcgatccatgggatcatggctgggtacactggcttcgtccctggcccgattaatggaaactatagctacataccgctggaagatgttgctgtggcgaagaacccggtggatgtgaatgatcacaaatgggcatgggttagatcagtcacaaaccaaccagatttcatgaagccaaaatactaagaccaaaagtgctgttactggacatggttgtatgactttttctccctggagccttgacacgttaagcttgatttctttctatccagtttcttctcttgttatgccgatctatctataagatgttaggtattctgatctccctggtttgtgtttgtgtgcacttgaaatcgtgttagcaggtattgctgtaaatctgtagtacataaataaatgaagtggcaggaaatgttgttctccattggcgaatgagttatatgtcgtgtcatgtaaatattgcttatcttgaagacttaattggcgattctgcgctaatctctcgcttaaagaatcagaacattataacgtgaaatattatagcagacatatccaaataaattggcctattagctcagctggttagagcgtcgtgctaataacgcgaaggtcgcaggttcgagacctgcatgggccattattttttttttctttttccttgcaatcgtgattcttttttttttccctttttttgcctgaacaatgttatgttattgtgtgtacgtgccaagatcaaattgcgattcctgagtcctgaacaagtgataaaattgtgtttgtgtatgtgtgtctactgtcaagatcaaattcctgatgatcaaaattgcaatcctgagtcctgaacaatgtgatacaattttgtatgtgcgtatgtttttcaagatcaaatccccgaagatcaaaattgcagtcctcattcctgaacaatgcgatgctatgttccacataatcccaagttccgacaaactttatgccctatacaaattacacaggaatataggcgcaaaaaagaaaacacagcaacacgactgcaaaaactgaggattactccaccaaacatagaaaattttggtaaaaaataaacatagaaaattctggtaaaaaataaacatagaaaattctggtaaaaaataaacatcgaaaattttggtaaaaaaaacatagaaaaatcatattatgatctttctctttctttcttttttataccttttttctctttaacttatcctctccagtaaacctctcatactatgatctctctccccttccccttctcacgttgagctcgagcggcgggcatggcgggcggcggtgtcgcgcgggggtgtgcagatgatcctgcgggcgccgctagaggcgggaccgccgccggcgttgggccgggcgcaacggcgggagagtcgacgccgcggtggattggatacggggacgacggcgcggcgcggcttcggctggaattcggcctcgatcctgggcgaggttacgcgtggtggattcggggactgttatcccgtgaaatcgtctagcgatgtgaggggggggggggggggaactccactcttatggaataatgctgctgttcgtccggttttttccttcagtccagaaacactgaaactaagatttcccctgcaggaaaggattccttcagaaattcctccaatccaaacgggaccagccatctccgattgatagggattatccacgatcgaatttgtctgctccgaaattccctgagaagtagtgcagagtacagtccatacatgttcatgttcatgttcatattattaaaggataggagtactctttcaaagtttcaatgatttgtttttgaagatctttggcttcatccaaaatcttttcaatagcccaatagcccaattttcttcttttttttttcttctatagaatagcagatgaaagttgaaacagtggaggatgttacagggtgaagcaccgcaccaccaccaccgcaagcaatcggcatggacaaaatatatctacaccatgtacagcaaattacaatctcagcttggctcattgataggtactactagctaatgctcagtgcattcttcagttcttgaaatattttctctccttttttttgtttcactgactaatcctctcagtccgtcgttctcgcccgcatctccccctcgcttgcggggatgatttgatgaactcgctcaccgtggctgcaactgcaaacctgtcaggattcagagcaaagtggctcgatttctatgggcagacctctctggaactccacgtacgggtatgccatcggaatgtcatcgccatcgattctccatctgcacaggttttcaagaaacgaaagaaacgaagaacgatgatcagcctttctctggcatggatattcagtaagtacatgtagactctactctgaaacaaccgcataatttacataaatctgcctgttcttgtcagttgtcacgtatagattgttgctaatgaacctagttttttttttaaaaaaaagagtttgatcatatcgtggtagtatattttatcttgtatggcagccctcaactcaacttgcatagcctacctatcgaaaactccatgctgtcatgtttgttctgtgtgttgtcgtctgattctatgctctacagtgccacttatgaaaatgcacaagatagctgagttcagacttgcggtccttacagacaaaagcataaataatttgcctagttgctgtcatggccttcttgccattacttactagtggtctagtgtagtgtgtattatcagtatgagagtggtaactgcatcagtatgttttcctgttcatgtttgcctcaacagttttctatggcctatttaaacaccaactactctgcaccagcttcttaaatattacttctgaacgtattttgttcattgctgtttaagccagtcaactttgatccatgcatcttctactcgggtaggacaaatatacccttttgttttacctataattgagcacaaggtgatggaggaagaaagcagcctctacttttgcaagctctgatccagggcagagccgggggccaccgccgaacggcgtaaacttcttgcttgtcccttggcttgcaccctgttgcatcaatcagattaggaacacacatgaatcagaccattagcttcatcacagaaactaagaaaaggaagcaaagccaagaatgctggctttgaatgagaggaatcatggttaggaccatgcacaaaaggcattgcagccacagggagcttgtttggcatctgaagacaccagaatagttgcgagtaattatgtcatagttgggcgctcactaattaaaggtagcaattagttagagaacaccctttaaagaagattctttcaaggctccagataagctctcttgataggtg

SEQ ID NO: 35114 - DNA, 703 bp, Oryza sativa
  unsure (1)..(703): unsure at all n locations
nnnnnnnnnnnnnnnnnnnnnnnnnnnnnnnnnnnnnnnnnnnnnnnnnnnnnnnnnnnnnnnnnnnaatggaagctctctggtgggattggcatatggcgctatggtggcattgtgaaaattgcatcctcaagtaagaggttgccttcatattcatccaggggaggaggttcagctgatctgaaccaacaaatgctggaatttgtgcaccttctgtctgaagtctcccttgaggaatctagagttggagaatctcagcattcacttttccagcaatttgtgcttcgagttgtgcgggcattccttcaggaatggggtgaagctgagggcttgcccttagatgatatggtaggtaagttctacttattattgtataatattcgctgaccacctgatttctttagtggtgctctcaccaaacaagctgagccttgacacaaaagaaaaaaaaatgtgttaaattcctcacgctggtgattttttttttcaggtccttgaaacaatacttgaacaagcctgtaaagaattcaccattctgcttgcttcccatcgaaaccaggtacttcattgtttgtgaattacctaatagggtattttgttcaattttcaatggtagccccgccgcaagcaattgcaaaaactaataactatgtcatgattattgatcaatttttgtctatgattcagttttgggctggctgtg

SEQ ID NO: 35115 - DNA, 722 bp, Oryza sativa
tacagtagttcatcagctctttttctgaaaagggtgaaacctacaaatatccatgaattccaaccttagcatctagtgcttggatatttgtatccctgatatttcttaatcgctttttcttcagagcaaaccagttactgatggtttcaagcagtttcggataggagcctaggagggtgacacctcgccatcatcaatcagagaagaaagctagctagttgctcatcctaaagtggactgcgatatatattatgctgcagcaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagcgcaaaaataggacagctggaccaatccattcagtcagtggtctccaatgtccacgcagatgtgctaaaaatcagggaaattgcagtccatttctctgaacttttgaagtgatgatattataatttcacaactgaagctggcagtaacttaaccctacctgcagtgtgttggcagtttgcatgcaagatcaacctatctcctcacaaatatcagtacagcaatctccatgtagatgcatgacagaatgagaatctgagttcatgagctggggaagattaatcattc

SEQ ID NO: 35116 - DNA, 1722 bp, Oryza sativa
  unsure (1)..(1722): unsure at all n locations
nnnnnnnnnnnnnnnnnnnnnnnnnnnnnnnnnnnnnnnnnnnnnnnnnnnnnnnnnnnnnnnnnntatactatatttttttaaaaaaaaatcatacaatacaaacgtatctcggcaaaagtcgagtcactctctaatattctccacgggtaaatcctcttgcgtgtggcgtccggactttccgatcatgcgtgcatcgatcgatcggttgcatggtcactagctctcgatcccgagaacccgggcgtttaattggtcagtcatcagtgtgtgttaggaacgtacgtagttgtccgagtactaattattactagctcgatcggagcttagctgctactgtacgatggagtgcgatgtgtggttccgatcgaataggctcgtgttgcttccttctctctcacctgcgcacacgtactgtacatatatacgccccggcccggcccctagctaatacctgcagctgtgtgtagtatatatagagccgtttgtgcgtagctcggtcgatcgtatccatcacgattcacaaggcagttaatttgatcttggtttttcgagctctaaaactgctgatcgattcaatactcagtagctagctagctatagccacctaattcatcgccacgtacaaacggacatctgctttctgaaactgtttctgttgatagccggtgatcataacagcgcagataaacgtacggcttccaaatgaaggtaagaaaaatcggtctccgatgaactccatctcctctgaacattctgacgcagagagatcaagtggtactgcagaagaagaaacgagaaatgatctcgtttaatttcttaatacatatatggtcgttctttgatttgtattgcgcagcaaaagatcgtgatcaaggtgtgcgcgccgtgcgaggggtgccgggcgaaagcgctggaggtggcggcgagggcggcggacggggtgatctcgctggcgatcaccggcgacgacagggacaagctggaggtcgtcggagtcggcgtcgacgtgacccgcctcgtcatctgcctgcgcaagaaggtgtgctacgccgagatcctgctggtggaggaggagaaggaggaggaggagaagaaggagccggaatgcaagccgtgctactggcctccctactggtgcccgccgccggaggatccgacttgcaagccgtgctaccctcgctacagctacgcgccgccgccgccggcggtcgtcgtctgcgacgagcccagcgcctgttccataatgtaaaaaaggaaaaagaaattaaagaaaaaaaaagagatttgaaggaagagacgtctcttcaagcacttttttaagaagaaattgtgaacgtgttaaggatattgaacacaagatattgagattgaaaccacacgacccttatattaccactgtactatcaagtgcacctctgttccatcacgtagattagtcactcaactaaaaccggcgaatatatataccttacatgcatcggttgaaaaactaatgctgcttaatttcatggtgctagaccaaaacctgtacacatgaggaatttagaatcggcactaacgggggttctttgctagtgcatcatgttgtgtaagcagagagacgttaacatacttgcgggtgcaatggggtggcacgaaataccttttacctatattggaaagaattttggtacaaataaccattaccacgtaaattattgaattttaaatattacagaa

SEQ ID NO: 35117 - DNA, 529 bp, Oryza sativa
  unsure (1)..(529): unsure at all n locations
nnnnnnnnnnnnnnnnnnnnnnnnnnnnnnnnnnnnnntttttttgtcagggttaacattgtgtttacttaagctgtttcattgttcaattcactcaccctgcaagtcggcaacctcctgtcatccctgtgaatatctccacataaaagcccttttcaccttgccggctacgaacgcttgcccggtcggtctccagctcacccgcctgatcgaacggccgacggagctctcccggcgcagcacggcgccatctcggccgtccgtctcactcactcgtcactgatagatcagccggtttacttcccattacccagtattgtaattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35118 - DNA, 613 bp, Oryza sativa
agaatggccctccgctggatggtgaggcagaattgcctccgttgttgtagtcgttcacggcacctcctcctggcgcaccagctcctgtcggcggcggcgtatcacctccgccaacagaggcggcagcaactctagacatggcgatgagcagtcgtgcgggaggcactccccaaaaacctgatcacccgcctacccggtgtagatctcaggccaatctctcgtgcgtgcaagagatcagaagcggggaagcgagagagcaactcaggcacggagggaatcgtgggaacgtgggttagtggctgcaaaaggatagcgacgtgacgtgacgcacgcacgccgccagccacgcctcgcccacggcccgcgcgcgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacataaaagaattagaattaaaaaataatttattattatcaacttaaaagagtatatagaagatatat

SEQ ID NO: 35119 - DNA, 1091 bp, Oryza sativa
  unsure (1)..(1091): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttgctagagcaagagggccagcagttcccaagggctcagtctcttgggaacacgtgattgtgatgccaagcttatcctcaaagtccttcaggaaattgagcattacctaaaagacggatacagaacaaaccaattagaatgcgaagatagttatacttataccatgagacaacagtaaaatattatctcctttttacctccgggcggtagttgatggctaaaacaacttctgttactccaacttctttcaaggcctcaatctgcataaaccagaaaacttttaattcagagctcattactctcctcaatcctcatgctcatgtttgctggagccaacattttggatataaatgaagtactcttgataactgattggaattttcaaggacagaaaatttggtgtgataccaaaagagttctccaaaatcatgtaaccaaattgataaggaaagaaacagttgaatagtaaaaaggtgcattcaatcacatgcaaatgccacctatcatggatgtttagttgttacaccatgtttatgtgggggttataaacaaatcaaatagtattaatgttctttgaccagtttaacaccctctccctcctttcatggagaggccagtgtcagtgttggaatgttggtaaagaatactgtactaattaacttgtgcccaattcatcgattggcattgcaaattaagtgctcttattactccatcagagtactagcgaaaccacatattacctgatgcagaatcatgggcttgttcgcgaaatcaacaagaggctttgggaaactgagcgttaaaggccgaaggcgagtgccgaagcctccaaccagaatg

SEQ ID NO: 35120 - DNA, 22580 bp, Oryza sativa
  unsure (1)..(22580): unsure at all n locations
cttccggttaatcttttcgtccgtcattaagagtgggcccacacgataattcgtcgctaatccatgatccgaaagcgtggccacgatctcttacgcctgcaaataaaggagaaaagaaaaataaaaagagaaaaccttgtttgtggagcagcccatccaaagcagcccggattggattagtgacgaggcagcccacccaaagcagcagcaggccggcccagatagcagccgcagcccaccagcgagcccacagagcggaggagaagcagcccaccagcccagcacagtactgcacaacactgtagcaaccgaacacgaataaagtttggactcacgccaagcaggaatcggataataaaagaagcgattttattacttaaaacatgtagtcaccaatgtagtcaccaataaaatgaattatttaccgacaaaataaattattttttaaaataaaaataatcacatgtgtctttctttttttaaaaaaagaagtaatcaccaacaaaatgaatcgtgtttacatttggatttttttcccctcatcaattgctcattcgccataggacacctaatcacatcacttttttttccattcattatataatttcttctattatttagagtgaaagttattctgcgatataccacatttttttctttccttctaattatttaagtgaaaggttatgcaattggagtgcaatgaggttgatctgatagctagcaaaaaattatttcttgtattatggctactctttacaatatgaaaaaaatgcttatcaatatcgagtaccaaaaaaataacaaagtactgcaattgactcataataatacatgacaaaaaagtaaatattttttgtggtttcaaactttagtatccatgtcagtgcatttagagcagcaaataattatatcatgttagcgtcttatttgcactagaaagattcgattcgactataaagacctcaatttacctggtggttttatgctcccacacactaattactatttctgtcttcacccaatgcaacgcatgggcattttgctagtagatatagatatagatatagattagatatagatagatatctacctacctatattataattaataatataataaaaatataaatctatcatatacctacccctaattaaaaaattcagtccgcttcgtctgtcatctgtatgttttgagtccaagtcggtcttcaaggaaaaaaaaatccccgtgctagatacccaaattaatcaatcaaccaaaaacagcacgaaaataccaaatttaacctagatatcatgaatttgatcccaagaaatctaatcccccaattcgatccatctgagccaagacacaatacataaacgatagaaaatgaatcacgaaatcacaaatccaaaatcatccagggaaaattaactcacaaaaactaaatcagcgacgccactggtcatgggaggcgaggacgccgcttctacgaggagggtgccgccgccgaggctgtcgataccgtccgttgtgttgtggcggagaagagggtgaggacgccgccgaggagccagggggagggcaccgcggctgagacgccggctgccaagggaagggaagggcgccctgggtgagtggtagggaaagcgacgtcgtcggtggggggagaggaagggcgcgctggctgaagggtaggggaagcggcgttgccggtgggggaggagggggccggagagagggactgagggagaggaattaacgcgccgcggagagaggagagaaggtggggaaggaaagagataataaggtcgatggggccaagcattgagacgccgctctcttctctagtctagtctcatcccaaacacttgatttcctctaaagcgacacatgtcccccctccttctctcctaccatgtggttcccaattctttatttttttttctcccggtgagatgcagggtttcccaaaccaccagagccggggttaccgtgccccggcggtaagcacggttaccacacggtaaccgtggtaactgtgaaaaaccgtacaaaaccgtgcaaaatttatcaaaaatttaaattattttttaaatttatttaaatttaaggaggttaccgcggtatttatattaccgtatccccgcggtaagcccggttaccggcggtaagggaaaccctggtgagatgttgagcttgggtcggaccatccacgcggtgttgagcgccattgagctcatagtggcagccgggaattggagtcaaggcatcaagctaagccctaccaactttttcttcaaacttccaacttttccatcacatcaaaactttcctacacacataaactttcaacttttttcttcaaactttcaattttaagttaaacttccaattttcgcatggaacacaccgtgctgccgtcctactgaatgaaagataaatcacgtgcatgcgttatctttttttttcgaacagtcagaccgttgccgacgttttatataaagaagaatgtgtctcattttaagaagaaaacgagacaaaaccttacaatgcgcagttaattaggaaaaactggacgaaaaccacaacactctaacataagctaccaacaccgcgaaaaaagaaagaatggcgaagcccaaaacagccatcgataaagagcttgttgaaagcgacacaaaggcttcgacttcgcgtggcaagtgttatcgttgccgagcttgtcacctagcgacacagcagcttcgactccacagctatcacatcatcgttaccaaaggcatcgcagaaaacgagcaagacaccgactgtccactttgaacatcaacccaagccacttgagcactactacttgtacacagctaacaccaacctccctcgaaaacttcaacgtgttatcgttgtcaagcttcatcgcaccccgataaagtagctccgacttcacctagaagaaaacggagaaagttggacacttgccacatccaagagcggcacccaagagacgaaggcctcgccgaatagctaggcttatagagcttcgacgtagggggtccacgaacgaccatccttgcatggaaaaggttcttggtagtgagggagacgccatagcaacgcctccaaggaggggaacgacgcctaatggcgccgccgtcgtcaagccaaccaaaggccagccaaggctttcgccagcgtcatccaaaaccacacaacccacccgcacaacgtatgacgccggaccgccacatcatccctctagccaccaagcctagcccaccacccacaacttaggcaggctcacgagtccaccgtgctgccaacccgctgccatcctctgctgcactgacccgatctggccaaggcggccgtggatcccgccgtcaaagcttgacaagccaacgtcaccgcgagcgcctacactccgctgcaccgctgccaccgtcaccaccgcaaccgtcggtgggcgcagccagtggctgccactatctccgcgccgacgagagcctcccgcaaccgccggtggcgcgcccgccccctccgtcgcagcaccaggccccccgctccgttacacgcgctcgattccctccgtggccggcctcccgtagccatccccacgccggcgaggccacgccggcccccacctcgccttggcagctcgccgtcatcatccaaacgggggatctggccaaggggcgccggaactggccgtccccatcatcgggccgagggtcaccgtcgttgcagccttcccgacacgtcgtcgacctccggccagcgcgccgncgggctnctncatgcgcacaccgaccacctccgtgtggacaccagctgggacaccggatccgaccatgagaggcccagatctgtccccaccatcgtcgaagctagtcgccgatgaccaccacttggggtcctccctccgtcttggcagcgccccgagccgccgtgcctgcgagaggaggcaaggagtcccgccgccgccgtccatgcgcccgcccgactttgccagtggccgctcgggcggcggcgaggcggaggggaggaggaaaagtggtcccgcccgtgccaccccgaggctgagcggcaggagggcttctcccctagggtacttgcctgcgttatcaattccaatctgcttcttgaactgcaatgcaaggagttgcctcatgatgaagttattcaatgattagattttgtatgccattgagtttagtttgtatagtgaatttcactaataatttttgctggtgactgaacttgactgagccttcaaggatttcttcgtgcagttgagccttcagggttataaataacgttgatgtttggacgattcttctcgataaacgtctcatgcgactatgcgagcatggatgctggtaagtttctctgctacattgagctcgactcctccgaggagagctaaagaatgggaaaccggagacgaagagatgagggggtaaacctgccctgagattttttcggatgagggtaggagtaggacttatatatcctacgtaatttccttccccgcatcaacgttcggatgggcgttagcatccataatttattatatataagtcaattctttttcgattttgctatatctcactcaaaagattttttcttatctctcactcgattttctcacttaaatttacagtgcattttcttgtaagttacagtgtaatttatgaaacttacactgtaacttttgtaagttacactataatttttgaatcttcgcatgtaaattttaaattttgtattggatttggtctttttcttgaggatatagtaatttagtgtccattatggtgtttcttaattgctttttactttttattatatctatcggattttaatccaaagattaaaaatctgtgtgatacgatcataaaaatctttcgaaagatgtataagtactcccattcttttttataaaaaccggtatatttgtcagtttttattaagaatcacatatatagagattcatagggatcggttttaacttttatctttcctaagagtaacatggattgaaaaatgttctataaatatcggtttcaaatgaatcggcacatatacgggtgcccttcattggtgtttctgtataatttaacatgtcaatgccattgtatatacatgcaccgcatataataaggatgggaaaatgtcacgcccagaaattcactagtaatttccgaactaatttgtgcataaaatcctcgtccagaaatcagccgagacacacaaactgataatttaatatacagaatcatcataataataacgttacatacttataaaagaaaagagaaaacaacaacggaattacggtctagcgaagctccggctccactccctcttctccttcgcaacttgtcttcaactgagatttgattgattattgcaaggtgagcatatgacatattcagcaagccacacagcaaatatgcaagcgcacaaggataccaaaggatggcataatatagagctcatttgcaaaagcagcatttagcaaacagttaagaattgtaaaacagtagagtaattaatcatcaattgctcaggcccaaccatcctgaacaaccatacccggctgtaccgatctatctccaaaccaggaatgtaccattccaaaccaggagctaatcaaattattaccagttataggatcagttattatggtgagaagtgtgagactaatcacgaaagatattgttagactcgcccatgaccgcgggcacggctattcgaatagttttactctggccagaggtgtaccactgtacccacaaaacacagccccacaacatatcaccatgcgcctcgataccaccacgataccttggaaaggagctgtgacagtatcccttgcacaacacaatccaccacagcgcatcgttcctggatcataatcaccccattataaaacaaggcatggactccccagcgactcccgtgggcttatctccgccacttctcagtctggtgccccgcaatgaaccatgctatacaaaaggtaaagccgttgcccatgctggcttgtggttggcacggttaatgtttcataaccgaaactcgtgaaccggtccttaattgtcatgagcacgaccatcaaaaccatgtgctcacaacccaccattatcaagttttagttggcaagtaattaattaaccactcacgattgaccatcgtgagcttccattaaatatccaaaagtgatagtgaagcatgatttatcccattagtgagctattgtttctaagcatggctaagaatctattataagcatctagctgaaccaaaccaatatataaggttctagctaattaaattataacccatagaaaaataaagtcatcttcggccataattaaataggaaaggctcaccacccggtgacattcgaaaataaatgcacagttgaaataaatagagaatttaaatataggatcaacatgctcaaaggaattgtgtttgggatctatatgacttgctttgcaataatcggtcttcaattaatcttcttgaatactcccggcacacacgcgaaccttcgaaacgacggaaacgacaagctaacacgcaaaacaaggaggaagactaataaaaaccaaataaacaatacataaaagtaaacaaacatgtagatcataattttagataaatttagagacttgaatagcctcattccgacttcatatgaattagttatgaattttacaagatttaactccaattaaatctattaaagaaaagactattccaaattaattaaacaatttacaaatgatttataactgagataaaatattaaaacaacctccggaaaaagattagaatatatttagtggatgacatatattaaaaaggaataatatgttactgaaaagaggaaacggatttatattgattttggacggctgagattaatcttgacctagtcgaccaatatcggaatgcttggattgatctggcaagcgggcctcacgagataccgactcaacgagtcaattctacgtgacacgggatcacccaaatgatcaaccgaaactggcgaacggaaccggcggctctgaacagctctaaactaaaggacgactccacacggatgaacgaacgaaacacggggaacacctcgttcgaatgaacgagcgaacgactcaacaacggctgcgactagaccgatggctagacacgattcacggtaaaagcattggtacggcaaacgataggccgataggaacctagggttacacctacggctagacaactcgattaccaagcaatgggctaaagtggcggctaggtttaagcgacacatagctgcgacatgacacaacaacgacaacacggcatgcacaacagcagcagcatggctgaggcagggagtggcacggcggcggctaggcggctagcggcacagcgatacgacaagcggtgtgcacggcagcggcacaccagcggctaaacagcgacgtggcggcaacaaggcgacggcggcagcggcggtgcatagagcagccggcaagcgacgcgacagtggctgcgctagggttagagcaacaacggcttggacagtggcggcgacacgaccgagggattgaaacctaacccgaggggatacagatagaagtcgcaccgaacccaaacgttcggagagggagagatgacgacggcgacccggcggcaacacacggagacgacgacgctatacagacaatggactaggttagattggattaaggccctagagaaaacctgcaccgatgaacagcatgggagcggcggttggcggcgaaccacgacacaataaagcaaacggagggcaccagaaggtagagaaggcgacggcgattcttacttacacttacacgatgacagacggcgacggaagatggccggcgatgagcttgaaaaggcggcgaggtactgatcaacggtagcggtggctttccggcgatccacggcgaagaagaggtggtggacggtgttctcctcgcagctgcgaatccaatggaggtgacggcgaagcttggcgacgacggaaggagcagcagggcctcgccggagatcaaaacgcgacggcgagcttcgggttgacggcgacgatggagctccggtggattttggcttcggggaagtggaggccggtcttgttcttgccgctgcggtgccgaagaaagtggcggcgctggacgaaggcgaccagggaagacggcaacggcggctgaaacggcggccggcggcggagagagaaggagcgcgcggggagagcgattccggcgactacggagagagggagagatggcggtcgaaagaggggagggagggtgcactatatatagccatgggaacccggaatcgagcccacatcgacgggaaaaactcgggaaagtttaggattctcgccggtaaaaggaaagattgattcgcgaaattggaaaggatttccatagaaacatttggggatttcttggggaaattgaagaggagattgagaggattccattcccgcaactaatttggaaaaaggagcaacgggaaggccggattggaggaggagatcggcacggctgcacaggctcggcctctgtccagaggttgaagaaggtactgtatcggagggaggcaaattagacttttgttttgggcttccttttccttggcacgattgaaggagggatgcanaatggacttcgggaatggataaggccggccgaaaagaagcaagaatgggccgataactgaaggtgaacttttcctgtttcggcccgaaaaggaaaaggggattttaattacttttcccaattaaattaatcagtgaaatgatctttcattgttaaaaatacttccaatgctcaaataattccaagaaaaatcttgaacatacttggacactctaattatttaacaatattaaaaacatatcatttaatgattaattttttaattaaataattgctgaactgttctttgtattattaaaattaggaattgagctctgaaaaatccgagaaaatttcagagagtataattaatcatggagaatttaatacaaattaaatccagccatgctttatgtttaggaaattttatttcccacatttaacttcacttgtaaattaatgaacttttaatataaattctattaataatttattgaataaattataaatcctgaaacgaaaaatcaggctgtgacagtaaattttagattagactcatcaattatccgaattcaacacctcaaccaactattcggtacacgcatcagcgaaacatggatcataagacttgaagcccatcaagtgtacaaagaaattaattgggcaagcgttctgttcatcaaggctattggaaccgacaatccgtggagaattttaaatttttgagtcaatttagtgattattgattccctgtaatctctagaaaaaaaacttaattgttttatttattttctaagtttggtcaatgcgtgtgtaaaaaaatgttggtagtgacttatgctccatcccgcatcgattagtttctgttcttatttcttttatacattcggctatgatacttaaaattttggattcgttttttagtgtcggtgcatattgtatgttgtgagttgtgattcggggatggggattaatttgcatttggggcagcagggagtaactcggaggattttttttttatcgtgtgtgcctcaaaggtgcaccgccgctgtgctaggagatgccgagagggaaagggaggaggaaggcgctgacaacgaggctgaggtggcgcggccgcgtggtggtggctggtggcggtggccggtggcgggaggcggatgcggcatgggtagcggtggtggtgattcccaaccatagtactagaaataggaatcggttgaaaggcttccgtgcgcgtgaggtttctacctgcgacggacgaaaaaattcatctagaagccttgcatattttttaatttttatatttactagaaaaatgtccatgccttgctatggaaaactacactttcatgatccaagcgttttaagagaatattcttcacggtgcacgcgaatacaatcttttgtcaagttctagataagaaggtaatttttnttcaaaacaaactatttcacattacaccaataaattattctatttgtacaagactgaaacacaaaataattgaaatccgatctcgacacggacttcgtgtcgcacatgaacatgatctaaaaagttacaactttaatgtacaagtctcaacattcgtacctatgagattgggcagatcacaactcgcggtgggcttggcgtaaaggtaccttgatgagcaccacgcacgctcctgtaacttattcacttcccccaccctataagctccacgctgaggcagccccaccctcagcagcaggctcacagaagcaccccccgtcacctcccgccccctctcccccacctcctccagccggggccgcagttgcctttctgccccaccgcgaagctgacaggtgaagaagaggaggaagccctttcggccatcaccggccctggtgccaacagctaggtgaccgcggaggagtggccacggtgggcacctcctcgcctctctcggccacgatggccgccgtcgtccgtgagcttgtcaagaggaggaggtgtgcgccgacggagaggacactactggagaagtgatctttgccaggatgggcaaaaaccacaattgtcccggttcacccaaaaactgggactaaaaattatttttagtcccggtttataagtgcaacaggaagatatgatctttagtctcggttggtaacacaaaccgggactaaatgtcatctttagtcccggttgtaaatgcgtcaggggttgtcaggcgccaggggatcttttgtcccggttggtgttacaaaccaggactaaagatgagagctttagtctcgatttatgttacaaaccgggactaaagatcatggtgatttttagacccggttggtaacaccatccgggactaaagatcccatccatatatagtcttcttcttcctctagctagcccgagaaggctgttggtatttcttaacgatattattagaaatataactccgagcaatggcgcagaaatacttctggtatattatggttacagagttcattcgcaagcgcacggatataccattatagcatttcacccgagagtattccaagggtatctgtcgacgtttgatgtcgcgattccggtatttgcatagtatggggatcataggtactaggatatatgcgagattgaggtaaaagagatggggatgaggatttttatacaggttcgggcctctgaattgtcaggtaataaccctactcctgttggccgatgccggtcattgctcttattcaccataatcacaccagtacaatatttgggggtagcctatctatttgttgtcgacgtgatggcttgaagtatcatcacgtagtcgacaacagggtagtcttcctcctcgaatccgtgcccggcgagatcagagatagtgctagatccctcctgacggtagtcgtaagtaccatacgaggggtcctcctagacaaatctctaacatagatatccggcgtcttgtcttggcgtatgttggcttgtatattgatctatcgttcccctctcccctttcctcatagggggccttgtatttatacccataggtgtcccattgtccaaatagaactagggaaaccaatatggatacaatccgagtagtccttgtcgtttctatgtagaactatattcatccttccttatgcggaactcctcctatatccgaagattgtttctgtataagacatggtatgtggtgggtcctgctgagatttagtgaactactattaggtatgtggtatccaaaaccctgacagtattgtatttatttaatcccgtgggaagatcatagtagagagaaccggactaataatttatatgttacttgaaataatcagagtctaagcagaggttaagataatccaagggtagagtgacacacaaggagggagctactcattctcatactaaaatatctaagctaagtggaaagaaaatagaaagagaatctattcctatacttctagtatacatagtatacatacattctagttataagattaactagctaatactctctatccgatgccctcttggtacttcgagaagccacccctgactgccgagttcctcacggcagcccgtcatgaccatacaaccagggctaaatacgaaggagtaccctccccaggaaattaacttaggactatatacacgcgcggaggaatacccgtgctgagctgtcaccatcagcggcccacttctcatccgcagcatataatccaaataatgatatcccgtaatctagacactacgcctaaactaccagatactactctaatatcatcgtcatgacatagagtaattgcataagcaaacgctatacccgtactgatgcatctcccagataagctagcagtataatcagtataacatgaacataatgcaaagttggcattcatatacttggaaagtatttcaataccataaatgtataaagaagagtattctaataaaagcaaaaagcttacaaaagagaagaggagatctactagagccatacctgaactcttccgaaggcttccggactccgatttctactctattcctactccactagcttcagaacactaaactaaacttgagagaatatgagagagctttgcttgagatgtgtgagtgaaatgagaaggtgaagtccttaaataggcaggtatgacggttgtaactgctgtgaaatgtctgaaataccctgcaaccgtcatcaggagaagatctagagcgtccctgccaaaccccacatccaacggtggaggtgggtctggttcggccgaaccaggggccggcccaaccagcccacaatttggctggtggccttctggacttctcttctccgaagacttgtgaattttggcccaattgatcgtgtcatttctgagttcttaagccatttatatataagtctgattttcgacatcgtccgattgattaatcgtcttatttgatgtcgattctcctctactttatagttattcactgcaaaaggttagtgatccaaatactagtggaatattattattctaacagaaatatgcattgcaagcataactagttctcttctattttggtaatattgacggtcgaaactgatcgctaacgaccgtcaacgaaggcttcaaaattttcttgagtttgaggggatgtgctgccaaattttttggtgattttgttttggtgataatatacaacttggaggtgtcaaaaaggttagcaacttcatcctcctctattttgtggttagcatttgcatttagagatatgttttgtacactattttgcctctataaatttggaatgggagatgatgagagagaaagtttgtgtagagatggaataatatagaaatttttttatttagaatttgagaaaaaacttgtgataaaagagatgagaaagaaaaagatagaaaattaatctaaaagaatataaaactaagttaatttaaattaaattaagtacaacacattaaatagtttacaactttattgtggaattgaaacatgaataatttggggtattattttataattattgtttgaataattatatataactattgtatgattgtttaattggttagaaaactaagttaatttaaaattaaaataattacaacacattaaatatttgtttacaacttcaaatataattaaaacatgaataatatgtggtattattttataatcaaatttgtttatttagaatttgaaaaaaaaaacttgtgataaaagtgatgagaaagaaaaagatagaaaattaatctaaaagaatagaaaactaagttattttaaattaaattaagtccaacacattaaacatgaataatttgtggtattattttataattattgtttgaataattatatataactattgtatgattgtttaattagtttggctttagtgaattatttttctcgatttttgtgctttttgtgtagatggatcggcaatgaatgtgcgcagacgacggtcgaaagagtttattgatggcgtgcatatttttctgagagtggccgaagctaccaagcagaataatggttttatccgttctccatgcactaagtgcaaaaaccagagggagtattttgcagtaagaactactcatattctcttgtttgagatgggcttcatgccaagctataatgtttgggcctcgcatggggagcaaggtgatcaaatggaagaagatgaagtagaagacgagaacattccggactgagctcaatatggtagatttgaaggaaatacaacgggtgaggtggaaagggctgttgaagataatgacgctgcaaatgatcgtggtcagatgttgcaggatgtcaaggaggactgcgaaagtgaaaaggaggctcagaaattagagcgtatgttagcggatcacaagacgtcattgtaaccaggttgcgaacaggggcacaaaaagttgggtacaactctggaatttttgcaatggaaggccgaaaatggtgtctgccacaaggcattcggcaacgtattaaaactagtgaagaacattcttccggaggaaaacaagttgcccgaaacaacatacgaaggtaagaagatagtctgccctctaggactggaggtgcagaagatacacgcatgtccgaatgattgtatcctctatcgtggtgagaagtacgagaacctagaagcatacccggtctgtaatgcactacgatacaagattagaagagacaatccaggtgaagttgacagacagccttcgaagaggagagttgctgctaaggtgatgtggtatttccttataataccatggctcagatgtttgttcaggaacaaagagcatgaaagaatgatgcgatggcacgcagaagaacgtcaacaagacgggatgctgagacaccccgctgatgggtcacagtggcgaaacatcgatagaaagtttaaagactttggaaaggatgcacgaaacgtaagattcggtttaagtacggatgacatgaatccatttggagagatgagcagtggccataccacttggactgttacgatgtgtatctacaacctccccccttggctatgcatgaagaggaaatacatcatgatgccgattatttttcaagtcccaaagcaacccggtaacaatattgatgtgtacctaagaccactggtcaaagatctgaaactgttgtggaaaaaagaaggcgtccctatgtgggatgaggacaaacaggaggaatttaacctacgagcgttgttgttcgtaaccatcaacgattggtttgcccttagcaacctatccgaacagtcaaacaatgggtacaaggcttccattgtttggaagaaactgaaagtacgtatctgaagcattgtaaaaaggttgtgtacatgggccatcgtcgatttcttgttgtgacccaacctgtcctcaagaaaggcaagcatttcgaacagaaggcggactaccgtaagaagcctatatttcgcaacggtaaatacgtgttcgatatggtgaaagatctcaaagtagtgtttggaaagggacctggcagccaacccatagccagcgaagatggtcacgcggcgatgtagaagaagaagtctattttttgggagttaccctcttggacgtccgccatgcaatcgatgtgatgcacctcactaagaacttctgcgtcaacttgctgggcttcctaggtgtatacgggaagtcgaaagatacacttgaagcacacaatgatctctaagatatgagtcaacgcgaggacctctacatggaaccaaaggagaaaggaagccagtacttgagcccaaccagctacactctaagcaaggcagagaaggaaagtatgtttgaatgcttggagagtcgtctgggtactcctctaatataaatagaataataagtatgaaggataagaagtttacaaacctaaagtctcatgactgtcacgtgttgatgacacaactgcttcatgttataattcgaggtattctccctgacaatgcccgggcaacaataacaaagctatgtgtttcatgaacgcaatttcacagaaggtcatcaatccagacaaattagaagcccttcaaaatgatgtggtgcaatgccttgtcagctttgagttgatctttccacctttcttcttcaacataatgacgcatcttccaagtcacattgtgaaagagatcagtattctccggctctcgggcctgtgtacctacccaacatgtttcctttcgagaggtacatgggtattctaaagaagtatgttcgtaaccattcttatccggaaacaagcatagccaaggggtatggaacagaggaggtcattgagtttttcttagaatttattgaagaccttcgtccaatcggggtggcagaaatcacgacatgaagggaggctacggggaaaggggactcttggaaggaaagcaattatgactgtagatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcttacaaagagcatttcggtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagccaggccgaaagtctgttttgcctccctggcgctacagtactccatcttcctcctccagccgactgtctcccgtgccgtgcacagtgccgccgattcccttccaaaatccgacctccccgttgctcctatttccaaattggttgcgggaatggaatcctatcaatctcctcttccttttccctaagaaatcctcaaaattttctatggaaattctttccaatttcgcggatcaaatccttccttttccggcgagaaccctaaactttcccgagtttttcccgtcgatttgggcccggacccgagctcccatggctatataaaggacccccctagtcctcctctttcgtttgccccatctcccgagctttcccgtgcctcgtagctgccgcgccgccgccgtttagctcgccgttgccgccggctgactccatccgcgccgcgccgtcgcctccgtcgtcgccgccggtcgccgccaccactgttaggtgcgcgagagcgaggagaagcctggccgctccctccccgctatcgccggtcaccggagcttccgccgccaccgccgaccgagccgccgccgccacccactttgtcgccggccgtcgtcgttcgtcgtttggttcgagggtgagtaccgttgggttcgtctcgtcgtcctctacgtgtgcatgccttccaaatccgcagccggccgctctagctcccgcaagcttgccatccgagccggccaccattgatgaggtcatcgctgacgtcatcatcgtttttttctttttcctgtttttctaatagattaaatcttcggaaattcataactaaatcatcgtaactcggttttgagtggttcaggttgctaaattcatctaaaatcatgatctacatgttggtttactttttatgtattgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagatgctaaacacaatcctttgagcatgttgatcctatatttaaattttctatttatttcaactgtacatttattttcgaatgtcaccgggtggtgtgaacctattcctttgttatggcctgtttgcattgattactctattccttgataccttgggatattataatttgactagttgagctttatatatattggttcaactagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatactggtaataatttgtttagctcctggtttggagttaaatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatatatcggtttagttattatgatggatttgtatattaaattgtcagtttgtgtacctcggttgattcctggacgaggattttatgcacaaataagtttggaaattactagtgaatttccgggcgtgacagtagacaacgatttattctgtaaagcacatttcacggttttgcaacaatcttcgttggtggctccttacatcgaggagcacatggcgattattcggtccaaaaacatcgttaagtccgatgcctggattgcacgacatcacattgatactttcccagcgtggctacgacaacatctcatagctaacgacgattaaccaacagcttgccttcttggagaggggaccatctggctcacgacatggcaaggatatgagatcaatgggtatatattttacataatagcccaagacagcaagagcacgaaccagaacagtgttgttcgtatcgatgccattagacagaatggcccaaccagcacgtattacggtgccatcgacgacatatgggaacttaactattgacctctgaaggtccctctgttccggtgccaatgggttaggctgactggtggaggcataacgatcgatgatagtgggatgacaacggttgaccttactaaggttggatactccgacgaaccattcgtcctagccaatgatgtaacgcaagttttctacattgaaggacatgactagcaaagcaaagaaggggaaagggcccaacgagtctaagcgccacgtggttctccctggcaaaaggaaaatcgtcggagtcgatgataagactgacgaagattacaatcagttcgacgggcaacttccgttcgcggtgacagttgacctgagcatcctcctatcaaatgaagacaccccttactcacgagctgatcataaggaggaaacattagtgaggagaaagtacgtgaggaaaaccgatgtattagcctagactgttgtatggatgatgtaaatttgttttaaaatgtattgaagattcatctctttctattgttgtatggcgatatctgattattagaatttaaaacaattttaaatcgaggatatggtaattatatatgattattagattttaaaccaattttaagttggggatagaataattatatatgatcattagaatttaaatcaatttaaaatcgatgatatgataattaatagagaaaagagagagcaagcgggcgacaaatctgtcgccgactacacgcaggctcctaggcacccaaattaactgcatccctgttgaagcaaaacaaagaacactgagggagagaggaaaggcaccatgcggtaaaaaaatagtaaaatttcttaatcttgtttaacgtgccaatagcctgttactgtattctctagctactaattaatttgctttacatgacgtggcacacttatatcgctagcagctggcttgtacacaaaaccaagaaaatatatgaaagagacaagtcggccatgtattaattataaagagctagctattatatgggtagtctaagagaaagctacaaagaatctttcaaccgacaaacatgctatattattagagtaagtttaatagtatatccaactactaacttcaattcatctataatcaatataatagcttattctacctataagcatatactacaccattaatatatagtcacacctttcatatacacatattgtattggagttcgtgcttcaggtagctacaacgcttttcttctctctcttctttccttctctttcttctcttctcttctctacgtgtgcttacagctgacctgtatcttgctattgtactctcttctagccttgctctcaattgctcgactactgcagggatcttgtacatgctttcctccgttcttttttgggcttgtttagttagggaaatggaaatttgtaggtgtcacatcggatgtttgaccgaatatcggaaggggtttttggatacgaatgaaaaaactaatttcagaactcgtcggaaaaccgcgagacgaatattttgatcctaattaatccgtcattagcacatatgggttactgtagcacttatggctaatcacggactaattaggctcaaaagatacgtctcgcgatttccccctataattgtgcaattagtttttatttttatctatatttaatactccatgcatgtgtctaaagattcgatgtgatgttgttgggaaaagttttggggaactaaggccctgtttaattcgcgaaatgaaaatcttttgatatcacatggacatttgaccggatgttggaagaggttttcggacaagaataaaaaaactaatttcataactcgcctggaaaccgcaagacgaatcttttgagactaattaaaccgtcattagtatatgtaggttactgtagcacttatgacaaattatggactaattaggatcaaaagattcgtctcgcgatttctcccataactgtgcaattagtttttatttttatctatatttaatgttctatgcatgtatcgatgtgatgtttttagaaaaatattttgaaaactaaacaaggcctttagagcagatacaatagcaggctataaaccagctgcaaacatattttaagaagataaataaggagagagaagagcagcgggctacagatttttagccagctgtagcacggactccaagacatactgtgtgtatgataagtaggaccatgtattaatagggtagtatgtaactattgtatgaataagctattaggttggttatagatgaattggagctagtagttggctatactattaaacttgctcttactgaacacctctgctcctcatcaacgatcagccagttgtgcttgtatggtcgttgcgtcaaacagtagttgcgtgaatccgattcgatatcgacaacgctgctgcacatacggcgggaaagcttcgggcttggaactggaaaagtgctcggtcggctcggtacgcttgctcaaggaacagatgatccacaccgtccagtttcaagattagaacggcaaagccagtatcggcggcgaagcccaagctcccgaaacaagtctgcatggggatgaaggtaatgtgctgatgttgagattataggcatataatgatttaatatattccataaataaatcatgacattgcagatgtatactagcattaacgcatcattagatctacacatgtaaactaagcagtaaaacatgaacagattaaatatgcataacaca

SEQ ID NO: 35121 - DNA, 1207 bp, Oryza sativa
cgtcgacgaaggcgcgcagcacgcgtgcgaaaaggaagacgagccgtcgcgaacgaacagagagcagtcgcgcaaagcgcttcccaaaaaccttattaccgccttctcccggtgcaggatgtcgaaggcagaggttccgaagacctgctctcccgatcgccagtgcacgccggcgagcgggatggagtagtctacgagcgatggcgcagcacagagtaggaggcaaaccctagattgatttcgcgtgtgttgcgtaaaggcggcggctcagtttatatagagataggtcgcttgatcagggcgcccacacgatctccactccgcgtaaccgaacaaaactgcaaaaggaggctgcatctgcgcaagagtgaggagccaattttgcggaccattaccttattaccgccttctcccggtgcaggatgtcgaaggcagaggttctgaagacctgctctcccgatcgccggtgcactccggtgagcgggatggagtattctacaagcgatggcgcagcacgcagcacagagtaggaggcaaaccctagattgatttcgcatgtgttgcgtgaaggcggcagctcggtttatatagagataggtcgcttgatcagggcgcccacacgatctccactccccgtaaccgaacaaaactgcaaaaggagcctgcatctgcacaagggtgaggagccaatttcgcgcctgccctgccaggcgaggcgaggcgagcgagagtgcgcgtgtgttccccctcttctctccaccacatgcttcaagtggctaggagggcatcctcccttttaaggaggtccccctctccaagaataaacaaggtggtactaaactccccatgcatgccatcccatgaggtgggcttttgtgattttccaaagaattaatcttcgagtgggccttagcccatccattaattccaataatcccccaccaaatctcaaaatcccactgagatttgccttttccaatgtactgtttatataccagcggttcgatgaagaccgattaaggttgaacatccacctagaactaaagctacacttactcacaacttgaacaatggactacgtcttgaattgcaagtcttgtgcaagcaagtttcacttagagtcttatctggtactagaccgtctgtagactacccctcgggtggagcgtataagacatactcctaggtctttagtaagcttcctaga

SEQ ID NO: 35122 - DNA, 2660 bp, Oryza sativa
tccattagtagatcacgctttcattctgcctcaacagtagcagtatccagtgccgtcatctctgcttctatggttgacctcgtcaaaatggtctgtttgcaagacctccacgaaacagcaccaccacctagtgtgaagacatatccactagtggctttgatctgatccagttagaatcactatattcctccagtaccgcaggatactcagtatagtgaagctccaatttcatagtacctttcagatagtgcattactcgctcaagcgcacgccagtgatcatttcccggattagaggtaaaccgactcaacttgctcacagcaaaggagatatcaggcctagttgcactagccaggtacataagcgagctaatgatttgggagtattccagttgattcctagcaattctcttgttcttgcgaagcaacaagctaggatcataaggtgttggagaaggcttactatcaatgtagcccaagcgattcaagatcttctccacataatgggactgcaagagtgtaatctcattcttacctctaattagcttaatgtttaggataacatcagctactcccaaatccttcatatcaaaattttgagacaagaatgatttaacctcatttatcacctcaaggtttgtcccaaatatcagtatgtcatcgacatacaagcacagaataactccctcacccccatggcgatagtacacacatttatctgcctcattgactgcgaagccggcagatgtcaatgttctatcaaatttctcatgccattgcttaggagcttgtttcagaccatacaaagacttcaacaatttgcacaccttgccatcttgaccttcaattacaaacccatcaggctgatccatatagatctcctcatctagttctccattaagaaaagttgtcttaacgtccatttgatgaacgagaagaccatgtgaggctgctagggaaagtagcacacgaattgtggtcaatctggcaacgggtgagtaagtgtcaaagaaatcttcgttttctttctgagtatagcccttagcaacaagccgagccttgtacttttcaatggtaccatcaggcctaagcttctttttgaacacccacttgcatccctcaggtttacatccatagagatgctctatcaactcccaagtcccgttagcgataatggaatccattttactaccgacagcgtccttccagtagtctgcatcaggagatgcatatgcttctgaaattaacttaggagtgtcatccacgaggtacacagtgaaatcatcaccaaaagacttagccgtcctttgtctcttactccttcgaggagcttcattgccatcctcctcagtgacatgttcatgtgtatgttcaatttgttctggtggtgtgattaaactgggaattattttagagggttggttagaactactatgtgtattctttattgggaaaaagctctcaaagaaggtaacatcacgagactacatagttataccaacatgcatatcaggtaccacatttttaactattaaaaatctataggcaacgctgtgatgaacatatcccagaaagacacagtccacagtcttaggcccaagtttgcgcttcttcattattagtacattgactttcgccaagcacccccatgtgcgcaagtaagaaagtgatggttttctcccaatccatatctcatatagtgttttgtccttatttctgttaggaactctatttaacacatgattcgaagtcaacaatgcctccccccaccatgccttaggtagtcccgcggtgtccaacatggtattcaccaagtcagtcagtgtacggttcttcctttcggcaatcccattagactcaggagaatagggaggcgtcctctcatgtataatgccatgttcctcacagaataagtcaaactcatttgagaaaaactctccaccacgatcagacctaagtctttttatctttttgttaagttgattttcaacttctaccttataaattttaaaatagtctaaagcctcgtctttcgttttcaacaaatacacatagcaaaatctagtagcatcatcaatcaacgacatgaaatatcgttttccacccttcatcaacaccccattcatttcacagagatctgaatgtaggagttctagaggtgccaagtttctctcctcagcagccttgtgaggcctgcgagattactttgattgcacacaactatggcacttagaacctttgacaatggaaaacttagaaattaaacacatgctataaagccgagacatcaagctaaaattaatatgacataaatgtgaatgccaaacattagcctcatcatccacactgccacaaatatggttcacagacttattgtagaaatcagaaagggaaaagcggaacaggcctccgcactcataacctttaccaataaaatattcatgtttagacacgaccactttattagactcaaaaaccaacttaaatccgtctctagtcagacgggagccactagcaagattcctgtcgatagtagggacatactgcacgttcttcagctgcacaatcttccccgaagtaaactttagatctgccgtgccaacaccatgaacagaagcatgtgacctattccccattaggacggtggaaccccgtgcgacc

SEQ ID NO: 35123 - DNA, 3043 bp, Oryza sativa
  unsure (1)..(3043): unsure at all n locations
atgagatgtcagcacaaacatgtacattggcccttgcatcaacccaccaattagtagactgattaactgaaaaaacagtaggtaaattaccatacccgcttccatctctagtgttgccaatggtcacattagcaggcttggaagtctgccctgcaggtgccttcatccccttgcgttgtggacacttcctagccagatgactaggttggccacacacaaagcaagtcctctcatcctaattaggattgttgttgttgttcttcttcttgaagttggtggtctgctgagctttgtattaacctttgctcttgttccgggcctttgtgcacgacattggcgctggactgcccaccatcgcccttagacgcggagtctttttcccgagctttctcctcaacatcaagagacgctatcaacccctcaacgaagtattcctgtctcttgtgtttgagtgcagtactgaaacctctccaagatggaggaagtttcgcaataatgcacccggccaaaaatttgtcgggtaagacaacttaaggagttcgagttccttagccatggtctgtatttcatgagcctgctcaactacaaaacggttgttagccatcttgtagtcatgaaactgctgcatgatgtacagatcattgctagcatcagtagcaccgaatttagtattcagtgcatcccacaactccttagcgtcggtcatatgcatatacaccttgaccagacgatcaccaagcacgctaaaaatgcatcccacaaagagagtagtggcctcatcaaattctttctgctggtcaacattaagaactcccatagccttgccagtactcacccagaagcatttcatagctatcagccacagagtgaccctgatctgccatctcttaaaatgcacaccggtgaatttatccggcctcagtgcattggcaaaaccagccatagtaaaatcacagtgcctataataaggtttttggattgttgagattataggcatataatgatttaatatattccataaataaagcatgacatttcagatgtatactagcattaacccatcattagatctacacatgtaaactaagcagtaaaacatgaacagattaaatatgcgcaacatattgaacacgtaccgaggtttcggaacaaccggttgctcggcaggaatcacttgcggttgcggacgtcgacgaaggcgcgcagcacgcgagcgaagaggaagacgagccgtcgcaaacgaacagagagcagtcgcgcaaagcgcttcccaaaaaccatattatcgccttctcccggtgcaggacgtcgaaggcagaggttccagagacctgctctcccgatcgccggtgcaagccggcgagtgggatggagtagtctacgagcgacagtgcagcacggagtaggaggcaaaccctagattgatttcgcgtgtgttgcgtgaaggcggcggctcagtttatatagagataggtcgcttgatcagggcgcccacacgatctccactccgcgtaaccgaaccggatatgtcgcgcgtaacttatccggactccacgccattttcacgcatcggatttttcggaatgtttccaaaacaaaacaaatccgaatttcccgcggcaaaacaaaactgcaaatggaggctacagctgcacaagggtgaggagctaatcttgcagaccattcgacacgtacgtcatgcacgcccgcccctgccctgccaggccaggcgagcgagcgcgcgtgtgttccccctcttctctccaccacacatgcttcaaatggctaggagggcatcctcccttttaaggaggtccccctctcctagaataagcaaggtggtactaaactccccatgcatgtcatcccatgaggtaggcttttgtgattttccaaagaattaatcttcgagtgggccttagcccatccattaattcaaacagctggtagctccagtaattgaatctgaaactcgcctggttaaattgtatctctcctaattggtttggatccgagtcagagagcaagagcttgtcgaagttgtcggtgacgaagaagtcgaaattcccgaagcgaagacgaagacggtgacttatgaagttgatttcatcgcacttgtcaataggtaactcgatacatccctacctggcgcactaattgtcgaaacaagattttggcaatatgaaaaggggtagcgtacgagacctaaaagtggatagatgcggagataaggaagataggttcagtccctctcaatgagaggtaatacccaactcctgtttggggatagtgtatattgatctgacgttctagttgagaatctctacaccctagagggcctcctacccaccttttattgtatgggagcaggttacaagacagaaacattaaccaatacggcatctgtcggtgatatgagcccgggggtatcatgtttagagggaggaggccgcccccaaacccacatggcgtcccctgaggagggtggcgcatgagtggagtggcggccgccccctcccagcttacggtactgagtttggagggaggaagctgccccagacccacgtggcacttccccgagggggtgacgcccggggtggagtggcggctgccccctcctagagattagatggaggagactgcccctcaatgccacgtggccctcccccgaggggagtcaggcccgaggtagggtggtggctactccgtcccagagattagccggaggaggttgcccctcaatgccacgtggccctcccccgaggggagttaggcccgaagcggggtggcggccacttcgtcccaaagattagccggaggaggctgccccccaacgccacgtggccctccctcctgtgactaggggtcgggctcccccgaccccctctgcgggttgccacgtgcggtgggttaggtggccaccttcgagcgctcacctacccgcattaatggcaacctgagcaggcgcgccacgnnnnnnnnnnnnnnnnnnnnnnnnnnnnnnnnnnnnnnnnnnnnnnnnnnnnnnnnnnnnnnnnnnnnn

SEQ ID NO: 35124 - DNA, 1495 bp, Oryza sativa
tttgcctacgaaagaccttgctaattacccgctgcccccggccgaactctcaaagggggggcctcacggttccctattggaggagttaaccctccgacatctggcgcgccaggtagggggcgcgtttgtgatttttgaggttcttccgaccgccggcgtgattagcatcgcgctgccgatgcgggggaaggtgcagcctcctcaggagtgtcacgccaccctaggcagggggcaaggccccccacatccccaccgggtaaggttggctgccaggtctttgtggcgagtcttcggaatgtctgatggcccccaaagctccagccctgcctcaccgagaagtacgacggcgacgtcgacccctccgagtccctccagatctgcacggcgatcatagaggcggtggggggtggcgaccaggtcatggcgagcgtcttccccatgggcctcaggggccaagcggggggttggcccatgaacctgctgtcgcctcggttcactcctgggaggactcttgcagttgagctctgggtgccgtcaaagcccgggaccccttgtgctggctcttccgtagtggctagctttgatcccgccggctggctacggtgcccggcccggctcaactgatcgtcctttcaagttttaagtattttcaattttttcaattcatcaacttgaaatcttatatttaaattccccctattttattctcatggccctgcgacgctcgcgtcttgtgcattatttgtatatttgaatgataatttgtcatgattcattcgaagggtatgctactgagtaattatccgaagaagtttatgaaatagttctgatagtactaagttaatcgtaaagtgtttctcaaatagtacggacagaacataaatgactaaaagtttaatacaaatagataagtcaaggacgatcagtgcccttcgcacgcttgctaggtcctcacttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctagggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagcgaagtgtgccgacccagatgctccctgcgaggggtgaacataaggcggagtttggaatacctgcggacgtggtggtgccgt

SEQ ID NO: 35125 - DNA, 8792 bp, Oryza sativa
  unsure (1)..(8792): unsure at all n locations
agagtatttaacaatatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcataataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaggacgaccatctctcgaagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgggctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgattttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgtcgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgatttaaccaacttttcgtaggcccgtgcccatctgtgagatcctccagtgcaacaggcagcacaccaccaaaactggccagaaggtcatgcgcccatccagcattcaccattgttgggccaactgcttgcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttgaaacccaacgaggatcaatacgccaatattgatccggtcctcgcatctttagcacattgcagaaagttcctgtactaagacgtcgcgatcgatggttcctatcgatctccttgtctataagctgcccatcatattgatcagcaatacctgcagatcgaaaaccacattagtacaatgcacgtatggtaccagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaataaaaattacaaggccattacaaatagattcgggtaataaaagtgcaagaaagttcaaattaaaattacagacgcactaaacataaattgaacgataacgatcttcaaaatagggagtccaccaaggataatagcgaactaaggattatttttcttcttcgacttcccctttggaacgcgacgaacatcagcgcctgtggcatcttgccttacattgtacatgctgcaatctttacgggaatggttctccccgcaaagaatgcaagctttcttacgacgagaacgatctttcacttcaacttcatccataaggttcttgatcctgcgcgactggcgacgacccttagtatcaagtaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcgaaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcatataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactatagggtttttcctaacctcttccatgtgtgtagtggtcaaacgatccagttgatcccatatggcatcaaactttctttgttgattctgcttgcataacttcttgaacaggtccatcaatctcttactcatgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgctgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctattttgccctccaagccttgtcgtacgatatctcatatccgtactctttctcaacgtcatgcattatggtgaaaggggacaaagatgtttttctaaccacctttgaatataccatttgtgccacaaataccgctgtcaggtttctgtgcaccagacaggtattctccaacaaacacgtatgttgctcaacccttgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccggcaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctctggtgcattcagactagtatcatggaaggcatatacagtcaaatccaccccgctatcacatatttgtataggaacatcgccataatacagacgaatgggcatatcacctgacatcctgataaaacatgacaaatagtctcacgtttaatcatttaatcattcgataattaccctattacaacttatactacattgccgtgtactaatttacaactattagtaacaaagaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggtgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaactcgcggcctgggtggacggggctttaagccggcctgtcgaacgcccattgttcgatagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgacagggacctactttcacgattttccccggttggccactacttttgcgattttccataaaaataatattaattctcaaaaaaattccccagaaaccggccaccaactttcgccacccgccggtcgccggggcggcgtctgagaggacgtcgggcagtgcgcgggtcggaggaaggcgatcgagatgagggagctgggccggcagcctctagacatggagcggcctctcgctgcgggtggggcacggcctccgcccttggcttcgccgcataccagtgttgtagaagacggaatacggttgtcggacaaaaagggtatcgttcaccgattaatcgaaattatacggaaatttgacgttcgcgaatatatgtacaaattttattatattatatacttatttgaagaattatatttgtttaactatataaatcaaatatcttcatgttgttttttaattaaacagataagtaaaacattaactcttctaacaccggatttatatatcatatggtggtagaattggttgcattaaataagtaaaacataaaaatatatgtaacaaaacaaaaacaattctaaattaagtaaagaaaacaacactaaatgatcatcaaatacaacatacggacgattattcaggtgatttaacggaaaacgaccaactaatcgctaaaaacgagttttaacgttcgtgaacaataaatgtacaccgtatcacattaacgcggtggtggttttaacgttacgaccgattagtcaatcggtatggccattttccacaacactgccgcatacaccgccttcgatctggtgcgtgccgtcccaccccccttctcccctcccttgcccagacgtcatcccatacgagtagtctgtcgctcgattgctacgagtaaccgtcgctgcgtgtgaggcacgcataccctacactatagaaagacatgcatgtacaatctggagatgggttataatcacttgagtggatgttccattgtgactcgccacgtccatgcgttgcatgagcccacatctcttgaagcgtgtgtgttatggatcgagcacgcttgtaatcgatggtgaacatactggtatgtaatggtgttgcatgcgtatccattaagtaaaataattctattttttttagataataatagaaataattctaaatttaactaaaacagattatatatatacatatatatatataaccgatatacaaaccgagagaaattacacacgaattaattaagaaattttggactaaactaaacacgctctctagctataactagctagttgatggtgcactcgacggggaggcccgtgtccttgaaccgtttggtgtcctcgcagtagtcgtagagcaggtgctcctgcctcgccttgctcagcgccgccgcgtccatctcctgctgatcgaaccacggcgactccggcggctcatcgccgcaccacgccacgccgggggacggcgcgcacggcgtcacccggagcccccggtagtaggcgaagaagggtgcctccgaccagtccgtcttcaccctcccgccctgcgtcgcccagtcgtcggcgttccacaggctgccgtgggcccgcatcttctgccacgtcgggaacgccggcccgccgcgcgccgccgtgttccggtagtccctgatcggcacgccgtccaccagaattctgcatcaatggcggcgtgtcaatgcgaagctctctgtctcgatggcaatggcggcggagagggatcaaacgaactactatctacgttttaggttatacgactttctactattgctcacatttatataaatgttaataaatctagacacatatatgtgagcgtgaggaaagctgaaaagtcttataatatgaaacagaggaagtagtacttacatgatgtgcttggggttccagacgatggagtaggtgtggaagtcggcggtggggtcgaaccagaggcggaactgctgctcgcggccgccgacgccattggcgaagatgttggtgtgcagggtgtagggctcgccggtgacgttcccgaggaactccaggtccacctcgtcgtggtactcccacggcacgtcgtccggcatcaactgcacgtacgcacgcacacgacgacatgtcgatcagcatgcatcgtccatggcggcggcggtggccggcggcgaggaggaggaggaggaggaggaggagggggaacgtacgtagagggtggtgacggtgccggcggagttgttggcgacgagcatcatgtcgacgtcgaagcgggcgtagaggtaggcgtccctggagcggaagcccgagccgtgggtctcgtcgaggcagagcgcgagggcgtcgccgtcgccgtccatgaagaagaagctgtggtcngccgcccacaccaccttcacgtngtcgtacatcgacgccgtagccgncgncgncgncgncgncacaaagacgacgaagaagaacgccaccaccgccgccgccgccgaccaccacacgcggcggcaccgctcaccggaacacggcattgccatggaatattaattcttcaattgattcttcctgatcttcttgttcttgttcttgttcttgctgttgctattcgatttcgagcggaattgtatttataataaccaatcgagaacaggttgatcatcgagaagatgatagaatttgcaggaacatgcgaggcatgttcgtggggaatgtttgagataggggacatggcatgttaggattcatggggatgtcaggctggccaaacactgcaataatctgcatgcatgttgcctcgcctggaatgcatttggatgatgaacacagttgaacacacacgctggtggctcgtgcatgcaggagttcgatcaagagcttaaaagaaaaataaaaaagaacttccatggggagcgacgaa

SEQ ID NO: 35126 - DNA, 12466 bp, Oryza sativa
cgtgggggtgggggccttaagttcccccaccctctctggacctatggacaacccccaccctatgccctcttcaaaaatttcgccatggatgatagagtaggaggtgcgctaggtatctggatagctagaggttgaaaaagcgtgaaattgggccgatgaatgcatttgggccaggctcacttagaaaaggaatccccttaaaaaggaataaatccactttgactccctgaaatttaacccaaatttaatgcatgaccctcaaccgcaaaaccagatatcttgacccctaaactattaaaacctgtgcaatttaactcccttggcggttttgctgacgtggtgcctacgtggcaatgttgactggtatgtggcattgacgtggcgcttaggtggtatttgaattaaaaacttatatgtgggacccatttgtcattaaaaaaattttgtggggcccacatatcatcctctctttctttctctttctctccccttcggtcgtccgcacggagcacgggctggagcggcggcgggcgggaccagagtggtggtggtcagcgggagttgaagcgacagcggtgggttggagctgaagcgggtggaggcagaggagaagaaggcggcattggactacaaggtcgcacctcctcgcggtggcagaggaggaggagaaggaggcggtcccacgccatctgctcggatgtccccctggtaccctcgggccacactagtgcccagctcttggcccgccgaagctgtcaaccgccgcccccctcgatctcgttggcatcggcatcggcgctgccatcttgtcccgcctccttgccgtccctcgagcgctagctgccgctccagctccatcccaccaccgttgccgctctagctagctcccgcgtcagagagagagagagaggaaggagggagggtcgagatatccggtattgtggttaagggatacgaattagactcggtcactagttaagggagtcatagtggacttactccccttagaaaatacttctaggctgcaggcccacaggccacatctagcccccagcggcccagcccaagtttccattccccaatccccagccccaaatccctagcactagccaaggcagtgagctccccgtgcggcggcgcaaaaggtgagcggcgcgggggaggcggcgaggtaacgacgagctgcgcagcggagcgcgctctggcgaggcagcaggcgaaagcgtgcggcgcggcggcgggcggcggcaggtagcaggcgaagcgcgcggcgccgcgagcgcgagcagccgagcaggtgcagcagcaggccagcggcggcggcggaggctgcaggccggtgctggcgacgccacgggagcacgcgagcaagaggcaggaccaggcgagcaacaggcaggcagcagctggccaccggctgcaaaataactaaacaaggtatgtaatgcttagaattttatgcaaatatgcaatgcaactgtgattactgattacttaattggaaatttggaatgattcaatccattaacaatttagcacagtttctttctttctttttttttgtctagactagaatctcagcatgtcgaaaagaacattgttcaactattattcaagtggcagcagcagtactcctactgcatcagaggatgatgagaacacaagacaacaaaaattggcaagggtagagtttacttgcttagatattgttagtgatccaggaacgtgcaaaccaattgatgagtatccatttgagattagagatcaagtgaagagggcatttgttttaaggggtccaactcaaccagttggttatacatttccttgcaaatggcaaagtggtgaatggagatctttccaacaacgttggttggagatctatgattggttagagtatagtgaatcaaaggatgcagcattttgcttgtactgttatgttttctttgagccaggaaaacctgaaaaatttgggagtaatgtctttcaaaggttgagcgcccccccacccccccaccccaatctttcattcctggatccgcccctggtgttgggtttggtgatgctactgctgcagctgcatagccgcagtaatatctcccgatcagcccctagcttataagtctaaacaaaagaggatacaaagtgtcttagaaaatggaacagagggaacacctggtggtatacagtgatgcctagtagttaagtagcaaggatgacagtttcagtttccgaataaagtggagttcaaaattcaattacctaagcccattgggccatcttttccccgactcattcctgcatgtgtttcggcccaagtcccataaccaaaccatcaaatcgtctccgcaggcggcggcgaatcgagcggcgcggcggctgccaggcgaggccggccggtggggcgccatccagcggcagagcagcgtgctccaggctaaacctcatctctctctctctctctccgtccggcgttgtccacggcccaagcctcaaagggccacgcgcgccacgcagcgaggctaggtcaccggcgctcgctgcagcctacggtggatgcccgcgggcggcgtcctgggctggcgcggtggctgggggtcaccgttcccagttcaggtagcaagcaggtgaatcccaattttttccccactcaatttttttttgttcaattcgagatggtgaatcagtgaacgggccatttttatcctagcaagaataagttgggttaggctagaatgctagatcacttccatcctgaagaaatagaaatttgaagcaaacaagaacctcaactcctcaagtataaacttgtttacaagctttgcagatttgtgccaactagctgaacttcccgagcgattagatcacacatttttcttgcatttagaaacatagttgtatttgctacacaagatgtaatttgtagctgatttttttgctgttatcaatctttgaacagtaactttatttataactctgaaatcctggggaggtccatttggattttggttgatttctcctattttaaggaacccttagattgctgtaatgctgtggctgtgaggaatcaaatccaaaatcttattctccgttcatttagttttagccttttagatttttattttctccatggtgccatccttaccagtcttatccatctatcctttgtttgatgatttatgtgcttcttcttcagcgagcaagattgatcccaaggtgcgggtgcagattatcttccaaacatgtttggggctctactgggactccatggcacatgttaagtgctctggatcgcttgctattttctgctcctcaatcgtgctcattggctcacacatggacggcttcagttatgcacaaccgtcttgtacgtggctgtttcagcagtttttcagcagcagcagcatcggctattcgtgtacctgttgcaagctatgggacttctgcagcacaaagcacatcaaaggaccagcatggcagcaacatcaacagtgcgctaaaagttttgaatcttgtaccaagaaaggctgactatgacaaagtgggaggtccatgccatcaccaactaatccatgactgcatgaatgacatcttgggggttcaatcaaatcatactatacacaagggaaatggtgtcacttttaactcatgcagcaatcctgcacaggctaaatttgatagctttgtttcaaataatggctcggctttgcgttccaggactagattcataaaggaggacatgtttatgctgataatggagctgcacaggaaaggagaaaccagtacagatcaatctattttggcagctgccatgagttcctgtgctgataggcaaatgttcacccaaggcacacagcttcatggtctattggttaaagttggctgtgattcaactgtctttattggcagctcacttatcaccttatattccaggtgtagccagttggaaagttcgtacttggttttccagaccatgccaaccaaaaacacagtgtcatggacagcaatgatttctggttttgcgctacataatcgggttgaaccatgtttccatttgtttgcgtcaatgaggctttcaagttgcaagccaaatgacatcacatttgccactctttttagtgtgtgcactaaccacgcacttctagcacttggtaaaagtgttcatgctttacaaatgagaatgggtttccattcatatgtgcatgtttccaatgccctgctgtccatgtatgcaaagtgtgggtgcatagatgaagcccagtccatatttggcttcattgcctgtaaagaccttgtttcgtggaatgccatgatctttggatgttcgcagtatggccttgctaagcattgccttgacttgctgaaagaaatggagaggcaacacatagtaccagatgctctctccttccttggggtgctttcttcatgccggcatgcacgccttgtggaggaaggccgacactgcttcaagacaatgattgaacatggaataaaaccagggctcgatcactactcatgtatggtcgaccttcttgggcgcgcaggattgcttgaagaagcgtgggatttgatccaaacaatgtctatccctccaaatgccgtcatatggggctctctgctgggttcctgtagggtgcatgggaacatttcgatcggcatccaggctgcagagcaccgtcttaaacttgagccaggttgtgctgcaactcatatacaactagcaaatctgtatgccacaattggttgctggagtgatgtggccagagtgaggatggcaatgaaggcgagaggcctaaagacgaacattgggtgtagctggatagaagtcggtgataaggtttattccttcacggcagagaacagatcaaagagccaccaagtaaacaatgtcctggctattcttgattgcttgcaagctcacatggaatgcaagtatgatatgcttacagaaagcctggagtagtggagtgtgatggctgtgaacatgtcaagacgactataaacactgtatatattaagaggaatcctaaagaagatccattgatgccattataacacctaaacattatgtgtatggactgattggtataaagatctgtatggattgacaagattcacgaccaacaagacatacaggtactgtattttccaagtctcttccagttttgttcctcatttgtctaagaagtgtggggaataagtattcttgcattctgccaccacccaacgatctgcaatttatgtcccccatccatgttacattttcttgttagtttagttctccaaaacacaggtaattagaagaacaatattcagattttttttttgttttttttctttaaattctttctggccaaggttttctgacttaattgatgtaactgctacgagacttcctatgccttcccataaaaaaaagtacagttcattcatcctatctattcattgtgtagcagcctgttgtggcggatggtgatggaaggcctgctttccagcttgaaggaaagaactgaaggattgaaggttaagcggcataaacttgtcatagcacatctcatgtgtctgataacataatgcgttgatgtgtcatatgtgcaatcagcgatcttgtactgcttaattacaatggttagaaatgtagctcttgacaaagtaatgattcaggagttctgataattgagaaaacaagacagcatcgtctaaatgtcagccgatggcttctctgactgatgagtatcaacaattttcatggaaacgaataggattacaggagtgtcaacgaatatgatatttgcggggaaattgaagaaagtttttaacaacatgccttcccagtcttgagttagagaattattgcatggcccattttctttgggggtcaaattaggtaggtggtgaatttgacaatcagcatgccgttagtgtcgaagacaagaaatgattctttgtattggtgctgaggaacaaataaatggaaggaattctactcaaaatctcaacaatctaagttgaaaggtaagatctccaaattaaacgctggggataaaaaaagcaaagttgaaagaggggtgcaaatgaaactgaaggcgcagtttcatcttctttagatgagatgctatcatccaacctgctaacggaagtgatttagatgaatattaagtatgggtatataaaacaagaaaactattagtatatgattaattgagtttttattatttcaaacttagaaaataaattaaaaaatggttttatctgatatttcaaagcaacttcgtatgagatgtaccatttaacagtttaaaaaacgtgcttacaaaaatcgagataaaatctttgaaacgaacttggccacgtgtaacaaagatttagcatgacagaatggcacaaattgaaaaaggtaggattgcaacatcgatgcgacactaacatgtcaagtgcgtcttctttttgctacctaccgtgctaaagccaaaatgtagtacaaagccctctgcatctaatgaccattaccatgcaagctaaacccatcaccatggcaacggcgtcgatgctcctccggagcctcctctgcctcgccgtgctcgccgcggccgcggccgccgctcagccgcggttgcagtgcctggagaacccgccggagctgacggccgccggcgacggcgaggccggcgtggtcgtccaaaacctgggaggattcgcggcctacgtcaccggcgccgcccactccggccgggccatcgtcctcgcctccgacgtctttggttagtagtctgtgtgtgtgcatgtatgcctgatttgcttactgatcattcactgccatcctttggtgattatcgattgattagccgttaattgttgctgttaatttggtttcttcaggatttgaagcaccattgctgaggtacaaaatcttcttttcatttcctttagcttcttgttcgttgtcatcttcgacagtaattttcttcatttcttcactctctggattataggcgcagattgtttattttattaacataacaaattaatattttgaaaaatgaactttgcaaatatctaataatgcagtagaataaataatattttttaaagcatggaccaaataatctgtagcaattatccgggggaaaatctaaagagaacagggcatgacaaatacttgacacttgaacaactctggaaagagactgatttaaaaaaaagaaaaagacagacatggcttaattgtgtaccatacctgtttttcttgtgacaatgggttcaggtcatttttagtgaactatctcctatctttctgcagtgacttttgtgagaaggataacaggtttagactttagacaccaaaaggtgcaaaagcaaataatcgtccattcgccctcaccatccatgagcttgaacaaagaatattcaacattgctatgtacatgtttcttccgtttcaaatactccctccgtttctaaatatttgacaccgttgactttttagcacatgcttaaccgtttgtcttattcaaaaaaacttttatgaaatatgtaaaactatatgtatacatgtaagtatatttaacaatgaatcaaatgataagacaataattaataattacttaatttttttgaataagacgaacgattaaacatatttaaaaaatttaacggcgtcaaataaacggagggagtagttagtatcttttttttttttggagtaaccatcaattcatacggagaatcagaagcgtatactcatttttgctattttccatattctgaccttctaatgatataaatatgttaagcggttgaaatacatcatttactatcaatgtgcaatttcattattttaactactctacttagacaacatatatgctaaaactttcatcttctgtatccctacaaagttgaagataaatctactactccttccattacaaattatttgtagttctagttttatcctaagtcaacaatttctaactttaacaatcattttttttaaaaaaaatgtatattttaatgacataagttttaatatgttttttgattcacaataagaaatacttccaaatatgcaatccacatgtatttaaattatacaaattgctagttattaataggctaaaatagaaatatttgacttgggacaaagttataacaataattaatttgaaacaaaaggagtagtactatcattgtatactgtattactgtgcataactatgttcattacatgctttctaaaacatcatttctttaggggcaaacgctgtcgtaactcaatagtcaatagtaatatctcattgctgtccttgtaaagctgatttatgaatggataaccaagcaacgatccaatttcagaaattcagtttttctgtaaaaatatcgtggattccaatggtataacagcaatgatttcttcatgtggattgtactaaggtttctgtttttgattccaattttaagtgcttcctttagcttgaaagtattgtaaaacgtcccaactggattcctttcaatacaccttacatttttactcccattctagattgcaaagacaacttaaaatcaaatttgtggttaataatgctgacaattacaggaaaatagctgacaaagttggtgaagcgggatattacgtcgtggtgccagatttcttccaagggcgaccttacaatggagacccaagtataaacattacacaatggatcatggctcactctccggtaattgttttcaccaattacatagcttattcgacgacgattatcgaggagtcaattgatattgatcagtatattcaattgaaatttcaggtgaaggcagctgaagattctaaaccgatctttgctgctctaaaaagagaagggaaatctgttgttggagttggaggttattgttggggcggtaagcaaaatcgatcagcaaaaagaaaatgtctttacatatcctacatcagtacattagtaatacatacactctaaaaaactttgtaaattcctagttaatttccatatctagacttaattcatactattatagtctaaacaacaaaacttcaattgacaggaaagttagctgtcgaggttgcgaaaaccaatgaggttggagcgattgtcatctcccatccttcatcggtgactgctgatgatatgaaaggtgaacttatctgttttggtgctattgttgcgcagtatatagatgaatatatagttaactgattcatgtacgctgtatcctagtagtccctgtttttcttattccaaaatgaccttgacacagatgtcaaatgccccattgaaatccttggagctgagaatgacgctgtaacaccaccaagattagtgtaccagtttgtgaatgccttgcgccaaagacctgaggtgagttcctgttgattttcattggcacttgatgccaaatgcatcagcatagtcccacggtagacacacacgagaaaaatctcccactgatgatgagaaattgaaagatcatgctggctctatttttctttttgaggcaatactggatctagctaattagtaacattaatgaaaagtccaaacactagcacaatgtcaataaacaagtttacaattgtttcttaaacacaaccactcaatgatctttaagaaaagaaacaagttatgaagaggctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacattagctaatcatgcatgcaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctttttgtaggagaacaaaaataatgtgtgcctctgttgccattttaactagtcgatatgttcaatcaaatgttgtatgctactcatcttaagcacagcatatattgggtacctcttgactgtttcttatggccacaaattagacagatgaaagtcgtgcttccaagaaattgctagcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatatctggtctcaccggaagccagtggcgaggttgctgtagatctggccagagctgtgtatcctgcctccgccggatcgtggggatggcatcttcacatgagcatatctccacctcatcctatatatgtgcgccgccacatccagtgccaccccttggttgggttccatcgaggaggtcaagggagattcatgttgccttaagcttttgacaagggtcgaggggcagctcttccagttcatgtaggtgcagaaaaactatcacaacttccaagcatccaaggttggcgtgtgaagcttctgtctctaggtgcagcttctggtcgtcgttggcattcatgattgatcgcactctgagaaaattaaaatatattttagaaacaaaatgttgaggaaaaccatttgccatagggataacaaattattgcttacatgaatccctgagcatcataaagacccttcaaaatgctggattcttcatgcacttgggcagagctatggtatattttaccctttgaattcctggatgaatttggtcctgtcccggaggttataactaatcttgttgctagtcattaggatgcttggtattcaaatcttcagaaaattggctgaaaatattggatgtttaaatcaaacctttactgtcatagtcttgcagcgtgaataaattcatcatgttgctggctttaaaagaactcctctggtgagtgcctttcagtactttgtatttcagaaaatgctcgtgtatttgccaatgatatagacttactcctctagcattccacttataatcagtctatatactgtcatatctctagcttgccgaattctctatgcacgttcactagcctaatccacagagaatttaatttgttaagtagagtagaattaccattaaaaacaaaactacattaaatgacaaagcgttaccatgctaacaatagtatcggtagagtatgatagaaaattattcatctaccagatcatctctcactggcatccaatcaaaacttggcaatgaggttagaaattttgcatcgtacggcgacattgtagcaataagggcatatcactggcatccagtcaaaacttggcaatgaggttagaaattttgcgcgacattgtagcaataagggcatatcactggcatccagtcaaaacttggcaatgaggttagaaattttgcgtcttacggcgacattgctagcaataagggcatatcaaaacattaatgtatctcctctgctaccatatcttaatgtctagttgggtgtttcttataagattaattttccttttaagaaattaagcttctctcagattaagcaatgagttcaacagagaaaaaaaaatctaatgttagaaatttcaaaaagccaagcgctagtgtctagcgctgcctccaccgagagacccgactgtgtgcctataggtgtcacgtcctgataaattcatcccgaaataaaaatcattttctaaaaggaataatagaattaattaaaattcgaaaagaaattggcaaacattaaaatacgtacaagaaaaattcgaatgtggctcggagaatttttgttaaattcttcttggtctaaaaaggagccctcaaattttacttgaattttcagagcaccggaaataattattaaacaacaaaaacaattatcaaagtttaataaaaagaaaatctaaaaataatcctccttttcttttgggcagattttggcccagagtcctccctctctcccctcggaccgcgggcgaagtctccctttcctccctctcttcctctccctctcctcctctccctccttctcttgggcctcctctcctcccctcccgggcccactccctcctccctctctctctggggccgttcctccctcccctcccggcctgcccggcccaagccgccctgccccctcccatctgggcagtgtcccggcccagccgagcccccccaagccgcgccgcacgcgcctgtcacgcgcgtcg

SEQ ID NO: 35127 - DNA, 5762 bp, Oryza sativa
tccaccccggcttgccctccgtttcgcgcggtgaccgccggaggcgcgttcccgccgtcgcctttctctttcctccgcgcgggccgcctccagccgcctctccctcctcgccggagcgccgtccggccgcgccgtcttctccctcggcctggcagccacctcctctccctcggtcagccctccgtttcgcgggggaagcaccggagacgcgtcctcgccggcaaaacagtggtgttgccgccactgttccacctccggccgccactgtcgcgtttcccgtgcgccggccgacgtcgccaccacctccctcggctccgcgacgccgccctcatccccggcatcacctcctcctcacccgaatttcgccggaacaccgtcgcccgcgccggcttctccttcctcctcagcggcatctcctccggctgcccttttcgccatgcccgtgcgtcagccggcgctgccgtcccctccctcggcacggtgacgtagccctccacctcgtccacccctcggtttcgcccggaagccgccgcacatcgccgcgaacctctccatctgcctcgccggagttgttcggccgcccgtccctcctcgcccgtgcaccggtcggccacacctccaccacctccggcatcgcagcggcaaagccatcctcggcattgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgtcccacgtcgtcctcgtctccgtgcagccactgccggctgccctcatcgcctcctcgccggccccggtcgtcgtcgtcgtcgtcctctcgtcgttcccggtcgttgtggcgttcgtccctccgtcgagccgttctcgtccgtcgtccgcgttcgtcaagcgagccgccgcagccccatcatcgtcttcgtcctcggctccgcgtcgtcaagcctcgtgccggccgtgtctcgccttcgttcaaggatcgccgccgaagtcgttccctcgccgtccgtctccgccgcgcccgttcgtcgttgtcgttcccacgcctcgtcgcgtggtggtaaggttccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgttgacccgtggaccgtctctgtgtacccggtctaccgcggtcctttaggttgacatgtggggtccgcatgtcaacggcgcagccttcctgtcttttccaggctagcgtttacacatgttttatagttgcaaagcttaattataataatccgcaaatctccatacaacagcattaaacttcggatgatcatatcttggtcatacgagctccgaatcgacccgttcaagtctcttaatgtttgttataacctaaagaaccatgtgctttctttttatgtattggtattgcttctttataggcttgtagctttgcttgtgtgcttcgcgtagcttctgtcgttccggaggttccagaagcgtggttcgtggtcgtcgccgaaggttcggaaggccgttctctctgagaaaggcaagtcacatcatccttgaacatgttgaatcccagtttataaaattattttgatttaaattattgcattatcgctttatttaaattcccgcgtgatcactgttttatttagccatgcctatttacctttgttataaccttaatattattggtattgatattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgaaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttggtcaacaactaaaatgtggaatggttggcctaggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccgtatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgcgacaatagggcatcttttcggcagggggtcgcctgccgtggggatcttttcactgctccatttctttttcttttttttcagctggccggcagggggtcgcctgccgtgcctcagtaggggatcttttcactgcattttttttttgcagctgaaacggtagggcggatacacgccctaccgctgcccattgcagtcggggtgggtgtccctggggtggcgatggaatagaatcaaatcgagctaataaacaggtcgtgttgtctcagaatgggcgatatggtacaaaactcattaccggatggattcagtcggagccaaagaacagcgcgcagagcaacctagggctaggagtagaggtgcgtggcatacctgctctccactccacgtcgagggcgccgtcgaactggccgtgctggtgaagtttcccgccgcccggccgtcgccgtcgccgtcgccgctgacggccggatccagattctccggcagcatcaccagctggctgctcgccgccggtcttggggaagcggcggcgtcgcggagagtggagagaggtcgggagcgagcgagaagccgagaaggggaggaggaggatgacccatcgacacccatcgactcaggcaaatgcaggatgctgggccatgagtccacgatgagtccatccttctgacgacgcacgtggggccatccttctgacgacgcacgtggggctcgagcggaagctttcccaggcccagtttgctactgggctgatttatcttgtttcgttttttgagtttcactcgcatccttcaaccacaaagaggtactatattgcatccgtcaactatcaaaacaagtggaaatcgagtgtcatagttatttaaatgacggtttcgactgatttggtgtctacctaaaatacccttatggacatataaggttaacggttgatttatatcaagtttcaaaaaaaaatatgaaaacttttatttggcctccttacacagtataaaagtttgtatataagttttaatttttttcatttctattttttaaaaatataacttatttgttatatgctatataaaatattttttgtgttgttgtttttaatataaattatctttcatatgcaacataagatattttttgctattatctttcgtgtaagctatttctctatgatatacacacaaaaatattttctctgatatacacacaaaaatatatttttaaaaaataaaaaaactaaaacttatgtacatacttctttgttgtgtaaagaggccatataaaaaatttcatattttttgaaactttctaatgagataaattgattgttaaccatgtatgtctctaaggtattttgggtattttttaaaaaagaggcccatcataattgataaagtcatcagtatatagtagaaagagataatgacagtggtaaatcgttgaactgggataaactcagtagcatagaatagattatctcaactttatatacacatataaaaagtttatacgtatgtatgtaaagtatatacgtacgtacatataatataaatttttcatatgtatatacttttgatgtataaaaaatatatacacgtataccaagtttgtatctaatttaaacattcaaatctttcaactcgaaaattttaaaaaaataattatgtatagattttaaaactttagattctaagttttaactttcaaattcaagttgaaaacttccaagtcacctatttatttcattcctggttaaggacgtaggattggaacgtcgatgcgacactaaacatgtcataggtgcgtctccttttgctacctactaccgtctaaatccatgtacaaaagctgcttcagcaactatgatcagtagagctaattaattaccatggcgccgtcttcgttgctgctctgctggagcatcctctgcctcgccgtggccggcggcggcggcggcggcgctgccacctctgccgattcgctgcgcttgccgtgcctcgacaacccgccggagctgacggccgacggcgacggtgaggccggcgtggtcatcgatgacctggcaggcttcccggcctatgtcaccggcgacgtccactccggccgggccatcatcctggcctccgacatctatggttagtagtgattatcaactgattatcgagtgatcagctgttgtcgctgttaatttggtttcttcaggattcgaagcaccattgctgaggtacagtattcgtcaatttctttagagagaatcctttatatgccactgaaaattggtctgaacccttatatgccattgaaaattggctcttcccttatatgccattgatacaaatttgcacaccctctcatgtcactcccgttagttgaccgtgtgttgaccgttaattctcaaggaaaaaagacgtatttacccttctaaatatagggcatgcctaacaactc

SEQ ID NO: 35128 - DNA, 11411 bp, Oryza sativa
  unsure (1)..(11411): unsure at all n locations
tacccttctaaatatagggcatgcctaacaactcagagagggcaaatatgtcttttttacttgagagttaacggtcaactgacggtagtggcatgagagggtgcacaaatttggaccaatggcatataagggaagagccaattttcagtggcatataagggatcagaccaattttcagtggcatataagggattatctcatttcgttaacctcctcctcctctctttgtcgtcgttgtctgtcatctttctccgcaattttcttcattttctccacaaatttagtgaaagaaattaacacctgaacaactctagaaagagactgaattcgagggaaaataaacagagtaaacatgacaaataattgtatgacttaaaaggtgatattgtcatttttactcaattatccctatctttctgcagtgacatgcgtgaataatagttctcatcacccatgaggccatcatcagtgtttcaacaaataatattagacaatgctcatctttcatttcaaatagtttaatttcctgatctttttgggactaatcatggttttaaactattccctcccttcatattataggccactttgggtttgacctaagtcaaatatcgtcaagtttgataagtttataaaaaatatagaaacatctacaacatcaaattaatttcattcaacaactatcgttcaatatattaatttttctataaatttggtcgaacttagagaggtttgacctataacaaacctaaaataatttataatttgaaatggatggagtagttaccaatgcatggagaatcagaagaatatatactcattttgcaatttttccatattctatcctcccgctaatgatataaatatgtcaagcgggtttaaatatatatatcattttaatggaaaaattcatgtccacacatcgtgcatatatatcaagtgacaaatacagtgaaaattattgaaaatactgtacatgccaataatattatacctatgtgtaaagtctatgcattatactgaaataaataaaaattctgacagttttacaagtaaaaagccatcagattttgtccttagccatcagattttgtccttaggacaaacgtagtcggaactcttttttttgggcaaaaaatgtgtaaagtctatgcattatactgaaataaataaaaattctgacagctttacaagtaaaaagccatcagattttgtccttaggacaaacgcagtcggaactcttttttttttgggcaaaaaagtgtaaagtctatgcattatactgaaataaataaaaattctgccagttttacaagtaaaaagccatcagattttgtccttaggacaaacgtagttggaactcaatgaaggactgagaatgatccaatttcagtgttccactttctgtagaaatatcttgaattccaacaatacaacgacaaacccgtgatttcttcatgtggattttactaaaatttatgttttacgttccagttttaagtgcttccttgagcttcaaatagtacgacatcccagctaaatttatctcatacaaattctacttttattcccattctagattccaaaaacaatttacaagctgatgtgtggttactgatgctgacaatgacaattacagggacaatgctgacaaagttggtgaagctgggtattacgttgtggtacctgatttcttccatggacaaccttacaatggagacccaagtataaacgttacaaaatggatcacgcttcactctccggtaatttgtttcaccgtttacatagggggtgtttggatcctagagatattttttagcccaccccttttagccccaaaatagcttaaggggatccaaacaggaggaagtttacatcttgtagacacgtggtgtgactgttgtttctttttttcctctatttataactttttagggctatggtcttgtaattttttaatgctatatcaatatgaaatctcacatggttcgtttcaaaacgccaagtaataatgatcatagttgcattaaaaaaaccttttctagatgatgcttattgtggagttaattaatggatattgatcagtatattcaatttgaatttcaggtaaaagcagctgaagatgctaaatcaatttttgctgctctaaaaagggaaggcaaatctgttattggaattggaggttattgttggggtggtaagcgaaactaaccagcaaaagaaaaatgtctttacatatcatacaccagtacattaggattgcactataatttttttcgtaaattcctagttaattagattgcacagctagatttagttcatattatagtctcagcacaagttcaactggcagcaaagtttgctgtggaggtggccaaaaccaatgaagttgaagcgattgtcatctctcatccttcagaggtgattgctgatgatatgaaaggtgaacttaacttgttttgatttgatgcttaattggttgcactacatatacatgaattatctagtcattttatgtaagttgtatccaagaagcctctgttttgtttactaaattcacattgaacgcaggtgtcaaatgccccattgaaatccttggaggtcagaatgaccctataacaccaccaagtttggtggaccagtttgtgaatgtgttgcgtcaaacaactgaggtgagtttttttttttttgagaacaactgaggtgagttgctgttgggtttcattggcacttgatgccaaatgatctttaaattttgtaaaaaaaaattacaaaatagaaagcacaagaataactgaaacagagtttattcaccccccctccccaagaaaaaaaaagaaacagtaaacagagaagagataaatctcccagtgatgatgagatattaaaagatcatgccggcactaattggaagtcaacatttggaaagttgtttttgagaagaacatttgggaaatttacaataactaaagtctaaacactagtacattgcaattaaagttccatacatgtacatggccataaattcggaaaatatcctatatcttcttgacttgttctatatttgcaagaagaccctaattttttcttcaacacaaccactcaataatgtttaagaaaagaagcaaattaaaaagtgcctctaatggattgcatctttgttgcaggttgattactttgccaggatctttccaggcgtgtctcatggctttgcttgcagatataacgccagcaaccagtttgctgtcaatactgctgaacaggctcttgccttaatgcttgactggtttgagaaatacttgaaatgacaatatagatattctattaaaaaaatgacaatatagatagttatttgtgaaaatgcagaaaatcgcacttattcattttcatctaaataaattgccggtgtccatgtataagtataaccagccatgtcaatgtgattaattggctatgattttctctgaattgagcttgtcgatgtattaactgctgaattgatcttcaaattcagcggtgggaattcaacccaacgcacatgcatgtattctcaagttcaaagttaaaactaatcttcaaatttgaacgttggaacaaatgcaagctgaaagaggggacttctgcagttggagcttagaaagttggaggtgaaggcgttgttttattttatttattttagatatctgaggttttcattaagcaaataaaagcatctatatgttcgacaccaaaatgtacaatcaaccaaaaaacacactcagacacacactacaaaaagaaatcagagtagcaaaagaccttacacaactatatcttgacttaaagaaactcaagtaagactaacatatataataaacacgccatcccaatggcgtaataatttcactttggtttttgagataaaaagtaaaagctatacttttttttcttacagaactcttacaaatgctgatgtgacataccgtgattaatctagattcaaagcgccgttactgaggtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaactgcttcgttgagcctcctgatcctctgcctcgccgcgctcgccgcggcggccggcgccgccgccgcggctgctccgccgcgcttgcagtgctttgagcacccgccggacatgaaggccgccggcggcggcgaggccggcgtggtagtccacgacctggcgggctacgaggcctacgtcaccggcgccgcccactccgaccgggccgtcgtcctcgcctccgacgtctacggttagtacgcacatatgattgcctgagctagctaattaattaagcactgatcagttatcactacttccatttcttcattccataatgatgattatggactgatgaaccgctaatttaattttaattgctgctgcatgtgtgattgttaatttggttcaactcctcaggtttccaagcgccgttactgaggtaaattttctttgtcatcctcctctttttctagttttcttttctagcacaaatcatattatttttttattaaaatataatcgtgtgagatcttgctgtaaatatttaattataacaaatacaacggtacgatcagatcgtttatatgataaataatttatgaaaaaaatagtttaaagatacgagaaggaggctaaaataaaatatatggaaatgagatataaagtgtgtagctttgcatgcgtatggatagacacctcttgcactagccaaaaatgcaacaatgtagtaggggagagcatctaatttttcaccataaaatcgagtgtcccatttgtagccacatcgcaatcgcacagaaagaaaattgacacatgaaccgctatagaaagagactgatttaatttctatatagaaagtaatggcgtggaaaatgttcattttttatggtaaactgtttttatttcaattaaatggaagatgcaccaacacgcttgcacaagtttctcattccaattaaattctttttgacaaatcctacttttttttttcttgtacaagtcagaagcaaacacactcacgcacatacagagacacacctatgttggtgagtcctatgagtatctccaacatactatccaaattatacgaattagactttttaaacactcatatagccaactcttcatctaatttgtcaagtcaaattcattactcacttcaacatcctctaagtctgtgacaatgggtcccatatgttgaccttcccacccttcttcacccatcctctctattcttctcttcttcttctctccactccctccacaccgctgccgctccccctttctccacgctgcggccacttcctcggccgagagcagcagccagcagaaccgggaggagctgggagcctaggagcagctgccggcgatggcagagaggatgaaggggaagggaagggtgcctcgagatggccaccctccgtgtcaccaccgcggcattccctggtgcatcagctgctcgtccctagcttcctccacgtcgccgctctgtggggtgacacgtgacggagggagggtgggacggtgatggcgataagggcataaagcaacggtgacgaggatgaacgaaggcggagacggtgcgggggaggaggcagtggaggccgtgggtgcggatgccgcggagcaactgctagtccgttaccatggccacaatggcggctggtctagctggcagagggatgaattaaggagcgatggaggtgggcgctggtctaggcggcgacggggtcagggttggtggtggtctcgggggcagcaacagatggtggtggtggtggtggtggtcatcacctgcggcagcaggaatcggtgtggggcggggcagggcagcagtgggaaccggcggggacggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaccgctcgggatgttcaacagaacggaaacggcaacagaatacttctcgggtgctggttcttttgcaacacccgggatgtttcagtactacagctcaacattcttcccgtgtgctaaccacacccaggnaagttcagtcctacagttcaccatcacacgggtagtagaaataataagcaatgaaatagaatcggtacaagcactcaaatattcagcaatgtaatacaatcagtgcaagtactaagcataaactgatctgtacaaatgttaataccagatatttgttttagttgcacacatacatattcaaacagccacaaccaatctatggaatacacacaaaagtaatgtttgctccttcacataggtagatttttttcgaacatcataagtaccagttcttgaataatatctgggagtccattggataggtaagaccaaaataacatgaactacatccaaaaatcattgttccagatcttgatgtttggatggatttctgtagcaatgaatcatggctggcaattggacgcacttgatctagatgatggctgaaaaattatagtgtgtcagaaggtgctgataaatattgtatagaatatattgccagataaatattgctatagcatattatgaaagtttaagagtgcacattgttagagattcatgcctagatggattaaaatcacaagcccaaagacaattaacagtacaaatgtcaagcatgccatttgtctaaccaagtggttcctacttgtcctgtacaaagagcccagttagcacaaaccaggaagaagatacataaagaactagattgaactatagctagcaactagatacatgcatcaaatgtagttagtcttacttcttaggtacctatatatgcattttacctatttagattaaactatgtgttatatcttaggcaactgtttacatattgaatgcattcagattatatgctttttcgaagatggaactatctggtaaaaaggtcattaatgttggtataagattgctcgcctaaatagacagtggggcatgttggggccgctggtcgtggaggcaaaacattagctttcatcgcagattgaagcgcctgaaatttatttacacatgacaatgcaaatagttaaatttatacatgttgatgaattttaaaattaataagtacatagaggaggcaaaactacaagttaccagctgtatcgcagatgttaagtaacatgtttcatgttggcaagccttaccatcaatgggttatttcatcaaatcaggacttgcaccatgcttttccttaacaactccaaaataagcttcctggatgataagttgggtgtttattcaaatgggaagagattaaaaagttgctgatcaaattttgtgcaagctagagtgcaactacttacaagcttacccttgacacggtcagtacaatagtcctctccatcttttccattcttccttgcttctgcataagcctcaaatatacccactggcctcttctccttcttctccttcatgaaacaaaataacaattggattattttaatctgtaaaatacatttcaagattttatgccaatatgtgaaaggtgatttaagttaccatgttcttttggaatcggtcaagtgaagcgctgccttgacggtgtgctggcccatccatcatttccctgtataccctaccttcacatgactcttttatccactcttcattacaccaatgcagttccgcacacaatttccatccttccggagtcttttgagcccaccaatacacaaattcagtgacaaaaaattcctcggattagtcaacgagtaaaaagaattcatactacaatgtccacttctgttgttctacgttcagcaaattaaaggcacaaacagtgcactttaatgaaaactagaatatctctctagtgttaagctgaaaaactaaaacaatggcaatacatcgctagtaatcagaagtacaagtcctaacaagtaaaaatctacacggccaagataactaaaatgagaagcataaaaggaagtaaatattagccatatcacaatgcattaaacatgtcaagtttttttaccttgcttatgatctggatgaccaaatcactctctgaacaaaaaaaagtgaacggatatggctgggtgggaacaacctgcaaatcatcaaaatcaagcacattatatgacagaaactgaatcttcattacatcgaacaaaactagagggaactaaactgaggaaaatcagaataaaacataaataccagtgaagccgaggagggtagaggaaggcctggagatggagtatggctcaacctggtggatgatggctgaggtggggatgagctgagtgggggaagaggaggtccaaaggggtgacggcggaggcggcgatggacggtggaggcggcgatggacggcggagacggtgggggaagaggaggattaggcagggaggtgggtggaggagttggtcggcgttggggtctggcgtgggggagttgcgtgaaggagttggcctgcggcggtggagcggcggcggcttcgtgcgcaggacggtgacgccgcggagtcacgcgctggcggcgtagttagggatttctcagattggggatttctcgggagagagatggagtccgaaaaaaaaatcgggaaacaaggaataaaaaaaaaatcggcgctctgggggg

SEQ ID NO: 35129 - DNA, 4207 bp, Oryza sativa
ataatggtattctagcgaagccattcttatgggatggtagatatgcaattttctcggggggatggggactcatgtacacgccaatattttcatctgacaagtgggccacagtatgttgcaacaaatctcacgttatcttggacgaaaaccgttgccacgtatcttcccgggagttatacaggcatcccgtgtgcattgtcccacgcccaggaagcttcccgtgttctttgtaaaacacccagaaatactttttgacacccgggaaagtttaccatcctggtagtggtttttgggtatatgaaaaataatatattcaaatttgttgtgacaaaatctttcatatgatattacctactaaggggtgattttgatcttatagttgcatagcaaaaccttcagtccttgacctggctgagatgcttatggagggtaatggatggtttctgtaggaagctgagggtttccccctctgttttttagaaaattaagatgcatatcaataagtcaaaaggttgaaattgagtcaataagttgatattgatcagcatattcaattgaccattcatggcaggtgaaagaagctgaaaaggctaaatcaatatttgcttttctaagaaacgaaggaaaatcagtcgttggagttggaggatattgttggggtggtgagtcatattgatcaaacacaagaaaatgtatttatgtgtttatactttatatctatatatatcctaatctatgaatattatctaaaaaaatcttaatctatgaatacactcttgaaacttcctatccacattatactatgtttgatagaaattaaagtctctaaaaacatgtttatctggcaagaaagtttgctgtgacggtagcaaaaaccaatgaggtagaagcggttgtcatctctcatccttacgctgtgactgctgatgatatgaaaggtgaagttgaactttttggcgctatgcaatatttatcatttgatctaatctgtattatttactcatattaattattcccgttgataaacagaggttaaatggcccatcgagatccttggaggtcagaatgacacagttacaccaccaagattagtctaccagtatgtgcatgccttgcgtcaaagaaacgatgtgagttcttgtttgatttcgttgagcatgtttttgtctcgttacctttttttctcggataaaatcttcattttccactaaaagttgacacgatttctaatttgtccatcatcctctcaatcacatataggttaaatccacgtgttgatgactcatcgtgaataaataagggatttttttaaataaatcggcacatgcagcaaatttcattgaatagagaaggaaaaaaaaacttatgtatgttataataagggattgaaagctctgaacaactgaaactgaaatatttggcaagttaacgaggcgatcaatgtacaaggcacttgtaaatcaattaaaaaactgtggctttgacccaatttcttcttctagcatatacggtacagagtaacacaatgatattgttgttgttgcagattgatttctacgccaagatttttccaggagtttcccatggatttgccggtcgatataacaccagcgacccgtttgctgtcgaaaccgggaaacaagctctcgccttaatgctggactggtttcagaaacacttgaagtgatgaaacttaataaatactacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcggatagattcaaatgttacacagtaaatttggtcaaaattaggtcggaattcgtcgaaaaccaaaccgtgatacgatacgacggggcttgaatggccaaccggtaaatgtataaagggtaaattggaaccatgccattataattttgtaaagtttgagatatgccatcggtatctcaatgacatgtaggacccacatgaattaatgacatgtgggtcaggatggcatatctcaaattttacaaaattataatggcacggttctaattttccatgtattgtataaacccttgccaatgccttgtaagttgtatcgccacgtttcccctctctctctctctctgaatctctcgcacacccgcaagccctcaaatcacgccgccgcgccccgccgtcgtggccgccggcgacccctcaccccgcgacgccgccgacgccctgccatcgcgcagtccccccgtatcatcagaaaaatcagggggcggcagaacccggcgcactcccggagtcgtcaaggttttctctcgcggagttccatcccggccgtgctcccctcccccacccccctgcacgtgccgcgctcctcctgtcgtgtcgtcgtcgctccaccgcaaaaattctgtggctcctgagaggtacaatggtgccattgctcccctagtgctcgatgatatgcctttagggcgctttttttttgtgggggggggagggggggtaataatttgaggcaaaaattcagttcaccctagacaatcatgcggttgaatgagttttgatttccctacgaaacctatttgatgattgtgcaatttttagatctaatttcatgatattcattgcagctgataaatgcctcattatttttggagctaatttcttaatattctgttgatttatctttgttcctttagttttttcatggattgccatcggaaccttgtagcttataccctgtcatcggaaccttgtaggactatatacctttgtacatattgatcttccatatgcattggtttgttgagtataaacacaatctagatgaatatgtttcctgacaattgtttttcatttagaaaggaccaaatatgctaaaactattcactaaaatggtcaaacagaagaattcactgtcacactgcactttcaaaagtttttactcatactggatttgattctctttgtgttccttcagtattttgcaagattggcgacgccaaccgcgccgtgacctccccaaatcacgcagctgtcgctctcctcccacatcgccgttccctacgccggtcaggatctcccccgtcgtcgccacgcacaaccacctgaggcgctccctccgatatcggaataccctgcgcctcccctctctttccatcagtcacccaccgaagatcttctgccaacaaagtgctgccgtccgccgctatctttcaccaacgctgcgcggcgttcagcctctgcaaacgattgccaagaaggccttgccgccttccctccgattgagtgctcaatctgcatcgacacggtggtctacggaaaggctgtggtgcggtcacgagttccaactcggtgagcagctttctagccctccttgcaattttttagtccttacaaatcttaggctgacattgccgtgatacatttattcaaacctgatcgtttagtttattttgttctccttttgcattggatcaatgtgattacccttcataatttgggagcggctgcgttatacgggagcatgataacagatgctatgaatcatcctaatattaaattatcgatggctattatgcatctgtttaaaagtgactgaaatagagataaaatagtgaataaaaatgaatatatactttctgtttaa

SEQ ID NO: 35130 - DNA, 37749 bp, Oryza sativa
gaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtggcaccgacgagagcggaggcactgtccctcttccggtccctcctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgcgcgaaaccagcttataacaaacacgtctcatgtgtctgaaatggcgtcctaacgtttactgtaatatacttcaatgattcatcaggtatacaatcagcatcacaaaataatttgtatcgcttaattaattacgatgtttcgaatggtggctgtcggtaacttacagaagcatgcatgacttctgattattgttggtactagtagagaaaacaagacggcatcctcactctaaccgtgtaaaattttttttaattcagtgctaaatgtcaacagatgacatatatgccatcaatgaggaacgttcaatgctctccccaagatttataagtctggtgcagatatagttttcttaccgagggaatatatatacacttcgtcttgaaaatgtatcaaatatcactaaaaacattagaaacaaatacttttagtaatattacacatctacacgtaaagtcacatctttaaattcatgatatataaagagaaaaatacaaaattcagatagacttatagccttaaaactgttaaatatttttgttatgtctaaactataatgactatggggttaaaattttcattataggtgtgtaatactactgaaagtatatgcacaatttttttctagaatttattgtgatatttgttagttggtatacacggagtatgcacatgaatcttatatgtagatgttatgttcccatccatctattatgatatataagcatttgttggttgtttagaaaagattaaggtttataagaaaagactttggtgcatcttattaaataagggagggtaagggtgagagagttcttggcagtagtattcgtgctacaagtgattatattttgatataagttttgcaggaggaaagacctaatcatcatttcattactgtcaaatgactacatattatatgattctggtttaagaaatagcatatgacaaggaggaagcaggtagaggccgatagaaaatgcaaacgttaaaaagtatatagctgtatatctatagttggtggagatgctagctagaacactactaagaaaaccatttctgcagacgaaacccttctatttttcagacggatgtttattttgaaccgtatatacatcctcttatgaaatgcttattgctttctcgcaagtacaaaacggtacggtgtcaattaatccttggttgatatcaacggagctatggatcgattacaattaatggcgctctgatgtgtgtgaaccactataatgtgtaaattaaattgagaacattttttttctgaattacacagtgcaacacagacactcacaatgcacgcacactcatgcacccctataaacgcacgcaagcaaaccctacccctatgagaatcttcgaagactgggccgataaatcctagaaattgacgaagtcaccataggcgcctcgacagggccagtaaatcctgtcgacgggtacatcacctaccacactgaaagcacaaagtcattaaatcctagaaaatttgctcccacggggagtcaaagccaggaccttaggtactactgaggctcttgtaaccactagactagaagctcttttcctttaattaagaacatttaattcaattcaaagtaatagaaaaacacgtgtacattgtcaaaatgaaaaatataaactatagctctgatgatctcactccaagtccgtcccgtttgcctatatagttagcaacgagctgctctctcagtattactaccgaacgattaaagccacgtaaagaaaacaaaaatccaaggtatctcggtagagccaattcttgcatgagaaccatggcatgggcgttgttactcagcctcgccgtgctcgccgccgctgcggctgctgctccaacgcactcccagtgcctcgacaacccgccggacttgacagccggcggaggtgaggccggcgtggtcgtacatgacctggcaggcttcgaggcctatgtcactggtgccgtccattccaccaaggctgtcctccttgcctccgacgttttcggtgagtgcatgtctaggattatgattcagggtttaaaatttaggtccgtgtttagattcaaacttttttcttcaaactttcaattttttccgtcacattaaatgtttggatacatgtatggagcattaaatgtggacgaaaaaaaccaattacacagtttgcatgtaaatcgtgagacgaatctttcgagcctaattacgtcatgatttgacaatgtgatgctacagtaaacatttactaatgacagattaattatgcttaatagattcgtctcgcagtttacaggaggaatctgtaatttgttttgttattagtctacgtttaatacttcaaatatgtgcccatatacttaaaaaatttttggcacacgaactaaacacagcctaggttttaaattttcaaaattttggaacccccccaaaaaagtaaaaagactaaattatttcgcccaaaaatttcaaatatttttagtttgtatgaatttagtaaagcttattcaatttcggtcaaaaaaatgtttaaatttcaaataattttgttctattcaaaccctatgatgattagggatgaaaatggttcggaaagttaccggattctggacatgttttcggaaacggaaagtgccggtcggaattttttctgaaactttcagaaacgggaacgaattcggatttttttttgaaacggaaacgaatatgataaggttgctatcatcagaaactttctggaaatgaattcaaattttctctcggaatcgggaacagagtatttctcatgtacaactaattagcttcagctatctcctcttaatatttagatttatactatgtattgaggtgcttaattaaatagaaatattttttgttgtctagtactttagatttcttttggctaatgttttttttttagtttttattaggtcatgtcatacttcttatagttatagatgaatatagtttcttttctaaaaaagtaaagtgtacaactagttgtattattactattgataaaaaaaaatagaaatgtcgatttgttgttttagaaaaaaatatttaactacatctattcgtcgtcgatttgagaagttcagtttaagagctttttatattccaataaatatccataccgtatttgctccgattcgtatttgcttcattttcgtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcggccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacagcaataatacgtcattacatgtatagtcgttgttgattagtaatccattaagcatcgcatcgcatatgggtcattacgagtcgtgctttttgtcgttacaagaacccaacagctattttttgttgaacagcttggcaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgtgctgttttgttgcattgaattccactgaatatatcgtgaattatgatccagtagtagatccggaaacaccttaaaagcatatgtgtgataatgatgctgaaaattacaggaaaatagctgacaaagttggtcaagcaggatattatgtcgctgtacctgatttcttccacggagatccttacacattagacctgaaccttacggaatggttcagcaaacattctccggtaattcgtttcaccgtcttatgcaatttgattttatattccatagaacattaattacctagtaatcgtgatcgttcagatgaaaattctcagctcctgcacctatcaggatgcacaaattaagccgcaaattaagcaaaactatatccaaagtacttaacctatactagctagatgctaattatcaagaactcaataagttgattttgaccagtatatatgaattgatcctgcaggtaaaagcagctgaagatgctaaagcaatcttttctgatctaagaaagaaagggatatctgttatttggagttggaggttactgttggggtggtgagtgatattaatcaacataaagaagaagcacattaatttgtgcatttataattatactactacatctatcagtggtgtatcttaaaaataaaaagagcccaagtaaacttatttgctataaaaactctgtttcaatcttctaatatataatttcaatggattcagcaatgagcctgggcagccgcctgaggttgctagggacaaaaaaaatgtttgcagtcacgaataacaacatactccctccataaaaaaaaaccaatctagtattggatgagatgttttctagtccaacgaagacatgagtctgtccagattcatattctaaggatacactctgaaccttcctgatctcctctccacattgaacaaacagagatctgattcatattaaagtctctcaaaggcaagttttaactggcagggaagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctagctatagggttgcacaggaatatatagccattgttttcttattccaaagttcggcgtgacatttcacgcagaggtcaaatgccccattgagatcattggagctcagaccgacacactgacaccacaaaatttagtgtaccagtatgttcaggccttgcgtcatagaactgatcgggtgagttcccctgttataatttcgtttacagttgatatagcaaatgcatcagcatatatagctctatttgccttgcaatttgttatcctttttgtttttcagataagataatttaatttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacgggaaccgagaaataacaatagtatatgattaattaaatattaactattacaaaattaaaatatatttatttaatttttaaagaaacgtatacacatatatatatatatatataaaattttctaaaaaagacaccgttcactgtttcgtggtttaaaaaatagtcacagtaaacaagtgagttgcataagcgaaacgaggaaaataactcacccaaaatctaatccacaaaagctaggccatcatttggggcactgcatgtggctttaatcctatacctattcctttctctccttttttgcaagaagaacatatttttctttaaaacattcatcaaatatttcaataacaaatctttgcaaagaaatatattattcattagcaaaaaatgaacgttagaaataaccttttgttcattaattattgaagattgattactttgccaaggtcttccaaggagtgaaccatggatttgcttgcagatataacgccagcaacccattcgaggtcaaaaaagccgagcaagctcttgatttaatggtcgattggtttcacaaacacttgaaatgaagacaaggatcagctaatcatgcatgcaaggccacgactataatttcgtcaaaataaatttccgatgtccatacgtttaaaaattgcataatgagccatgcatcagttgatgtataggttatattgttggttgtaattttttaggatatatgtaaaactcaattaaaagcaacgtgtgcgggttagtgaattattatattggctaaaaagttacatggatatataacatattttagcagctttggtaatctctgtaacatttgtatatatatattaccaaccacagactgcaattattcctatgaagtagctcccaagtcaagccatgcatgtaaccaagaaagattaatttttttaataatagattaaataaaacccggcctctacatctatagaaggatgtacacaaatatggtattacatcaccaaacacttaggcttatactctccatcccaaaatataaggcacaaccacttttctctcatgtctcataatgtaaggcgtgcatgcatgcatacattaactagtatctcttggtcctataaaatttatttgttttaaatcttatactatcatcaaacctcccaatcactcccaatcacattgcttgcattcatcaaggtgatccaactaagaaagtgattaaatgttttcttggtctttgtgttatgggtggttatgccttatattttaggatggatcgagggagtaaacaagttcaaaagcaaacaccaccataggagacaaagagacaacaaagacatccagatcaagtctcacaacaaaaaatttcaactaacaattcaatcttcctctacaattccacctagattttgaataaaattccataacagtatcaagaaagattgataagccgtttgatttcatatatcatgttccaacccatcccagctcaatcatcccctctccaatatgctactgttgacaaccagcccagtccaactaatatgtgtgagatgcttgatttagaagcaggctgtaagaatctaggggttcaatttctcagcttctgacttctaggtagattttggattttacaactatagatcttcacatgcactcacatgcattcccagttcctcagtgaacagcgtgagctagctagcagtgttcaatctttcattttcggtatttgtatcgggggtgtcaacatggcgatatttccgaaattttagaaattccagtctaaaattttgaacaaaatagtcatatttgaacaaatattgtcaaaattcacgaaaaattaaaaagtttcagtcgaaataatatcgtatgggggttccaataggaccaaaatttcggaaattttgttacgaaattttgaaccctggagctagcaacaggagcaatccatggttcccacaaataaatgaagcaacacaggtgtgtcctccactatttcagaacaagatatcttaaccccttattatcagtgtcagtttgtataaaactggcataaaagaacatcaccaccaattggtttttatcatgataaaaactaaattactagtgggttttatcatgcaccacaagtgacaattatttaaaatatttgcatccatgctcctggccatcaaattggctatagatcatcaatgcctcctctctctgtctcccatgaaacaccagtgcaatgtttcttgagaataattagggcgtgtttggttaagtgtcaacaatccgggcacatatgcttactgatcgaactcccatgtgcgcatgcgtgcactgttatattgatggatacatcgacgataaaccaagcattaacttttggcgaaccggatgcactaccaaaaagtccagcaatttggccataggcctgcagcttccaagttcttcgctttgactttgcacaataattgatgattgcgtaggtagtaaaattcacaaattttatgagggaagaaatttaaatgacccaataaccatttctctttgtaatcctgcctccgtacctatataagatggacatggagcccttaaataacatggccaaaactcgatcgtcatatcaatacaacaccagacggatacaatatctaaatatgaatagggtaatacttctcatcgagaatgcctcaacctttctaaatttgtgtccctttacttactcattttagatctcgtgataccccttcttactaccgatttatagaatcaacaaggtcaactactataaattaaacatgatgttgaactcataaccgctgggcttgtggactgtcatagactgatgtaaacctatatgcgtggaaggaattcagcctcatagaagtattctcaagttgaaatttaaaatctccaaatttcaaagagatggtccttgtttgattgtccctaagttttcacttaatctttctcaggcctccacgttttgctcaacaaggtcaactactataaattaaacatgatgttgaattcataaccgctgggcttgtggactgtcatagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgaccttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatatcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaaccatggcaccagcgttgctctacccgaccatcctcttcctcgcagcggccgccgtcggcgccgccgctccgccgcactcgcagtgtctcgacaacccgccggacctgacgacggccggtggcggcggcgaggccggcgtggtcgtccacgatcttggaggattcgaggcctacgtcaccggcgccgtccattccaggcggaccatcctcttggccaccgacatcttcggttagtgcatgcctgcctgagctgccagcttatctgtctttgaaatattctttgatgatatattgtggattcatttattactaaccattaattaatcttgaattcttgctgttgcatgtgagtggttgcgtggttgttaattgtgggtctctacttcaggattcgaagcgccattgctgaggtacaatcttcttcttcgtttgtataatagggaaattgctgtatgtacgataaacttgttatgattttggtacgatccagtcatgcatcgtacacttgcatgaacattagcattcaattgtcatgcaagttacaacaatagaaaggtgactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctcacattaatcggagaaaaagaaaaagtagaatccatataaaaatataatttagaaatagctgaaattcggaattaaaaaataaggaatatagaagaggagactagagtccatatagaaatacaatttagaaatagttgaatttcggaattaaaaaataaggaatattagaagagtagactagagtccatatagaaatacaattaggaaataactgaaattctgaattaaaaataaggaatattagaagtagagtatatagtccatatagaaatacaattaggaaataactgaaattcggaattaaaaataaggaatattagaagtagagtatagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaagaaaaaaatagaaatttggaattaaaaaataaggaatattagaagtagagtatagagtccatataggaatttaaaactaactaaaatttggaataaacataataaaattaaaagtagagtttagagttcgtataaagatacaatttacaaataactaaaattccaaattaagaaaaacatgggaagaagagtttaaaatcaatataggagtacaatttagaagtaactaaaattcgaaattaaaaattaaagaatactaaaagatgagtttagagtccacatagaaatacaattagaaataataaaaatttaaaaataaaaataaataatattggaagaagagcatagagtctatatagaaatacaatttacagaaaattcggaattaaaaaaaagaaaatattaaaagataagtctagagtccatataggaatatatataatttacaaataactaaagtttgatattaaaaataattaataactaacacgtatataaaatataatataaatattacccattagtagttttgtaaagttattgcaaaatttaaaattatgttctcattttaatatatttgaataatataatgaggaaacatatatgctattatatgagagaaaatataatgatactagccgcgcaatctgtgcaggccactgtgctagttttgagagtaatttcttagggttttcaatatgttatccctacatggagatgatcagcagcatagcgacatatatatattggaattgtttcatattctatcctcctacagctaatctctactacttaaaaataagtagaagacatttccgttgtccgtaccgataaaaaccacgcgaaaaaaaggtttccgcatgtaaaagaagcaaaaaaaaaaaagtgtgaaaaaagtttctgcccgattaaaaaaaatcatctgtataaaccgttatccaaaaaaaaaaaacaatgttagtgggaaaaaaagttccgtcgtcgatactggaaaaaggaaaaaacgtgcaaagaaaaggtttccatcttccgtaaaaaagagtaaaaagtagtgcgaaaatttttttgttccgattcttaaaaaaaaaacccttctcccataaaaaaggaaaaaattatagtgcgaaaaaaaaagtttcgttccgattctaaaaacaaagtccgtataaaccggtcatcagaaaaaaaaagattagtgtccgattctaaaaaaacgggttacttttccaaaaattcctaaaaaaaataggttggcagaaaaaaaatgttcctcacaccgttaaaaaaaaagtccgattctagttaaagaaactggttcgacattttcagcttttccaaaaattcctcaaagtatatttgaaaatttaaaagcaaattcaattttccccttttgaataattcttttattcattcaaattatcatatatcaaaatccacctaaacatgtcaaaatttatataaaccgcgtgaggaaaaaacatcaccatttataaaataaccgatttgaaaaaactgtctgactcaacgtgagaaaaacgccaccttttataaaagaatctggtttggcaccatgcaatgcgaaaaaactgtctaaatttagaaagaaaaaacatccaattccgtgaaaaggattcgtaacatttgtattgttcatcgtctaccacgtcggtttggtttttttaaagcgtaggtcgaattctgacatctggaactaagacaagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccggtggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcacccccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccacgaaaatctatcgtttagtagtgattatcatgaaaagtgtcagggttatggataagatataccctctacccttggatacacgttgtatactgatacggtatacccgcgcctatacggatatttcctatgtacgttaaggaaattcgtcacgagatagatgcggaatccacagatagaaggagtcctactcagacagaactgggtcgttactgtatcgtgtggggtccgatgtctccgagttctacttggagaccaactgacctgcggtataaaaaggaccaccccgggaggacctaagacatcaaatcttaccgccaacacatccaccacagcctacaaagccggagcctacgggagccaagtcgccgggtgatttagttgaaccaactcgactacgatctcgtcggtatcattgagttccactattccctttctaatatgtgattttcattatataatcccatatcactggattagagctattacctatcaaggggcctgaaccaatataatccctgtttcctgtttgcttgatgtcgtactacgtagatcctcatatcagcgtaccccaataccctctatatccggtctacgggtatcccccgtcgacaaaaagcatatattgttattagaatttttcacccgttataacgcacgggcatatttgctagtaatataaatataccaagaggttcaaatataccatttaatagtgtggtaatcatggtttaatatctttaactagtacttagatagcacatataattggacagcaatttaaaatgggcgagtatatgcgccatgataagaattccatattgtgcttacttaaactaaaatatgtttttcatgacacatatactattgtacatcattgtatagtgtgcacatctgcttagggacaattaatatatgtaagattgtgaacccaatgttaattcagaacttattatgtgatcttccattgccaggttgtacgtcaagctatttctccatggcttgcagaaactctgtttatctgccagtactttattttaattttacatttgaaaacaatgtaaaagcagatgtttgattataaggttgctgacaatttcaggaaaatagctgataaagttggtctagccggatattacgtcgttgtgcctgatttgttccatggacaaccctacacatttgaccagaaccgtacagaatggctcagtgctcattctccggtaattcatttcaccatattaattaatttgatctaatattcccctgtaactttaccttgaaatcgtgatatatgattgagacgatagagtaaaagaaaactcgacagctgcaccaaggatatacacaaagccacaaaacaaaactttatcccaaaaatgtaacttatgcgggatgcttataaagataatatgttaaagttctaagaaaagataatatataaacagttataaacgattcaagataataaattaaagttctaaagaaagaatatataattaatattgacaagcattttcaattgatcttgcaggtaaaagcagctgaagatgctaaaccaatctttgctgctctaagcaaggaagggaaatctattgttggagttggaggttactgttggggcggtgagtcacatctatcaatcaatataagaaaatgtagttgtaatatcctgaacttaatggtcaaaatctttgatatggaattccagaatatataattcctaaccccatatattcaacaagcagttatttaattcatattgaagtctctgaaaacaaatttgttttactgacagggaagttcgcagtggaggtagcaaaaactaacgaggttgaagcaattgtcatctcccatcctgcagcggtgactgctgatgacatgaaaggtgaactttctttcttttgttgcgctgttcgttgttacaatagaaaatagctaataattgttttcttattccaagctctccttgattaattaacagaggtcaaatggcccattgagatccttggagctcagaatgacacagttacaccaccaagattagtttaccagtttgttcatgccttgcgtcaaagaactgatcaggtgagttcctgttgattttattgacggttggtcccaaatacatccatgttttttacttctaaactccatctcgctcttcaaatacttgttactggattctatttactctctttgttctaaaataaacaaaccttagataaaataagtctttacctattacaacgaatttaaacaggcaattgttcagatttgttgaataggtaaaagctcatcctatttaatatttgtttattttaggatggaagaagtagtttttgacgttgaccattcatcctatttgcaaaaataattatattacatattaacgatgtgtgttctgccataatacaactacataagttaacttcattaatctttaaaaagttattaatctgaaaaaatgatagtcaatagcgacaagcaaaataatagtttctaaatacaagttgcatgtacaaaacacacaagctagctctcactaactgaaactgaaccagtgtttaatatgctaaaaaaattgcaactgtaaacataaaagagaattaatttttactgatgatgagatgttaaaagaccttgctagctctatttgcatttttttttgagaaagaatgctagctccaatttggaagaataagtgctataacattgcatattacttccttcgttccaaaataaaaaggcaaaatcatacctttttatgttgtagttaacaatcatctccatcttccctaaatttgtttttttcaatcctccaccccaagatctttaatcacattagatgcatgcatcgtattatattgaggtaatccaaatgagaaggtgataatattttttttcttggttttcgtgttagtggtggtttgtaccttatatttttatattttatgattgcgggaataatatattatgttttataactaaataacctcttatatatgagttattgttgcagattgattattttgccaaggtctttcaaggagtgaaccatggcttcgcttgcaggtataacgccagcaaccctttcgaggtcaaaaaagctgagcaagcacttgcgttaatgcttgactggtttcacaaacacttgaaatgaagattgctaattaatcatgctaggaagaccagtgcaattatttcatcgaaataaaactctcgttctcgatataaaagtttgcatatcaagcagccatgcatttgatgtacactattttctttaaattatatggagtgaattaatagtatgttgtcgagttgatgttcgttatttatctataaataattatacggatgtacttgtgccattgatgttcattgctggctataaattacatgtggatgtacaactcaattttcacaagggtactatatatatactttagcaaaaccatcaaatttattacaaaactgtacaattatgccacagcatcagcaacctatatatttaaatcacaatttataacaaatttccatgtcacaaagtttcaatcctagcattgttatcctgatgaaactttcagaatctctagctttgtgatatgaaaaaaaaaagtttatgtagttttgtgatatattgtatcttaaaattttcttttaaaaaataataataataaagatactgtggatttacatgtgcaatttaaaatagctttattgaaatatatataattttacaaaatttactcactttaatttatatcaacttgtaatcagtatatttctaacaattaggccatgaataattgaaagggttgaaaagctaactatatattaccccatttatttcgttgggccttgggccattcatgagtaataacaataacagtagcaaaacatacagcaatgcatggcaataataataccaattaactttctaaaaaaataataataccaattagaagtctgtacgtatgcttacaaacttgtacgtataagttcgaaacaaatttaaaatgcaaatgaaaaaatagactttgatttgcattttcctaatatgaactttaattgcgaatcagcactctcgtcgctctgcatgcgtttccagtcgagatcggccccaggcatgcggccgttctctctcatgtgtgtagctcaaaatagaaagatcatatgccgaaaataaaaatctagccaaaaacagaaagatagatcaatctagtgagagacgatggctgagcggttcccaataatgtttttgccttttgtggtggtgtaatcaacggttgggcgcactctcctcaacccgtggcccgcgggacacgtgtcaaccaagtccactactattcctgcatacgtatgtataaactttatatacgtatgtataaactttgtatatatgtgtatataaagtttatacatatgctatcgagtgggccaacgagatggtatcgacgcctcagacaaccgccggcagtgtgcctagccatggcaccgggtgatggggacgatggcgagacgaatgccaagaatgcataaaacttttactagggaagccaaacctaccccttgcaatctggcatgccgggccgctcataggccaagcagcggcacgtagacaagctagacgtagcggagaagaatattgcacggacggggatacaagtttgtctcgcggcgagttgcccccctccccccccccccgggatgatgagatagtggtgcttgaggccttatgtgcagcgagcttcgagtccaccatggcttcgttggtggtgggtgtgctcgacttcttccttgttgtcgagctcctaatactgacagccaacgccatggctcacatcgccatctatgagtgaaacatgtgggtggacaacaggcaaggctccgtgaagcacttttccaccctccaattagctagttgtcaccctaataaggtgatgtaaggaagggtgacgaaatcattgaattgttttagaatctatttctaggtccacctaggcatggcggagtactttccctcacgggctaccaatgaccgataggccactaggtgaccttcgcgctaattctacctaatggtgggggacagactcggggctctgctttaccagtcaagacatacggtactagtggaagctggatgtggacgcattacacctagtgggggctccgctgaacaccatcctccgccgcatctcctctctctagaggatgagggatctagtcaaggagtcctgcttgctgggggtcacatggctaaagaccaatgggatcactcccttacattgggcacccaatagtctctatgggaggacctaggccccttcacatcgcgtggttgataaccccttaaatctttctaccttgcagtagtgctccacttgttgtctccccattccgaccttcggtacacactgcagcgttctaagaccattatcctagtcacaatggtgatcgcggatgccaagaagatactagggagttcgctacccaggaagaaggtcgctcgcctggctcgaaagaatgcatcagtttgacggaatagtgtggccaagaggtttgggcttacactccttgccatgccttctctccatgagctagaggagaccaacaaggatggaaagcgcaaggggcatcgcggggcggacgtggtccatgctcccaagaggtccaagcagggagcaaatctttggctcctccttttgtgggcgtgcctctacaggccaagcgaccaacactgttgttgtcagagacgtcggtgaaagccttcgatcatgacatcatcgaggtcggttcgtcggtctccactatccatgcaccgaaggtggtaacggtagcggttgccatagaggccaacgagacggcctggcaagtggccctcacaggtaagggtctcgtttccttcctgttatcgtgaggctatattgttatctcttacatgcctctctcttcattttccccttcttcattgtaggttttccagggtacaggtcgtagtcgtcttcttcgaaagttgagacaatgccctcgatgccgtggtggactggagaagaggaggtggcgtcgttgccacctcaagtggagatatcaactgatatggtgatatcggaggcggatggcgtccttgatttgactccggagcaagtgattgccctctgtgggggcatatcatggaggcagctccagagggcatccatgcagaggccatcatccactcatgggatccattgcctaccatcatggggcggctcgtgcgtcccagagacttggtggcgctccggttggatgtggaggcaccgatctggtcctccctgcttggggatgacgctcgtgtattggctactatgatgagatcaatggagctaatggagctgcaatgtgtgttggcctagtaggtgcgtccgtctgtccttgtttcttgttgggtttgttttgagtaatcagagtgccttcctccttcgctcaggccatggtggtcgtcaaagcatccatcaagcgtgggggaagtgatgcagcaacacaacacgcggagaggcttcgtctagacgagattatagccttaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatcaaaggacctacagtcccaaaggacaatgcccccatcaccgacaaaatgacctggtcgatgaggtaggggcttcaccaagaaggtcatcgccacctacgaggcttggtgctcataggccaccacccatatattgtcgttgcttcaacaggagtgtaggcacatcgacccctctgtttgcttggaccccgtggtgttctccatcctaatgtagggcgctccagcacaccatccccgcgtcgtgacatgaacgacctcacccggaggattgggccctcgttgggtcacaacgttgtagtggctgagctcgccgcttacaccgaggggaaaacgaagggtgtgcccaaggtgtagggattagttaattttttttagtaaatttcataaaactacagttacttcgatcaaattatcataaaactacaaatttaaggcactgtatcacaaaactacagatttaacacaagatttgaggccaactatcacaaaactaaagatttaatactagagttatcacaaaactatatattttacaacttaaatccctaccactactgctatgttagagtgataaatgttgtagttttgtacttaacatgttgcaaaacatgtacttttgtgataatattattactaaatgtgtagtttggtgatcttccaccttaaatctgtagttctttgataaagttggtcctaaatctatagttttgtgatacaccttaaatatatagttttgtgatagttttgtcaaagtacatgtagtttagagaaatttgctctcttttttttttctgggttccctgtttcttttatttctcttcatgtagccttctctctggcttagccttgcctactgtttggcctccagactatcctttttcttaccttctgcaattcgacataatatataggaaaaatttgctagaggacggtcaaattttctggtatttcctaacgaactcctaaaaggcgtgacatggctctaggactcctaaaagacacgtgatttactagtggacaccacagtcattatttcatcattcctgggcttaatggagggggaaaccatgagaaaaagacagttctgcccctctggctagcacgttgtatgtacattagtggctttgcttatgccacgaccttaacttgtgtcttgagccagtaccctttaacacatcgtaggcttcaccatcctcacccctccagggggtggtcatccctccggccgtcggggcctgcactgctttagcattgctgcctgtttgcacctacggttaccaaggtacatatggtttagtgtgtggcgaggtggccacgtcctccagcacaaccttcaactagaacttcgattgaagtctttcgttcaatgatgaggcacacgagccattgctctagtagctttggtgatcgaatctaggtccatcgaggcatccctagtgcatcggacctattctagatttcaagacatatgacgccgtagggaggttaggcaacatgtacggtggaatggcgaccggtcatggctcgcctgccatgggatgggtcagggtaccacgtgtttcatgggctcaggccgactaggattctagatcctagggctcttcaagcagaacactgggcgggggtccttacctactcatcatgagtagcctcatgccgagtcgggtgctgttgtggggtccttccactagggatccttaataatctagccatagcacaactctcccatgaggtcagggtggctcttacagaagtccgcctttaagggcgattcattaactagtccgtccgaaaaaccgctaatctctaaataaatgtggataattaattttaagtccaactgaggaaaactaatattctgttatatatatgtgtgtgtgtgtgtgtgtgtgtgtgtgtgtgtgttttcacatttaattaaaatacttattttagtatgattgttaacttatgtcatgtagcctctttatgaataaccatactaaaggaaatattcaattaaagtagtaactgtatgtcttattaccaaaatatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtgcacgtgtgttgattgtcatgggtgtcttccatggtctcctcaccctctcctcctaggggggcttgtttttatacccataggtgtcccccgtgtccgagtagaactaggaaaccaatatggatcaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggaccaggcagtagtcgtgacttgaccacttaaagtggaagttgtgggagagacgctacatcactggtcgaggaccaggcagtagccgtaactcgaccactgaaagtggaagtagtcggaggaacgctacatcgctggtcgaggaccaggcagtagccgtaactcgaccactgaaagcagaagtggtgggagaaaagctacgtcgctagtcgaggaccaggcagtagtcgtaactcgaccacttgcagtggaaatagtgggagagacgctacatcgctggtcgaggaccaggcagtcgtcgtaactcgactatataaagtggaagtggtgggagaaacgctacgttgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacatactgatgcgagaaccagtgagcgagcagaattatctctcgaacaccaatggaagttgcggtgcgagagattgctgcgtactggtgcgagaaccagtgagcgagcggaattatctctcgaacaccaatggaagttgtggtgcgagagattgctgcgtactggtgtgagaaccagtgagcgagcggaattatctctcgaacaccaatggaagttgcggtgcgagagttggtttattgcaagtgtatctcatgtggccagtatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataggtcgtcagtctttgttggtaggttgggtgcgataactccacaacctactcgagtgctcagttgttcctgaaaattattttctagaagacaagacatatagcagataatatcgagtatgtactcaaaaaactgcatagatcttctagtattatcaggatataacgagcagattaaatatcaggcattatgtaaaccgtaaacaagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataagtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacacatggaggaatcggtgtcggattgctcttggatgccaccgacacagtagcactcctcggcgatgatggttctgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggtctgaaggtctgactcgtagtcgacaacagggtagccttcctcctcaaatccgtgtccggcgagatcagagatagcgctttcgtatctcctgacggtatccggagacaccgtaggggaatagccatgcctatccctgaagtcgatatccggcagcgtgtcttggcgtatgtaggcttgtgtgttgtggcttctggtgggcgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttgtcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattccaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattagcaacagctagtggaaatactcaaataatactgctatgcccaggaaacactagtaattactacctccgtccctcatataaagtcatataaaggatattcactatttttaaaatactaatgtttgaccactcgtcttatttaaataatttgtgcaaatataaaaaagaaaagttgggcttaaaatactttagatgataataaagtaagtcataaataaaataaataataattttaaattttttttaataagacgattggtcaaacagtacaagtaaaatgttaaaatcccttatacgagttgacggagggagtaattaaatactgtcgccgttttcacgtcgctaccgttttaatttgtctgcaatataacgaattaatccggctatctgcgatatagccaatatatcatatctatgcgttatcttgttggaacgtacaggatatggccatccatgcgatatggccaaaaactctatgtacggttttgttacatcttaatcttctccgtcgtggccgatagagaccacacgtattacaagctaatcacaaatctagggatagctatattatatatttgtttatgacccatatttttcaccccaaattagtaagataagattcttttttacattgtaaatttaaaacttatacatatactacatattaaattacattatttacatattgttattttttttctaatatacgagtataaaatgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctccggatccagatccagctcctgtcggcggcggcgtaccaccttcgtcaacagaggcggcagcaactccagacatggcgatgagcagtcgtgcggaaggcactccccaaaaacctgatcacccgcctacccggtgcagatctcaggccaatctctcatgcgcgcaagagatcagaagcggggaagcgagagagcaactcaggcacggaggaggagaaactaacaccgggaaacaagcgaagaaaaacggatcagactcgcggcctccttatctatcaggagaaagaacgtggacgcgggttagtggctgcaaaaggatagcgacgtgacgtgacgtgacgcacgcaccccgccctcgccttcgccttcgcccacgccaacgcccacgccccggcccggcccggcccgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaacttaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagctcttttcaagggtctcttctctcagtcacacaatagtttgtttcaccatccaaattcacgggatctccgatcacaatggacaggtttctactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacatatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaccagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttcctgaatagcacgctgggatcatcaggagtaggagctggcttgcagtcactatatccaaagagactcaaaaccttgtccacatagtgggattgcacaagtgtaatcccacactcatctcctctttgtagtttgatgttaagaataacatcagcctctcccaaatcctttatttcaaaattcttagacagataggctttgacctcctcaatcacattaagcctggtcccaaagatcagtatgtcatcgacatacaagcacaagatcaccccttcctccccaccatagcgatagtatacacatttgtcagcttcgttcacaacaaagcctgcagatgtaagcgtgatgtcaaacttctcatgccattgcttaggtgcttgcttgaggccatacaaggatttcaatagtttacacaccattccctcctgaccttctagtacatacccgtctggttgatccatatagatctcctcctccagctctctgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccattaggctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgccccttctatggttcttggggtgtcatccacgaggtatacaatgtagt

SEQ ID NO: 35131 - DNA, 584 bp, Oryza sativa
  unsure (1)..(584): unsure at all n locations
cgaaggtaagaatatagtctgccctctagaactggaggtgcagaagatacacgcatgtccgaatgattgtatcctctatcgtggtgagaagtacgagaacctagaagcatacccggtctgtaatgcactacgatacaagattagaagagtctatccaggtgaagttgacagacaagccttcgaagaggagagttgctgctaaggtgatgtggtatttccttataataccatggctcagatgtttgttcaggaacaaagagcatgaaagaatgatgcgatggcacgcagaagaacgtcaacaagacgggatgctgagacaccccgctgatgggtcacagtggcgaaacatcgatagaaagtttaaagactttggaaaggatgcacgaaacgtaagattcggtttaagtacggatgacatgaatccatttggagagatgagcagtggccataccacttggactgttacgatgtgtatctacaacctccccccttggctatgcatgaagaggaaatacagnnnnnnnnnnnnnnnnnnnnnnnnnnnnnnnnnnnnnnnnnnnnnnnnnnnnnnnnnnnnnnnnnnn

SEQ ID NO: 35132 - DNA, 586 bp, Oryza sativa
  unsure (1)..(586): unsure at all n locations
nnnnnnnnnnnnnnnnnnnnnnnnnnnnnnnnnnnnnnnnnnnnnnnnnnnnnnnnnaattattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatactggtaataatttgtttagctc

SEQ ID NO: 35133 - DNA, 402 bp, Oryza sativa
  unsure (1)..(402): unsure at all n locations
nnnnnnnnnnnnnnnnnnnnnnnnnnnnnnnnnnnntttcttttactgtttgcactgtacatgcaacatagccccggctgtagctatagttggccatgtgggccgcccggcacggcacggcccaggcccggccgtgcctgggccgaggcttgtcgggccggcacggcccgaccgacgcaccggtccgtgccgtgccagcccacgtgccgcactcacggcccaggcacgacccaacacgcctcgggccgtgccgggccggcccgaaggcacgatgggccgtcgtgcttttcctcagaataagtctaaatttactacctcctattgggctgtgacatatgtacagctacaaaaagtctattgtacctccctcttctttgggctggggtatataaatagctaaaa

SEQ ID NO: 35134 - DNA, 599 bp, Oryza sativa
  unsure (1)..(599): unsure at all n locations
nnnnnnnnnnnnnnnnnnnnnnnnnnnnnnnnnnntatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaatgcatgttgcatccaacggctctgattattctgatgacgtggcaaattgtgatgatgagaccacttatggagaaaccatctttactcccggttggaaacccccatttaatcccggttttccaaccggaagtaaggatccaggactaaagatgtctctgttaaaataaccgggactaaagatacatctttagtcccagttggtaccaacaactgggactaaagagaggggatctttagtcccggttgatgttaccaaccgggactaaagagacaatagcggcagtaccagatggtcgccttttctttttcttttttcctttttattttctctcgaatcaagtnnnnnnnnnnnnnnnnnnnnnnnnnnnnnnnnnnnnnnnnnnnnnnnnnnnnnnnnn

SEQ ID NO: 35135 - DNA, 751 bp, Oryza sativa
gctaaacacaatcctttgagcatgttgatcctatatttaaattttctatttatttcaactgtacatttattttcgaatgtcaccgggtggtgtgaacctattcctttgttatggcctgtttgcattgattactctattccttgataccttgggatattataatttgactagttgagctttatatatattggttcaactagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtgggactgtgtcttgtgggtacagtggtacacctctggccagaagtaaaactattcgaatagcc

SEQ ID NO: 35136 - DNA, 6823 bp, Oryza sativa
  unsure (1)..(6823): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnaatgtcttcaaacattattaagatagggtaggagaggagatgtgatagtatatagactgatcatccaataatttcagtagatgtttgactgaaacatccaatattttcagcgagttgtctgaagatgtgaataccaaggttccaaatgactagcggcaagatcaggtatgtgcagacgacctccgagactgaaccaaactcatccaggcatggaatgcggaaaaaaaatagaccatagctcatctcggcatgaatgaagaatctcacattttgaagagtctttttgatgctcagggattcatgtaagcaattatttcttatccctaacacaaataatttgtctcggcttttgtttctgaaaatgatattttttttccatttttctcagagtgcaattaatcacgatgccataatgcatgctaatgatgaccagaagcttgacgccaatcggaagtcatgatagttttttttggttgctagttcgactggtaagagctggtgctgccgagacaccatcctcagtgttcttgaagtttaagtcaacactcaataggcattggtttatttagttcttctcagccatcagaaacttcaaatagcagggccaaagtctgcaaacttttaggtaggatgcacttagaacatctcttgcatattcgctacaaagaaaaagatgatctagggactagcttctaatcacacaccaagtttatcatagaaaggtcatgcatcaagctcttctactaggaacattatcatgcaacctcaagtcctaatttaccaatatgcaccttcaggcttcagccagctcaacaagcattaaccaggcattttaagaactccattatgtccaaggatatgctgctatttaagaatctgctgaaggaaatagcaatgttgcaaagatgcaaaaatgatgcaacatggatgctcaaaccttactaccagtaattttagctgtacttgagtggaacaatatttggctaggtctggtgtgctgcataaattagtttcattcagataggacatgcaaattagagatagggggaatgtttccaacatctttttgaaaccttttggcattgctgactgattctttttgtaagaaaggaacaaatctgaaacaagagcatgttaggtgacatgtggcaaatagatgaatacaaacatttatcaccggaaggattggtggcgatttttttttttcaaaacaaacttgtgggaggactgcggcaattcgttcttcccccaacttgtagtgttatacacgaaacatgataggcatgttgaagcatgaaaatacgtccttcacactttgttttttcctcattttttagatttccagctgcaacaaatttggtgcaaaattgcttatggggacctggttggactggtgaaaggaagctcaaacaacaatctttatttaattttcgtttgctttgagacaggaagaagtaactgaaataactattccctccgtactcgtaaaggaaattgtgttggacagcgacacggtctccaaaacacaactttgacttcttgtttctataaaaatatttattgaaaagtgatatatgtatacttttatgaaagtattttttatgacaaatctattcatataatttttacattttcaaactcaacaacttgagagttattcatgatttatatttcgaaagtttgacttaaacattgtcctaaacgacttctaatacgaacgagtatggagggagtacttgactaataccaacatttctttatcatttaatttttttttgtcttgattgccaatgcagggccttgttattcagctttgatgtttcgtgtgttcgtttcacctatttcctatttacattttcctgatactatattatcatcgaccttgttgtctagcaccaattctatagccaaattttggtctgcatttcaatcacttgggttcaatcacttgaccagattacgccattgacttttatgaaataacgtttgattatttgtcttatttaaaaatttggtataaatatgctaaagaataagtcatactgatacggtatcatctatttaaaaatgagagtactatgatacgatgaggttttctgcttcgaacatcagatgctagatgacagtagatgctaatgacagggaaacccttacggatgttaattttctatgcccttgtttagttccaaaatttggtataaatatgctaaaaaatacctgtgcgttgcaacgggtgaaggctattttaattttattattgttatatggtttagttaaaatggaattcactgtgagagttaggttggatatatatatttttagaaaatcatgagctgcagttaagagtagttagcatgcgagttcttttttaaatagatttcttatatgatttcttctgtattactaaaagcataacaataataaaccatataacaataataagattaaaatagatttcatccgttgccacgtacgggtattttttctagtaatatgtataataggtaaagaaatacaaatattacatatttaactggtgaatcaccaaagaaaataatgaatacagttaaaagtggcttagtgaaaagggtacacaacacaaacgttacatgaaaaacgcatgggttgataaaattatcaaattcatcataaatcatgtacaggatcttctcccgtttatttataccaaaaagcagagaatacaacagaaaaaaaaatcattaactatttagctgggaaggagcaggaccggccaggcaggaagaagcccaagaggcctagggcgatgggcagatggcccagctggtaaaaaaaaaaaaattcaggactcacgagcgcttcctcggtcagatgcagaacagcgcctgtacatctccgtctccgagcgacgtgcggcaaccaagccgacgcgacgatggataaaaaatgggacaacgtacgaaaatttgagggcaaaaacaccttgcataaattaagttgcaacaaaataaataatatttatataattttttaataagacaaatgatcagacaaaaatcaaccaacggtatcatctatttaaaaatgagagtactatgatatgacgaggttttctgcttcgaacatcagatgctagatgacagtgaaaacccctacagatgttaattttagttctaaaatttttcttcaaacttttaacatttccatcacatcaaaacttttctacacgcataaacttcttaacttttttgtcacatcgttttaattttaataaaacttctaattttagcatgaactctacacaccctatgtctacccgtgttgctagtcgtcctggttttcttgtacgtcaaagaagtgctgctagtcattaatgattgaccccctatgttgcagttactgtttggaaagtcgtacctcatcatgctcaaatgttctgcagtgtacaaagtagtgtatgaatgcagttctctactactatcacagctcatgtgaaatgggactccagctgagaaatgcaggacatggaacttcgattcattgcataagccctgcatagatatttttcaaaagatttattcatgatgggcctccctaataaagcagcggacggtcctagagacacatggcagaaatatcttactatatactagtatttagcaagtaaaaaaaatgcatttaactttgtgttcgttcaataattaaggagacgactacacgtcggacatccggagatttgtaaaactccggacggtgtttcactacgtgttaaagagatgtcgcaatgtttcattgtttcaaaaaaaatgtttcaccatattttgcaaaacgtcggacgttattgcacgaaatgtttcacatgttacaccactcgatgaaaaatgtttcaccaattaaaggaaaatgtttcatcgcttgaacgaaattgtttcaaccaaatacaacattcgaaacacaccaattgcaacacgaagaattgatatatgcaacatcaaatcaaaagaaaacgaaacaccttaataaaataaagtgcaatagagataaataataggctgcaacatcgttaaaaatccaaacaaaaatgaacccacctttgttttcttcatctactccatccgccgaaatcaagttaatgatgcagcatgggagaggtaatggctagggaagaacacatatgagcagcctcgtgagaggagtgaccttagccagggccaccacatctgatccacgccgatggcaagtccagtgtctccctccccgacatcctcacgttctgccctcctgctgccgctattgtgtgggcacccgccaaaggcagcatcttctgactatcttgcatcaccttgccctggcgctgcagccatggatgcctccgctatggaagaggtgaataccgtacccgaggaggaggaggatgcgaggatgtggtggcaacaggagcacccgacggggaggaggaggaggaggaggaagaagcaaggcatgaagagagccaagaacacaagcaagcgaagagccgtgtgctcgatggctggaagtttcgaggaaggagggagagcgagaggaaaaaagttaatagaaaagatgtggaggagaaggtagttggagttttggataagaatgaagccgtccgatatttcacatgcgctcggacgtacgtcggaaagcatttttgaataattaaccctaggaactgtaccatttcaacaaactaagacaataatttggggagggataagtcagacttttcccaaatccaaatgataaatgactgattggagggacatcaaagaaatgtaatcctatggcaagtaaaaaaaaagaaatgtaatcctagatattattttcccctgtggctgtgttgagaagagtttaagattataagaaaaaaactgattgaatagttaagtttctaataaactagaaaagttagatttcataccttcttgcttcttgtttattttctgaattttataacatagattctaattaggttacgttctttagtctactttccctaacttcactttcctcgtttttctaaatggcgtgttttttttaaaaaaatttctgtagaagagttgcattaaaaacttcatattattactagccacattcgtcacccattgcgcgactatcatgacttttttcaatctctatatgtggactatggcatatgccactaagaaggactatggcatcctctatgtttgtcgtcaattttacattcatatgttgaataaattttacaacatttaatataacctaccagtgcatttgttatagtaaattcattttttactatattcaccttgttgcaaaccccgaagctaagagtttgtttatagataactttgtacttattgtatataaattttacaaaaagaattatattattgtatataaattttacaaaagaatcacatgtttaaggttattcataataattgcaagaaatataccacaaagccatgaatgcattatgaatgggttttcaatttttgtgtttgtaaatgattgagaaatgatattaatatgcatccgttgacatgtttaatatcttaaaaccattttttatttggtaaattattaaaagtggtattaagaaaagtaatctgtctagagtggtaattatctttcataaattagaaactcgcatataaattatctcttaccgtaggtaatttaccatgggcattaagattacaaatttaatcatgtttttccatttgaatcataatttacttgaatatatatatatttttcttcttttattcaatataattttgatcctcctatcttttacctttgttatatctcctattctatttttgataatcatgttattgcattgcaattatatttttcatattttcaaatattttactctcaattataaaataaccagtgtcaactcagtctctaatgcgttaataaaataaaaacccttaaattaactaacttcctttctgatcaaattacatcatgtgtaaacccaatagctacggtctatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaatgcatgttgcatccaacggctctgattattctgatgacgtggcaaattgtgatgatgagaccacttatggagaaaccatctttactcccggttggaaacccccatttaatcccggttttccaaccggaagtaaggatccaggactaaagatgtctctgttaaaataaccgggactaaagatacatctttagtcccagttggtaccaacaactgggactaaagagaggggatctttagtcccggttgatgttaccaaccgggactaaagagacaatagcggcagtaccagatggtcgccttttctttttcttttttcctttttattttctctcgaatcaagtaggcaaatccccaaatcaatcccccaatcaaagcaacatcccaaattcatatcaccaaatacacatcacaaatcataaagttacttatacacacaaatcaaatacatcacaatatcctaaaaaattactcaaatacatcacagatccaaacaatgaatcacaaatttgtatatctcagtgaatcacaatttttttttaaaaaaacaatgccgctgctaccaccactcgccacgaccgccgggcg

SEQ ID NO: 35137 - DNA, 11710 bp, Oryza sativa
attttagtcccggttggtattaccaacggggactaatgatcaagagtaccaacggtgactaaaatggtgatatttagtcccggttattgacaccaaccgggactaaagatcctcggccccatgacatacatctgccagggtatgagccaggactaaagatcaagatcaaaatttttatctttagtcccggttctttttggaaccgggactattgtggattttgccagaccgaccaaagatggtttctccaccagtggaaagatgaatcctttcactactttagattttttaaatttttagctaatatttaactaaatatacgctaaactgttgtttcgttttgcgtgcaatgaggaaagtgttttcaactccaactgacgaacacaacctacagctggagctgtgccaaacggtatagattctctattttttggagcggagttagtagagctgctccacaaatttgtactacgggggtggagctaggtttttgctactccacagcttcactccaccgcaaaagacccactaccctttaattttttagtctatttataccaaaatgctactgaactaccccttcctaccccatctcccgttctcgctcatccccatcttcatcccttgacaccggcggcgccgttggtgtcggcagcggcaggcggtggtggcaggtgttggtggagtggcggcgagggccacgagcggcaacggtggcgggagacggcacgtgggcggtggagtgtggtcggcggcggcagggcgaggtgcgagagtagcgtcggctgcggcagcaggcagggccatgcgcgtgcggtggcggaggcagtggggcgacaccaaccaggtgttcaactaaatgccaacaagggacgtgttggtgtggagctaatcaatctagccaaatacttatatacccacttcagctcctataggagctagctatcactggagttagagtttaaagttgggagttggagcttggagtcctactaaacgggcctaagaatccggataagaatattgatcattcgagagctagaaatttttggagaaactgtggccgctaaaatctcgtccagatagtgcctatagtaacctgccaaataaagtattgtagagaatctcatccggctgtcaaggccatctggccatgcataccaaatcttttctcaacagcaaaccaatatacggagtatagtaagtactagggtcttataagagtcgatactcgctcttgctgccgccatggcgaacaagggaggagagccggcagcaagagcagctgtgcgccatggtggaggccccgtcgcgttcaaggacgctgtcgacgtcgacgccacgccggtgcgccctccgacggagctcgccgccgccgtctccgccctgccggcgggcgtctcctacggccagccgatgcgctgctacggggggacctgggtgttcgagagctgggcgcagggcgtggtcgccatgcaccgcggcggcctcgtgccccgcgccggcgacgtcctcctcgccagcctccccaagtcggggacgacgtggctcaaggcactcgcgttcgccaccatggcgcgccgcgcgtgcccgccgccggtgagccccgaccacccgctccgtcggcttaacccgcacgactgcgtgcccctcctcgacaggctcttcgccgccggccgcgacgcgcttttcgacgagctgccgtcgccgaggctcatgtgcacgcacatgccgctctcgctgctgccgccggcggtggctgacggcaactccaacaccaagatcatctacatttgcaggtacccataaccatagctatagctagccatcccttattcgttatattgttattggtactccctctatcccaaaataagtgcagttttgcactattcacgttcaacgtttgatcgttcgtcttatttgaaaactttttataattagtatttttattgctattagatgataaaatatgaataatattttatgtgtgactaaatattttcaaaattttcaaataagacatacggtcaaacgttggacacggatatccacggctgcacttattttgggacggaggtaatattattttactaaggggaatcttagttttgaatcatatccggtcgttttcgtttttgtacaccagccgaaatttatacatatcagattcaaatattagctgctctcatctcaaatctcatgtgtgaaaactttaaactaattttggaaatggtatgtatttctcccttaaaaatgagtattttgccatatggccgttaaatagagattttttatttcccaaagaaaagcgttaggaagaaagatggtacatgaccacgtgctgtgctatgtgtgatacaactgcgtagtattattatgacagaacgggaccctctaccaaatatggtgatgtagcatgtttcctatttggttattgcaggatctagattagctggtactttgttgtcattatttaacattgtatttttctataagtaaagtacataaaaccctactattatggtgtaagttacgtaaaactataaggattttgatacgtggcacatcacaccggatattatggttctaaaatttcataaaaccgtactattgaacattttgatttttgatcaaccacaccttttagttctacaattacaatttaaatttttgagaattttattcatcatataaatgttttgtccactttttaaaatcttgatataggagcacattaaaatggttacacataatacttgagattatgtgtcacatgccaaaatctctatggttttgtacaacttgaaccataataggtggggttttatagaatctactcttttctatacaagaagataaacgcacaattacaaccatgaccttggtaagagccccttcaaagcaaaaagaaatccccttccacacccactcccctccgtctgagagtcatccttgcagtattggtagatggtgtctttcactggtgccattatcctcctacaagagttcaaggtgatgaggtcaaataattggcttcccttttccttatatccatatcgatggagaggcagttcatgtttttctatagtgtcgcaagcttctagtccctctgttctgaaatataattatctttgccccctcttgtatgtcccaaaataagttcatctttgagtcatcattgcattggattttatgaaagtaggggacaaatgcattaattgtaattaggtaagtaggggactgataaagtagagggtattctagtctttttgctttgtattagtatgcaagagttcggtgaaaaacaaacttattttgtctcccttgcaatgagtcatgatgctctagaccatggtgccctttgagaagtaaagagccccgtgtctcgtgtgttagcttgttggacttgttcaacaacctcgatctctaccctaggaaaaaaatattgttcttacatacttgatccaaacattgtccaaaatttcatgaattcgcaaaagcaagtcctggatacaatatgtatatttagaaagagagaaattgcaaaccaaaatccaaaacatttattcacatagtattaactttagtgacaatgaaacattgctttactctagcttgttatattttgtagggaccagaaagatagattggtctccatctggcactttcggaaacgcaatgtgccagatctgttgctccaagaagtgtatgagtctatatgtgatggcactgggtttgctggtcctgtctgggatcacttgcttggttactggagggcaagcaaaatagatctaggccgagtgctcttcttgaaatatgaggaggtgcttcgagacccagtgaacaccgttagagagctcgcacaatttgtcgggcagccattctctgacacagaggaagaagctggcattgttgcggagatcgtcaagctatgtagcctagagagtctaaggagccagaaagccaacaaagaaggcatacaaggtgtgtacatcaagttctcgcacgactcgtattttaggaagggggtggaaggggactggaggaaccacatgactcctaagatgggcgaacatctggattcgattatgcgagaaaagtttgatggatcggggctcaccatatgatgcgccattatggccggggtttcatcttttaatttgtagtcacagttttcaagctatgtgtttcataataaaacaaagcctcctagcctgtttggaggcttaactttaactgtttatgcttataaacaggtacatctatgacctatgtaattttcggtgcaccaaataaaatccttccgatgctacccatcgtttttgtcaatcaccataggcaaccatcttttttgttaattattgtaattaacctctgtttaggtaaatgctgcagttacattcgatctgtcactactataggaactcacttttgtgtcagttgggaaccggtctttggtgtcaaattcacaaccggcacccttcatgtgacactgatgtggagaatggtctagaaattggtgcttttgagattccatgaataaaaaaaatgctcgatgcatcggctcgaatcgaacatatgctacgagccaagaacacatacaaaaactgaatggaagattctcacaaatccaatgacaatgtatcagaatcatcccagaaattacacacataacattcacgacctcccccctcaaagaaaaaaatatttacaaatcaacacaaggatgcctccattgcctcatcccagcggagaccaaggccaccaccacccatcggaggccaaagccacctttgccgctactgctcaccaccactactcagatccagaagaccacagtcagatataaggggtggtgggagagatcagggaggggaattttttgggaggaggggtattggttagtcatgtggatcgccaccaccgctgcttgtggggaggtggggccgaggggaggatgctgatgctgccccaccgaggggaggtcactgttgctcgttgtcgctcgtcatggtcgacagtgataactaggggagggaggagggcagatctagaggttcctgaactcggacaatctagatatggcatcggtgccaccgccatcgccaatgacgatgaatccgtctgcgggaactgaggctgtggccatggtgagaggataacctaatggcttgttcgccgcaatcgtcgtgtcactgggagaggcaggctgccgcctttacgtgttggggtgtcatcgtagcgtcgcaggctaggatgctgagaggtggagaggagtaaagagtgagagacaatgagagaaaagatgaagattatcttaggtggaggcttagagggtttgagagagacggatataagaaaggaatggacgaggtcacgaggagatatggcgtatgtctatgtgattttttttccgctggtgctgctgctccaataatgtgccaaaaaacctagcacatatgacatctttatttgtactgcttttattaaagaaaatcaggcacttgtattatacgtgttggtttttagaaaaattggcacgttataggtgttgatttttaatttaagaatttacgaaggataggaaaggccttgtagatagaggatgtccccaatttgtggttttctagtagtgtgttctagggatcttgcagcgtatgctggagcttgtaactagcttaattaccaccgtacttcctccgttccacttcgatcatcatttttttctctctctcatttttgtatttgatgtatttattttggagcatgttaaaaaaggtttaccataatacatcttgatttgtcatctaaatcagcagttttagctatatccacgcacatgtgccaaattaattacatgtgccaaattactagaacaaatcctgtaacacacacatgccaatttgatacacaaatccacgaacagtatgcaaacagctgctttgcctccacacaattagtaagaataaaaacatagctcatgaaaatttagatctagctatcagtgaaaatgggaaaaatagaagccccaactcagcggaggcgcaatgacatgttcttcatgtaggctgcgagcagtatatactccctccatcccataaaaaaccaaatctaatactggatatacttcctccatcccataaaaaccaaatctaatacgggatatgacacattttagtacaacgaatctgaatgtatcacatccagtcttaggttcgttttattttggacgggaggagtattttttttaagaaggatattttttacccggattctgcatccaaccggatatatgcagcctttttaaattaggaacttagcctatcaaataaggaacttgccctctaataactcaatctaaaattcgctcatatggaaatttgaagttaggaccttgggtgctactcagatcactgcaaccactaggctatatgccctttcacggacgggaggagtatatatcatctccatattaattgcagatgtgtgaattaattaattacttccctccctcccttaagatgactcatcatatggggcttgggcaataacactagcatacttagtaatctatattaaatttataaatcctgtataaacttataggatttataggatttataggatttatgacttcataaacaagtacatggatatggcataaaggcttccattgtcgaagacctggtcctttattcttctcaaaagaaagaattagaggttgaatttttctagcttatatttcaatgaacagtatactggattgattgttgacattacacttagttagtttagtcatcttgaattgggaaatatatatgaagttagttgaattcttaagtaagctgaaacagtttgccttaatttactaaatttgtcttagggtgcagtaatcattgatgatagacttctagaaagcattttatatagtatgcgcatctctccaaagcaaatgatatccacagccatcttgcagcaatgtgtggggaatcattatgtatttatgccagatagctagtccattatcccattacatcagtaaccagagtaactctaacaattaccaaaatacaagctacattgtgattaaccgaattagggaaattacaattaaagggttttccttggtgccctggaaattacaaagttataaccgttttacaagcataaaaggttacagactatacttccaaacaacaccattatttcaatacatggagaaaaggttcaacaagaaaaaaaacaatccaacgttttttgcgtactactatatattgttaagcataaattaaaagacgaaacacacgtaaaactaaatgcatattcagatagtgagtcctgacccatcaaacttgtcccggagaatcgcatccagacgtcttcccatctcaggggtcatgtggctcgtccaaccccctgccacccccttccggaaatacgagtcgtgagagaacttgatgaacacaccttgggcgccttccttgttggccttctggctcatgagattctccatgctacagagctctacgatctccgtgacaacaccagcttcttcctcggagctagtgaatggctgcccgacgaactcggctagctccctgatgctgtctgttgggtcttgaagcagccgctcatatctaaggaagagcaccctgcttgggttcgctttgcttgccctccagtactcgagaatgtgattccaaacagggcccccgaagcatgtgccctcgcagaaggactcgtacagattttgtagcccattgcgcttcaggaagtgccacatggagaccaatgcatccttctgatccctgcacatgtacatttatatgttttgacagctccttcttttttattgcaaaaaaaaggaataagacttaacaatggtgttttaacaaatagcaaaatcgaaaaactacgtaactacagttcaaacctggttaccacctagctagttattgcattggacgaagattatgaggcatatctgtattttggggtacctagctcaattaaggctggacattatatgttaaactttaatttgtctttagatcgatcgatgtgctctttttttaattacacatggcatgctgcagtgattatattatagtgttcgatgtgtgtgctctaatactttattcacgatgcaattatcaaattgtggtttggatttttgatgaatgataggagtaaaacattgttgatcatgatgtgttccatgaaaacgatgaacatatatcatatgagaattatatttgtcacaagcaacttgttaatttttgcctttttatgtctttcagtgatctaggttcttcgcacatgcaccaagcaaaatttgaaaatggtggtattattccatcccacttgtttacattaacaatcttagttaattatcacttcatcatggtacaaatataatgggccgcaaattgaatattatatatatcgacatgtctatctatatataccacacacatatacagaaagagaaagagagagtatgtgtataagatcttatgtatttactcccggtctgttgatgagagagattaaagaggaatatatgtgcccaaattatggctatatatagaggttgtttaattatatacaccctccatttgatatataagtagtttgacttttttattagtcaaatttctttaggtcacatttataacattaaattagttttattaaatttaacattgaatatattttgataatatgtttgttttatattagaaatatatatatatatatatatatatatatatatatacacacacacacttataaacttaataaagcttaagagagtttaactaataaaaaaatcaaacaacttactccctccgtttcaaaatatttgacaccgttgactttttagcacatgtttgaccgttcgtcttatttaaaaattttgtgaaatatgtaaaactatatgtgtatatgaaagtatacttaacaatgaaataaatgatatgaaaagaataaatacttatttaaattttttgaataagacgaatagttaaacacgtacttaaaaaaatcaacgatgtcaaacattttgaaacggggggagtataatataaaaagtgtggtgtgtatctgtccgattaattacctgaaggacacacagtagctagcaactttggtcgagctagcccatgcatatatcagtcccattccgtcgaccgtccttattgtagctaacaaatatccggtacacctaattgatatgacaacacccagtcacctacttccacgttaattgtccaattctatcacgtagctagcacaagtacgccttgcgctgtactaacactactacaataccctccagtcgctctctccctccccgttctctctctctctctccccctcatcatattttgtttgcacatatatataataacgacatgattctatatattcttctctgcccattgttattcatcacagaaatcacaattattaacactactacaataccccttattgatatcgattcataggtgtcggtcgacatttaaaaccgttacctacggatattttctcacatttgcacgatgaaaaaaatatagaacatacacctttgagtaatataaatgtcagttctaaagaaaaaatcagcataatattttcaaatgaactaggacctataatatattgtaatatattgtaggtactggttaataattaaaaaagaacctataatatattatatgaactgattttttaattaactattacccataaaattgacggagccaagccactttcttatccacatctttcacacatctatcctcacattttctccctacttttctccctaccccgtactccttgtccacatcttttgcacatccccaccacacgggcctttcctcctcatccatcttcgtccgccgccactcctccctcctctgcctcctcttcctctccctggtgacgcccctccaagtaattctgcccctcctcctcaccactacctttaagccatgctagatccggccgcctggaggtcggggtccgccgaatccggctaccacgcagcagtagcaccgctagaaggacctgtcaacgtggaactcgctggtggcaccggggccgagaatatcgacgaggacagcgccggcgtcagagccaatgccgaggatagacaagcggcgtacggagaagagtggcttctgccccgtcgcagcgccatccacgagtaacccgtcctagcggtggtgtaggctggggcagcggcggtggacggtgagcacgggcttgagcagcgcaaggtcccgtgccgctgcacaccctgccgggcctgtacatctccaccttgaacgtcatcatctggatccatcctccttaaggggatcaagcgggagcagcaccggtttgtcgagaggcagcaactgcgatgatttattttattctcctctctgtgtattctctattgttctttgatattgattttgtatcttagtgttgatttcgtaattgtgttattggatgtgatgaggggatcttataggaatggttcttggatggggatcagtagctgctcgatgtcgagcaaccttgctttatttgttcctcacaccggtgttaggtggtaagaaccgacacctatgcgcaactgcataggtgccgactacggaaaccgatacctatgaccagtttctaaccggtacctatgacagttcaagcaatattgtaataagggcatcaggaaggcacggttctcattgttccctgtggtatatctatctgtttgcaaagttatccttatttcatagataagaggtgtaacaatgatatattataacctaaacttaaagtaattttacaaataccatgaaataatttaattaacaattggtaaaaaaaacaaagtgaaatgcaaaaataaagtaaatctatatactactacaatatatttttgtagttaaaatgaactaaaatcgaacacattaacatggcactacaaatttatgattagcaattaatgcataattttaggtgtttggaattttcaaattttcatgtgcctaatatctagcttttaatatccggcacatttgagtttagacttaatatttgaattcggtatgaattttttgcattgtggcctacataaggattttgcgaaagatgtagcatcattttttttgtcctattaattcaatcactttattttattaccatttactccacaattggttatcttcctcatgtcatgtgtaagttaataaactaagccagtatataggagtacttgctagccagtgtcctcaaactttatcacgcacaaagtcccggatacctgcaaatgtagatgatcttacagccggagctaccgtcggccaccgtcgccggcagcagcgacagcggcatgtgcgtgcacatcagcctcggcgacggcagctcgtcgagaaccgcgtcgcggccgggggcgaagagcctgtcgacgaggggcacgcagtcgtgcgggttgaggcggcggagcgggtggtcggggctcgccggcgggtgcgccgcccgcgccatgacggcgaacgcgagcgccttgagccacgtcgtccccgacttggggaggctggcgaggaggacgtcgccgtcggcgcggggcacgaggccgccgccgccgcgctgcatggcgaccgcgccgcgcgcccaggcgtcgagcacccagtacccctggtgctgt

SEQ ID NO: 35138 - DNA, 1169 bp, Oryza sativa
  unsure (1)..(1169): unsure at all n locations
cattttcggtagtggctttgctgctgcactgaaaccacatgcttttgatggttcaaactataagagatggaaagcacgtgcactattgtggtagacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcactcgaggccaagttcggagtctctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacatccggggcaaaaaggttgaggaaggttctagtgccaatatggtacagaagaagaaccctcatgcatcccacaacaacaaaaaagtcaagcctgatgtcaaacccaaggctgcaaccaattttaagaagaaaggcaagggaaaggcaaaaggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatggaaacgggtcgcttgcggctgttcatggtgttggtacggtcgatctgaagtttacttcgggaaagaccgtgcagctgaagaacgtgcagcatgtcccttcaataaagaagaatctnnnnnnnnnnnnnnnnnnnnnnnnnnnnnnnnnnnnnnnnnnntgagtccaataaatgtgtcgtatcta

SEQ ID NO: 35139 - DNA, 1805 bp, Oryza sativa
tcatctgttgtggtacgtctttgttcgttgagcgcatcacgccggtgtctttttcctgaatccactaatatgttttcatctgtcgtgtacgtctttctccatcgagcgtgtcatgccatcctccttgaatcccagttgttctttgcatactcagaatcggagaaaagaaaaccaactcagaataggagaaaaggaaaccaagttgtatccgttaatacaacaaaatcctcgtaaagtttcatagcttcaatatgaccaaatcggataacaccataagccaaaaacaagaaccgaagcttaagaaaacaaacccaaaaatttcataagaaaacaatatttgctctacctctagccgcctgagggacttcaccctcttcttcagtggctacagggtgggctgctggattaggcacctccgaactcactgtcgctagatctgatagccacaaggtgatgctggccgagagaaagcaggaggaatcgaagaggacatctcggatctggatactttgagcggcggcggcagcgtcgctggcctcatctgcctcctctcctcaccgtctttctcgtgcccttctgtccctgatgaggctaccgaagctacggggtgggtggggatagagacatcggcggtggaggaaagtagcgagcggcgtggctagggacggagccagtgttaggagcgaaaaactaaaatggagttcagagttcagaactctgaatggcggagtggatggcgccgcgtcaggctacttacgccgggtcggtggggaccgatggagagagagagagggggggagggggactgagagagagataaagagagagagccaagagagagagagagaggagagggtgcagtggaggaaaaaggaggagagaataatgacagaagagagagatgagaagaggagaaggacgggaggccaccggtgttcggctcgactcgattttaggagtgccttttttttaaaaaaaaattccaacacctataatatattagggttgtcagtttttaattaatggtcacctataatatattaaaggttctattttttaaaaaccattatctcagatgccagtttttctttagaaccaatacatataattatttaaatgtgtcagtttttgtattttcaatccacagaggtgagaaaaaaaatatagatgccgatttttagcactttcggtacctatagtgccgatctctatgtgcttttttttaagtagtggcaatccgccgcgtcctttccgatataagcctgttcggttgagtacgagtgatgatgcacacaaccatcagaataatttatccgtgttgacgtgctaaaggcaacatcaatgcatatagctaaagtagtacatatagatgggacactttaactattgcaatattcacaatgtatacaggcagtaagtagtaggaagaggagagaggaaatagagacaaatgacatattttattctatatgggcagctcatatgcttatggatgactttggctatttttctcctatgaactacttccacaatgtggttaggtagctgaatgtattattttatagaaaaagtatgaattaccccccaaactatcgcggcgtctgaattacccccctcaactttcaattccggacaaattacccccctcgacccaattcagagcggttttgtcctacgtggcgtacgcgtggcaatccagtcagcattttcttattaaaaaaatgggggggtccacctgtcatcttccctctttctattgttctctctctctcatccacaagctgacaagcggggaccacagggat

SEQ ID NO: 35140 - DNA, 19591 bp, Oryza sativa
ctgcaaaaaaacattttttagacgccgcttaagtggtccgtctgcgaaaatagattttcgtaggtggataacgaacttcacccgatttatatttttgtaggcggtcatttggctccaagggtcatgtccgcctgcgaaaaaaagaccccacgtcggaaaaaaatgctttttttaagtagtgagctacatgcggtcctttttgttaatgcagaaatcgatgttagtcttctactgctatgtgctatgtaagtatgtatgggaggcatcggaagccacgaatctatctgctgggtcatgctatgcttaacgagcatcgagcaggtaatctcagaggcagcacagcaggtctgattgccattgtgtatttcctatacaagatgataccccacgtgttaaggtgggcattggagaaatacctaaaaatatcgtttcaagctacaatctctcttaccagtgtttgtcagcggttaagatgcatttttaaagaactaaaaagaacatatctataattggacctagtaaccagtacaactgatagcatgaaaataagtctttgtattatatgattaattcaacccatactaagaaagcgtgatttgctctttgatgaaagaaactgcatgaaaatatagcgagcaatatataacagaacattaaaaaaataataaggagaatgtctaaggatataaaaaagatttaaaagaacaactaatggtattaatgacatatatggtgacattgaaagagaaaaaggatgggccatcaaggccaccaatcctatcgtttcttctgctaattaagatctaatactgcagttgatattatgggtcaacttctaaggaaaaactgataacatggttgcacataatctaagctaatggtgactcatatagaaatcgtagatgtagccggtggttccccttggtaccggctgcccttcgtggcctggcttggcggtctctctcacatgatcatagcccgattggatatctactttctatactggtatgaacattatctatccgaatccattttgttttcatccctagagtggatgcagctgccgtctcgagcttagttggattgctgagcttaaggagtttttcttgccactgctaagtttaaggcttcaataaatttttcagtgtaattagtagaactgtgtttgctggcaggaaagagactacagttaatatgacaataaacatagaccgtcgtggaaatatgttttacatagtttttgatacaaagccattgaacctaataactgctttctatgcggtgctactatatcaagtgagtaaatttgaggccatctcaaaaatggaatagatcagaaaattaaacagagaggtaaaaggcaattaaatttgacaaaccccacatcacagtaaagatttcatttcataccaaatcgcctgctttcatagtaatctccatgttctgtccatttgcatttactgtttttaaaataaaccaaatgttcatcaattgtggctcattttcttttaaatagctctacggtcccacattttgtactgccattcacaacactacaagtctcgaagagtccatataaatgaccataagagaaagaaagagagaagaaaacacaggaacaagaacgagagcagctcagacatagcagaaggcaaggaataacatgccaagcagatgacaacaatttgctcctcaaaaaacttacatgcatattaggtctaagaggcatcaggagctccattacaatctacctgttgcatgtaccatgatagaaaaatcaagggagtgccgggagaggcacaaatacaacctggcccttctagttcgatgagagctaggcagccaagttttgctccttcggccaactaaaaagccttcctttctgctcctcgatcaacaaggtcacaaattcaagcatatcaggtcgcatatgggttatgtcccaacttccaattgccacatggtatgacaggcgagatgatacctctggcaaaggatcgaggaatggcagcagagtactttaggcttcaatatcttaatctctgtcccctgttactggataagtttttacaaatttgcttttagcggtcaatctcttcctcaatttcacttgtggactaacggtcaagaggaggcaaaggcttagagcattgtaacaaatacgtaggtaagcaaaagatcagagcaccctgtagtcaagcatcgaccatacttccttgttcttttcaccatattcatcgaattgttgtaatggattaattgctccatgcttcgcaaaatatgcctttgaaagaaaacatttttcaattgcattgttagacaacttattttaagttatttattcaatttattttataacatatttaagccatccctataatcaagtaaatagcatgtgacaataatcttcacaacaatctaattcaaacagtgcatttcgcgcaaacattttctatatataattttcctgaaatacttttttaaagtaacttttcataccaaaccaacattgaatgtcactcattcgccattatatgttaatttgatgacttaatgcactaaccatctggctcatgccattacacgtgcatagatgcattgagtttacatagcatatactccctccgtttcaggttataagccgttttgattttggtcaaagtcaaaatattttaagtttgaccaagtttatagaaaaaagtagtaacattttcaacccatgaaaaatttattataaaaatataattaattattgatttgatgaaactaattttaaatattactatatttgtctgtaaacttagtcaaacttaaaacaatttgactttaaccaaagtaaaaaacgtcttataacctggaacggagagagggagtatgtttaaaaagtgcctagatgttgacacaaaacaacaagaaaaatacaacgcactgtgcctcaccaagctgtttgactgatgcaccattaatctcgctagagttttggttgcacacattttccataggctgatttcctccgtgatttccccatatctctcatgcaatcaacataaacaagcaaaggagcaagtgaatgagtagatctactgccaccccattcacatgctgtagtagcaagcacaaagaagtcagaaagcaagcaacttttatcatacacgcaagcatgcagcttcggtaatagccgttgatagccgtggtgcagggatggcacacttagatgatatgtgaccagaaagtggaaaatcttgtggtgtttgtggtgagccttagtgaaggtggaggaagtggggcaaagtcggcgagacaaatctagtgggggaaggaggtgaataagccaaaaaattgcgttggtgctagctatttcggaaatactcaaccactcctaaacttaaagatttcaactactcggatccaactttttaatatgtgaatatgtttacacatgcagtagtctttagaatctgcttgcgagaacggtttacacatgtggatgtctttgaaaatatgcctgggtaaaggtgtgggcccacttgtcccgtggatagttagatatacttacatatacggacaacctaactaactgcttgtgaaaaggcggctatctaaagatgccgtcagagataacaattgttattttttttgaaaattaatagaaatcctataggaacttctcaaattttttgaaaattctttgtgaggaactttttctattaagattgaaagcctccaattctcctgctggtcaaaagtgcctaataatgttctgtttccattctgggaatgtactaatagtaaaattattactaatgtattctaattgctgtgcttctctgttctttttcttgaacgcaatatagactcacctactaccaatttattatagggtatcccatccttgcactcttgatctacgtagaaccatacgtgtaactttcatcacaacaaccaacattagtgttctacactttggtataactgactagcaacaaccactgtatgcgtctgaactctctaaatatttcttgggaaaaagttacatgcaatagaaatgggatgcaacatgaaatgtactgccaccatatctcaccagataactgcactgggtcgaggtctttgggagaaacttctgatgtggtcttcacgtgatagcggtgtcgaattctttcacaagagaggatagctttccgtcagactctagcacagaaacataagtgcgaatcaagtagaaagctcttggttgaaaagaaaaattagtcacaacaaatggatcataagttaaggaaggaacaaagtttcagagattgtgtctgatacaatgaattcactaattcttgaataagaccaatgaagcagaataaaatcgagggctgacaaagtttcgtaaactcagtatatatacttcctgtacatttctgtctcagctatatgcatcaacttccatgcataacgactttaggcaagaccaagggaaatgtgaacaaaggacgaactagttttgcttctttacatactacaagaaacatgacttcagtttggcttttgctttggttagttagtacttgatccttttacaatgttcaaaaaccttttagctacaaaactcagaatgaccaatcaggcaaccgtacgagagaataattcattgacccatcctatcctagcatgttttcactaactgtcttctatattggtgctagaacttccaagttccaaacattgatgacatgtctgaattccgttcacttctcaacaccataagccacaattcaggatcaaagcaaaaatggaatatctattgcctcaatgactgtatcctagaaaatagttgtgctctcaacattgaattgtgagtcctgttatccatacctacatttcaagggttgttgtagttggctacttaatatcatacacaaatccctatacatccaacattaacgtccacttccatgtcaaatacataattgacttttttaataattattaaacagtctactgacaaaacaggtataaatgatattaaaatcaaaatatatgggcatagaagagagtgagaaaaactcagacacaatagatcaactgaaaaattcccactagtggggaaccggtcatttgtgccaggcgataaccctcaactgtgttgacagagggcctggtaattgatgagtggtcattgaggagcaaatatttgccccactagccctcccacccgaagtagcacccgaagtaggaacagtacgctgggttgtgataactatttcaccaagtatcggggtatatatatagtcacttatatcattgatagtctgttaacaggaccccgtaaaaatgactatagtcctctttgttgggcactatcctctttcatatcatccggtgtgcttgtggcccatcacagatgacccgtgttgggccgcatatttagcctgccacaggtaacgggtacggcggtgaggaccaatcttcaacgtggatttttttcggtctgtcaccagtgagcacatctgtgatggccgttcacgatgcaaagttagtatctaatgaactcatatgtatgcaaagttaaataaattatccagattaactacacatctattggtgtcactatcactagggaagtgctgacacatgttgatatctgttagatcatcattaagtgcttgcagttaaactcatcagaaaatgaaaatgttaacagagataatagagtctgggccaactgttgacagacaccaaccctgggccaacataaacagagagcctcgccttttctattcctgtaaactgcaagtgagcatgtagtagtaataacagagaatcaaagcagtggttgtatcaaaacttacggtaaacaacctcatcttttcgcttatgcttttgtttatcagccaaaatttaaatttttaaccttaaatttagagttgattttggagttttttcatcgaagtttattttccagccttcgctttaagaccctaagaacacgcatataaaagttttatttacaaattatttttcgttggtaaatatgcccgaataagtgaaacgatgggacgtttttctccaccatatcgaatcgtaatgatgaccactcagggctgaggtacatactagctagtaatagttattcactcgagacgtaatgctatctataaataaagacactcgatcgaattttcatggcgtgccactttgagagctgttagtctcctactggtgcagtactccttttaggaggtaaaaatcgatgtagtctcctcctagctcgctctgctaactaggtatgggaggcactggaaactattcagccgcctcggatccctttgctgggtgattctatgcttaactacgatcgaactagcaatttcagcggcagtgcagcgagttcgattgccactgtttttcctatacgaagccggtggatcaccgtcttgctcaagcatcgtgcaccagaggccctccgctgcaacacgatgcagccttcaagtgatccggtcgttagctatgacgagcacacaccgcaagcacgctacgtcgctacgacgatgcccaggatatgtaagccctagcattggctcggcgacgagttttctcaaatgtacactgccctggcatgtcgagcttagttggggattgctcaacttaacgattattgtttttggccactgctgagatgaaagcttcaacaatattttaatatacttagtagaagtgtgcttgttaattagcatcaaaagagaccaccgtctggatgcaacataaacatgaatcctcatggaaatatattttagatagttttgatacaaagctattgaatctaataactgccttatgttatgttgggttggtgctactatatcaagtcagtaaattggaggccatctaaaaaatggagtagaaaattaaaacagagcagcaaaaggaaaataaattactctaaatctaacccaccccacttcgtagctagcaaaggtttcatttcataccaaaccctctggttttgtagtaatctctatattatgtctaattgcattgacagtttttgaaacgaaccaaacgttcatcggttctggcccattttcttttaaccaggtctacagtcccacattttgtcctaccgttcacaacactatacaagcatatatatacatatatatatatgtatgtatgtatgtatgtatgtatgtatgtatgtatgtatgcttgtatagtgttgtatatgagagagagagagagagagagagagagagagcaacacaaggacaataatgagagcagctcatgcatagcagaaggcaaggaataacctggcaagcagatgccaacaatttgcttctcaaactaacaatgcgtattaggtttgagagccagcaggatctcccttacaccctatctgttccatataccgtgatagaagaaccaagtgagttccaagaaaggcacaaatacaaccagtgccttccaacttgtagagatctagacaaccaagtttttctccttcggccaaccaagtggccttctgttatatatgctcctcgatcaacaacgtcacaagttcaagcttatctcagaccacatacgggttatgttccaacttcaccaatcgccaaatggtatagcaggtgagatgattcctcacatctaaggccctgtttgtttcagcttaagattattgtaatctagattataaaactagattactataagctggattataataagccgatatagaataagctgctagctgtttgtttctctggattattatctgtttgttagttgttagccacccaataatctaaaataagcacctttagagtggcttaccagattatagtaatctggcttatagattataataatttatcataataagctatctgtttgtttcagcttactcctaataatccagattataataatcctaagctgaatcaaacagggcctaaggacataattgttttcaatagctcttaaagcggtcaatcgacatgatttgtatggaagagataaaaaaaaatcagaatttaggggcatacaagggtgtgagaaaaaaaatcataaacacataaggtattggttcaaaattcaggctgctgcaagggattttctctcaataaaggcctgatatgcctaccatgcgtgttaaacaagttccagaataagattacaaatcttgcggtgtcatcaaatggtaaggtgctgacatatgttgatatatgttagatcatcattaagtacttgtagttaatcaggttttgagtagttgtagttaatctggttttgatctgtgtgatgttccaactttgttgttcatgtgcaggtgttgcttgagaccatgagagtatagtcggtgatggatagagattgggcttaggagaagttgaggtctacgcgaggcgctcaggcttgaaaacaatgcatgtggaggtgaagttttttttatggcatacacatggtgttgtgtgcatatggaaagataagtgaagtttggattagagtccaaatttgaaaagtttggagtgcggagttgtatgggatgctgtttccctgatttggtaggttttctatgtgattaggtgtcctagttttgcttggattcgtggctaggagcaaccatgttatgggtaatagaagagggattgaggctaaaagtacatttaccttttgggagaaaaattttagggtttgttttaaggtttcaatcttagtttgtgagttgagagagtagtgctttagatgcactttttaacaatctcgacaagttcagaattatgggttgatttatgaagatctcatcttgtttctcgtgatctagatgcccggccgggcaattgcagttattgttacctccatgtaggaaggaacttgtagccttgtattttaaatcctcaattgcctcttgaactaaaacatttttaattatgttaatctggaaagttcaatacagaatacttaattaatttggttatatattcagttaatctgaagataaactggattgcattgcttatttcctgcaatttccgatgataagttgatcaagtgtgctctgtggagagattacagtctctgcatatgtttcccttcattattattgctggctggggttgggcattatcttgctacgaatcacctagtaactgtgggagaaaacatgaaggaatgcttggtgtactgtagggcttcgggaagaagaatcaaatgcatggtattgtgtttcatggcgaggtattgtgtttaatggccatgtgtgcaaagggatagaaagatctacaaccagggcttttcatcgagacaatttaattgcttagtgatctccagaaaaacaggcaattcaatacctttttttttggatggaaagacaattcaattccttagatctccactctccaggagtttatccaccacaaatccacataatgcgtctctgcaattagatcaaagcagaaattgtgaatcatccaggcaaatcaatccctagtgatacaccttataacaataaagacattgcttgtgatatacattagccattgggaatatatgttgttggagacattggccgtaccgaacctatctgtacagtcgtcacaattagtttggtccaaattaagtcagatgtacatgttaatcaggtgaagctttttttgcatttctgatcagatagctttcaagacgctggattatattcccttttgtttcatattataagttgtctggtttttttttctaattaaactttattaagtttgactaagtttataaaaaaattagtaacattgaatatattttgataatatattttttggtggaaaatactactatatttttctataaatttggttaaacttaaagaaataggactaagacttataataaaagagatagagtattaaattagcaacgacagttcatgcgaattggaacatatctgattctttgagacggaacgagagcgatcgaagatatattccatgtattatgctatctagttgtacactctttaaatctagtactagcataattgtatttgtcaaagaaaaatagctattctaatttttgagaagataaatatctcattacttttcagaccttcgaaagcattgcacaatactaacttgcaatattcagtaaaaaaaaaggagaattggttggcagttttgattcaaatttttttgtatgattcacctggttttactttttctgccttgagagggtaagttattttttgtttcttttcataccattgcagtataaatataattttggtttggatctgttctcaagattagactcgcatgggattgcttgggggttaagccgaaatatcttatgccattcgagttttctgtcgtacacggaaactatgtatgtatctgtactatttaaaaaatataaatgtaataattgttagtgaatcatgatgtaggctataactttatagtaagagtcattggagggagaggcaagtcataatagctgttgcacaagtagttctaacaatgtacatatgtagggccaaggccataaaaaagggagaatgccccaaatctatctaccgatccatcgggctgctgattggtactagtgtactattgctctctcttttcctctaacaatacataatatagcaagctttaaaataacttttctcataaactatttatccaatctacgatcctattacaccattgtatttgttataattaaatctttataacaagatattgtatggttatattatgacgaaagaaaaatatatgtttcaatccattaacactctttgttttaaacgtgatagtgatatgtttcaatatgtgtcttcactatgtttaacaaaattccaaaactaactgccattactctctctccattctctccacctcatccatgcatgcatgcattttagcgcgcttcaaaacgatttttctcctaaaatagttatccaatcaatgacccgatcacaccgttgtattcgttttaattaaatctttacaacaagatatcacatggttatattttgataaaataaaatcatatatatcaatccgttaatattagttgtttcatatgtgatagcgacatgttttaacgtgtcatcatgtttcataaaatttttaaatgttacagttgttggttttttttgtttcaccatatataactttgatgcttcactcgttggtcaactgaaacatttgactgtcccatctttttagtggcatcgggtgcccgatgagaagattcttcccataaaaaggcaagcaaagatagagcatcgaaaggtagacaaaaatcttgactaaactcgaaaccctaactaaactcacaactcaatgatctcaaaagcgataccgggaagcctcacgctccctctctagttatacatgaggtagccagcctaaagccatgaatcaaactcatactagaagtcctaatccacctaggaaaccttctcgtacaagaaacaaactttacaaactccaatcataacaaatttggactcctttcaaattcgactccacatcccatacgcacataatacctccatcgtatgccatatggaatctgcaccaaccatgtgcattgaactctagcctaagtatcccgcatgatatctgactgtcacggacatctccttatccccaagttgactcccgatccatcaccggcaatactctcccgaggcatcaagtcacctacacatgaatcaaacaaagaaactatattccgagactaagctatctccaacttgactcattagtagcaaacaacagtattacatacgcatagtatccatctagaagccataaatataaaacaatcacagatatccaaacaaacaaccgaaaattgaaaccgacacagtgtcggccggtcagaccgcgggctgagccggtctgactgcttgatcaccgtcggtctgaccagcaaccacagcccagtctgaccggaccaaaactcagcagcagctcttgttcacttgcaaatccaattatctccaaaaaccacttcgccaataatctccaaatatcaaaaccaataatgtcagatgccaattgttcatcacagaataataatcaaaaacatctttgattttacatgggaggcatcggaagccacggatccctctgctgggtgatgctatgcttaacgagcatcccgcattgtgtatagcaggtaatctcagaggcagcatagcagatctgattgccattgtgtatttcccactgcccgcttgcatctctactccctagagttgatgcagctgccatctccagcttagttggattgctgaggttaagtaggtttttttttggccacagctaagcttaaggcttcattaaatatttcactataaatataattaggagaacttgtttgttggcagcaaagagattacatgcagtctggataagtttgtttggagttctagtcacaggatcttaatttagcctatacataatcacctttctaatttggaaaatttaatttactgatctgcttgagaagcaatcggtgtcaacttctttgattctcttttcttattttcttcttctggttgcgcaagctctctcttcttatagtcgccggcaccttgctaggtcaccacggtctctgggtctccactagcactgccctaaggcagcctcacgaaccacttccagtgtttagctgatcagcagcgtttagggttttaggttttagcgcaaagagattgagcatcctctgtcctttgctttatttctttatatatggtactggtggggcacgggagccatatctccaattaggattcaaaattgattttaccgatcacaaaaccaatctatctcttatttgttttcttgttagaatcaaactgtgggatcacccttttctaacttactggacttagccgataaatcaaccaacaatgacataaacatagaccatggtggaaatatgttttagatagttttctatgtggtgctactatatcaagcaagtaaattggaggccatctcaaaaaaggaatatatatcagaaaattaaaacagagaaataaaaggcaaataaatattacaaaccccacttcacattaaatatttcattccataccaaatcgcctgctttcatagtaatctccatgttgtgtccatttgcattgatagtttttaaaatgaaccaaatgttcagcaattctggctcattttctttcaacaagctctacggtcccatattttgtactgctattgacaacactagaagtctcgaacagtctatataaacgagcataagagaaagagagagaaaccaacgcaaggatgagaacgggagcagctcagacatagcagaagccaaggaataacctgccaagcatacgacaaaaatttgctcctaaaaaaacttacatgcatattaggtctaagaggcatcaggagctccattacaccctacctgttccatgtaccgtgaaataaaaaccaagggagtgccaggagaagcacaaatacaacctggcccttctagttcgatgagagctaagctgccacgtttttctccttcagccaactaaatggacttccttgatcaacaacatcgcaaattcaagcatatcaggtcgcatatgagttatgtcccaacttccaattgcgaaatggtatagtaggtgagatgatacctctagcaaaggatcgaggaatggcagcagattactttaggcttcaatatcttaatctctgtcccctgtaactggataagttttttcaaatttgcttttagcgatcaatctcttcctaaattttactcgtgtactaatggtcaagaggaggcaaaggcttagagcattgtaacaaatacgtaggtaagcaaaatatcagagcaccttgtagtcaagcatcggccatacgtccttcctcttttcaacttatttattgaaataatgtaatggattaattgctccacgcttcgcaaaatacatttttgaaaaaaaaaaacctttgtcaattgcattgcttagacaacttattttaagttattaatttattaaaatttgataacatatttaatccatccctataatcaagtaaataaccagtgaaaataatcttgacaacaatctaattcaagcagggctggtcatgtttacacgcttaccaagctcttaaataatgcatttgatgcaaatattttctatatataattttcctgatatactttttaaagtaacttttcataccaaacaaacatgtgatgtcgctcattcacctttatttgttaatttgatgacttaatgcactaaccatctggctcatgccattacatgtgcatagatgcattgtgtttgcatatagaatatatttaaaaagtgcctagatgttgacacaaaacaacaacaaaatacaaggcactgtgcctcagctgtttgactaatgcactattctcgctagagttttggttgcacacattttctgtaggttgatttccttcgtgatttccccatatctcttatgcaaataacataaacaagcataggagcaagtgaataagtagatctactgtcaccccattcgcatgttgtagtggcaagcacaaggaagttagaaagcaggcaacttttatcatacacacaagcatgcaacttcagtaatagccatcgctagccgtggtgggatggcacacttagatgatctgtggcgagaaagtggaaaatcctatggtggatgcggtgagccttagtgaaggtggaggaagtagggtgaagtcggcgagccacaaatctagtggggaaaggaggcgagtaagacgaaaaactacattggtgctagccatttcggcttccaactggcgaacacaagacaatactcgaccactactagacttaaagatttcaactacttggatccaactttttaatatgtgaatatgtttacataggcagatgtctttagaaaccgcatgtgagaacggtttacacatgtgcttgcctttgaaaatatgtgtaggtaaaggtgaggacctacttgtcccgtggatagttcaatataattacatagacgtacaacctaactaactgcatgtaaaaatgtttttcacaagcggctgtctgaagatgccatcagtgataacaattgttattctttttttgaaaattaatagaaaacctataggaacttgattgaaaggctccaattctcatgccggtcaaaagcgcctaataaagttatgttccattatgggaaatactaatagtaaaattattactaatgtgttctaattcctgtgcttctctattttttttcttgaacataatatagactcatctactaccaatttattatggggtaccccaacacttgttcatatcctttcactcttgatctacgtagaaccatacttatgactttcatcacaacaaccaatattagtgttctttttttttaaaacacatcaactttgttaagcaagagcagaattaggggataaaccccattacataaccaaggataaaagctgaaagcaaaagagccacccctgagaagggagggttaactgaactacgaaatcaatcttcctgaaataacctaatagcagaaaaaggagcaagtcgatagggatctccggcgaagccgcgacgactgctaccctgggcctcaaaaaatgtgcactccgcttgacaaaccgttaatccccatcagctgcctccacggaaccggcacaagaccgaggtttgttgctgagccgtagattttggtgtgtgcatcactggactcagcgaaggatccccacgaggctcatcattgaatctgaggagctctaacatcaaccctgtcaactgaaattgcgcagatggttcgagctcaacccgaatgacaaacccagcatggtttcttctgttagggaacaacaggaagggtgaatccgaagagcagccaaccttcaacgatggagcacttgaatggctgcaaatcaacttgtcttgctgagatgatggagatggttgaggaagagatggcctgcaccatgaaactggaagcaacgagaaagggtgagctgcaactggaagcaacgacgcaggagacggccctcgcgccgccaccgtcgtcgggggccgcgtccgcgccgcagccgccgctgaggactggatccgtgctgccgccgtcgccacgggccgcgtccgcgccgtcgccgtcacgtcgggccgcaaccacatcgtcgccgccgccgcggacctgatccgcgccgccgctgccaccgcggactggatccgcaccgccgccgtcacatcgggccgcaaccacgtcgtcgccgccgccgcggaactgatccgcgccgccgctgccgccacggactggatctgcgcggccgccgtcgcctcgggtcgtatccgcgtcgccatcgcagttgcgagcagtaacctcgtcgcctccaccgtcgctggtcacaatcgcgtcgccgccgccatctccaacttccatcgcctcactaacgagaagaaaacgggaagaacccgacctaacgagactagcccgactacgtaactactatgggggagggggcacgacccctctccctcccgccgccggcgacgaggtcgccggaatcgaggaggaagaggggtcgagggtggggaatttactgtagcaagaaagggttcgagaggttcggtctcgtgtagatctgagcttatattagtgttctacactttggtataactgatcgactagcaacaaccacactgtactgtatgcgtctgaactctctaatttcttggaagaaagttacaagcagtagaaatgggaggcaacaggatatgtactaccaccatctcaccagcacactgcactgggtcgagcactttgggagaaacatctgatgtggtcttcacgtgatagcagtgatgtcgaatgctttaacaagttatagcggatagcattccatcagactcaagcacaggaacataagtgcaaatcaagtagaaagctctttgttgaaaaaaaaactagtcacaacaaatcgatcataagttaaggaaggaactaagtttcagagattgtgtctgatacaatgaattcaatatttcttgatatgaccaataatatagaataaaatcaaggactgacgaagttttgtaaactcagtatatggactttttattaatttctgtctctgctatatgtatcaacttgatttgataaaaaaaaaagcaatgtttggaacttggaagttctaattgcctcaatgactatatcctagaaaatagttttgtgctctcaacattgaattgtgagtccttttatccatacctatatttcgaggtttgttgtagttaactgtttaatgtcatacacaaatccctatatatccaacattaacgtcgacttccatgtcaaacacataattgatcttttttaagaactattaagcagtcaactgcaaaacgtaactggtataaatgagatcaaaatcaaaatatatgggcatagaagtaagtgagaaaaactcagacacacaatggatcaactgaaaaattaccactagtggggaactggtcatttatgtcaggcgataaccctcaactgtgtcgacggagggcatggtcactggtgagtggtcattgatgagcagatatttgctcctctaaccctcccacccaaagtaggaacaatacgctgggttgtgataactatttcagttgacagtcagttaacaggactccgtaaaaatgactatagtcctctttgatgggcactatcctctttgatatcatccggtgtgcttgtggcccgtcacagatgacctgtgtcgggccacatatgtagcctgccacaggcgatgtgtacggcattgaggaccaatcttcaacgtggatttttttgttctctccggtgagcgcatctgtgatggcccgttcacggtgcaaagttcatatctaatgaactcatatgtatgcaaagttaaacaaattatccagattaactacaaatctattccattatcactagggaagtgctgacatatgttgatatatgttagatcatcattaagtctttgcagttaaactcatcagaaaatgaaaacgttaacggagataatagagtctgggccaaccctgggccaacataaacagaaagcctcgccttttatattcctgtaaactgcaagtgagcatgtagtagtaataacagagaatcaaagcagtggttgtatcaaaacttacggtttgccaccagaaacgacatcatcttttctcttatgcttatgcttatcagccaaaatttgaattttcagctttaaatttggagttgattttagggtttttttcatcgaagtttatttttcagcctttgcttttagatcactaagaatacgtatataaaagttttatttacaaattatttttcatttgtaaatatgttgttttgcttattccacgaataagcgaaacgatgggaccgtttttctccaccatatcgaatcgtaatgatgaccactcagggctgaggtactccctccgtcccataatagaaaagattttgggtggatgtgacacatcctagtataatgaatctggacacctgtcacatccacataaaattccttatattatggaacggagggagtacgtatgtccggatctattatactaggatgtgtcacatccacataaaatcccttatattatgggacggagggaatacatactagtaatagttattcactcgagatgaagtgatatctataaataaaaacactcgaatttgcattgcatgacacttttagagctgttagtgcacataaacctggtgctgtccttttgggaggcaaaaatcgatgtagtctcctactagatcgcttgtaggtatgggaggcactggaaaccattcagccgcctcggattcctctgttgggtgattctatgcttaacgaccatcgaactagcaatctccgaggcagtgcagcgagtccgattgccactgtttttcccatacgaagccggtgcatcaccctcgtgctcaagcatcgtgcaccagaggccctccgctgcaacacgcgatgcagcgttcaagcgatcaagcacacgctgcaatgccccaggagatgccctagcattggctcggcgcggcgttttctctcatgtgcccactgccctggattgtcgatcagcttagttggacttctcagcttaaggattgttttagccgccactgctgagctgaaggcttcaacaaaattttaatatgcttagtacaagtgtggttgttagcatcaaaagaaaccactgtttgggaacgacataaacttttagatagttttgatacaaagctattgaacctaacaaactgctttatacgtggttctactatatcaagtgagtaaattggaggccatctcaagaaacggaatagaaaattaaaattaaacagtgcagcagaaggcaaataaattactctaaatttgactaaccccacttcgtagctagcaaaggtttcatttcataccaaaccctctggttttatagtaatctctatgttatgtctaattgcattgacagtttttgaaatgaaccaaacgttcatcggttcaggcccattttcttttaaccaggtctacagtc

SEQ ID NO: 35141 - DNA, 20978 bp, Oryza sativa
  unsure (1)..(20978): unsure at all n locations
cgcgcagcacaactacacaaggacgagaacgagagcagctcatgcatagcagaagccaaggaataacctggcaagcagacgccaacaatttggttctgaaactaacaatgcgtgttaggtttgagagccatcaggatctcccttacaccctgcctgttccatataccgtgatagaagaaccaagtgagttccaggagaggcacaaatacaaccagtgccttccaacttgcagagatctagacaaccaagtttttctccttcggccaaccaagtggccttctgttatatatgctcctcgatcaacaacatcacaaattcaagcttatcagatcgcatacgggttatgttccaacttcaccaatcgccaaatggtatagcaggtgagatgattcgtcacgtcttaggacataattgttctcagtaaatcttaaagtggtcaatcgacatgatttgtatggaagagataaaaatcataattcagggccatacaagggtgtgagaaaaaaacataaatacaaaaggtattggttcaaaattcaggagcatgaaaggaattttctctcaatgtaggcctgatatgcctaccatgttaaacaaattctagaataagattacaaatctagcggtgtcattatcaaatgggaaggtgctgacatatgttgatatctgttagatcatcattaagtacttgcagttaatctggttttgattcgtgcgatgtttccaacatacatatagagccttaccttttatattcctctaaactagaagtctacaagcagtagtaataaaattggtgtgggttctcaacacaagaattcttactcaatataatcatatagtcatagtactgcagttaaaaccaaattagtggtagtatcaacacactgtagaatcatgtgatgattaattctcaaagatgagtgtttattgaaaatactgtgaatagtgttttcggattatgaatggttttgtcagctttgtgaggccagtcatacctggcaggtgccgtcggtcagaccagtggtgctagagcggtttgaccgggtagccggacggtcagactgacataccccggtttggagtgatcggttttggcttgtttctgtggaatttctagattgcttcatgtttatgatttctagatgctttctattcgtatgtaatactattttgtgctgatgtgagtcaagttggtgcaaacttgtactcggatatacagtttcttggttgttcatatgcgggtgttgcttgagaccataggcatgtgtgcaaagggatagaaatatctacaaccagggcttttcttcgagacaattcaattgcttagagatctccagaacaacaggcaattcactaccttttttttggatgaaaagacaattcaattccttagatctctaggagtttatccaccacaattaatccacataatgcgtctctgcaattagatcgaagaagaaattgtgaatcatccaggcaaaatcaatccctagagatagaccttataacaataaagacattgcttgtgatatacattagtccccattgggaatatatgttgttggagacattggctgtcgcgaacctatctgtacagttcgtcacaattagtttggtcgcaaattaagtcagatgcacatgttaatcaggtgaagcttcatttgcattatttctgatcagattgctttcaagatgctggattataccccctttgtttcatattataagttgtttaactttttttctagtcaaacttaataaagtttggtcaaacttaataaagtttgactatgtttataaaaaaaattagtaacatctaaaatatcaattagtttcactaaatctaatagtgagtatattttgataatatattttttgttaaaaatattactatatttttctataaatttggtcaaacttaaagaagtatgattaagaaaaaaattgaaccacataatataaaacagagagagtattaaagtagcagcacagttcatacaaattggagaaggggacaattacacctatgcccccactttgaactctaattaatgttttactctcacattttaggctttgcatttttgctctctctttatgaaaacgaaccaattgtttgccctcacttttgacgtctagtttaacggtgttagttttaaaacaaaaggacattgatatccttagttgttgttgcttttttgctcaacttttagactagccgcaccggaagcccctgcagctcctgccttcgctgcgccggaagcctcctcatcgcctgcctcgctgcgttggaagccccatggccgccacctgccatcgccgtgcaagggagtgggaagcctgcgactacccacctgactcaccgtgcaagggagatcggggatccggttttaccagaacaacacaaagtcacaccgtgcaagggagatcggggatccggttttaccagaacaacacaaagtcacagagcatattgcatactgatcagaatatcatatcactcatctccgataccaaatgcgcccacataaatcttacaatgctatctacacaaatgaaggaacatagcatagacaactacggggagaaactatcctgcaagacacgcgacgggttaagcgaggatgagcagagcaactgctcgatcagggagggatcggaggggacgctatgtggacaccccgagtattataccatccagtgtccaacacgaccaccacatactgttggaggagtgggatccaaacacgcataaaaaagccactcgtcctcaatgtgtccatgatcacggttgacaccttctgctataataaccggaatgccgagtagtgatcgcaagagataaccataagataacttgccaggctactccgtcatatgcccgtcaaccacacgaaggcggcgaccagaaaacaaggcataccccagtgcctcgatccaaagcgctatctccaattatctcaagcgatcaaaacccgttactcgtgctcagctagtccccaggaatacgactaacctcacacattcattgcaagcaattggaacatcatcacaagtgcataaaaaggggttaagtatagcaagtatttggtacagaatagggtccgaggtcccatctaacagcaaacaagtagcagcggaagattcaaacaaaagccaaaagcacaaaacaaaagccggtggtgccacaacccacaagggcaaatcaaccgggcaagagccaagctgaaggtagcagaagatcaatccctgccctcgccgccccaacatcccggcctagggcttaataggattaatagaatattcatatcaacaagttgcaacttcttttccggaagccgatctccaaaaaaactccagggttaagcgtgcttggcctggagcaatttgggatgggtgaccgaccgggaaattcttcccgtcctcacgcatgtgtcttgccacgcaagtgaggacaaagtgtgcagaaaacacatgtgtcttgcccttgagcatgtcgaagaccttgcgacaggtgatgtcgaagaggtctttgatgtcgaggaagtgggtagtgaggacttgagcatgtcgaagaccttgcgacaggtgatgtcgaagaggtctttgatgtcgaggaagtgggcagtgaggaggtggtcatggacgggcttcacctagatgttgatgaacccttgccataagggagcgggaatcccgcggctgccacctgcctcaccgcgcaagggagggaagcacggccgtcgcgcacacaggagacctgtcgtcgactcgcgctcgactaccatcgccgcgcacacatcgccgcacttctcgatggaaccgtcgtgcacgccggatgtgccaccatcactgtgcttcctgccggaactgtcgccgtcgccgcgcatgtcagaaccgccgtcgtcgccgcacacgctgaaaccgtcgcccgtcgccgcctcaacatgactgagctcgtgttaatgaccaaatttggtaagatatgaaccagattcggcattggaatcagagtggattcggcaaagagttagattcgaagaacagagtatgcatcggctggagtctgcatcggctgagatggatcggatagaggacagccgatacagccgattctgatgagacagttgttaaattgtttctagaatcgatcaacgtgctacacgaggattgctgtgatggagataagctctcagataggcaatttgtacctattaattaggatattttaaatagtttccttagagatatgtttgggcaaaagtctgccgttaagacttatgtgtatcttagagtttgttagagataagagtcgtgtcctgcaaagacctatcatctatctcggctataaatataacacgaacccatgtaatttacaacaacagtttaataacgctttcggtgcatcgccacccttttctactttcgttctatttcgacgagttcttgccttcgggttgagctgcatcggtctcgatcttcaactagaggtaaacttgtcatggcggactgtgttctcaggattagtgcttccatcattatgatactctaatcttgcttatgtaattcgtcgagttatcatataagctctatagtcttcattagttgcgctatctgattaagcaattagctggtttctactattagggagtagccaacaaggttagatcttgttattagtctagattatatagcatatctaccatctcttagaggttttcatcatcttgcctagatcttatatttatctttatgcctaatgctgcatcggttgagttcaatctattaagtaatatccataactataatatttagcttgttagcttgttttatgattgtcgagagagatagcatcgtggtttcagccgatattatctggtttagctatcttattccttatatgcttgactgttatactaaatcgaccctttatattaagatcttattgcattagaatatactagtcttcttgtttgatatattttgcttgttttaatatcttagtataaagtggtatcggcgtattagccgatacatgctagatctatctgatcggctatgctataaacgcctatataatcattgctttaatgtatctttctacttaagtgatttatactgtctcggcacggcgaccgatctatcccaatcacttagtttaaacatacatcgaaggaaagattatatatcgttaatatctatagccgatcgagtagatttagtcgtatcttattcattcattactgccgatcgattccaacatgacatcggctcgaggacaaatgatatgtcatcggcaactagccgatcggctattatttatggatttaactttggtttagttgtattttattcttgttaattgccggatcaaatcaacttgcacgctctcgaacctaaaagcaagattttggacctacacaagagttaagcagatcttctaggccagtgtgtgtttttcgcttcaacagctcggtgaaggaatgggcttgggtccttatccattcactcaagggtacaacagtaaattgatatttcataaatcctttttctaattacttttcagaccttcgaaagcattgcacaatactaacttacaatattcagttaaaaaaaaggagaattggttggcagttttgattcaaatttttgtatgattcacctggttttaatttttctaccgataaattattttttgtttcttttcataccattgcagtataaaaagaatttcggtttggatctattctcaaggttagacacgcatgggatttcttggggtttaagccgaaatatcttatgccattcgagttttctgtggtacagggaaactatatgtaatataaagctaaacagaatttctggtagaaaaatattagtaaaattgtattgtccattttgtgaaaaatactgaatagtaaaattattgatcactttggcaacactatatatctgaaatgcatctagggtgactacaacaattttggtgtgatatcctaactcaattaggatgtggtctatgtaattcatgagagctgtgtacgtatatttagtaccacattgctagtttagcaacggtgtaaccaacttacaagggtttgtccttccaaccataacacctctaggttaacgattttacacgaaacatagacgaaagtgtaagtggggttggaatgtgtaagtaggcccgcccattcgctgtgctaggctgcatggttatggagggcgggccattactcatggtatgagagcggtccctcacagttgtgcgtacgggtcagtgtgtgggcatatgtcgcatggtgcgtgtgggctctgtgagagacacatggcatgatgacatatggcgtcagcactggatgtattgtcggcacccggggatggaattcctgaatacctggagcatacaccgtactagtcccatgatcagtggctagcacacgcatcctcaacattgctatcacatccatacatcatacttgacatataaatagataaagtggttatcataacttagcgattgttgatggtccttaaatcataatatctgaccgtcaatacctgcatataatgaaataaaacatggtatccaacttagtggtaggtattattactaatcacttccactagtgttggtgaaatatgtgtatgcaggtaatttgaggagaaaacacatccgtcatgcgacaaaatgcacctctgcacattcaggacacgtttacacggattggaggccccataagtcaatgaaaaccatttagaattgggccaaaacatagtgcaggttattgggggcccattaagcaacttaccggccaaaggagagaccgggaggcgagtttttgggttcggccgaaccattcctggcgcctcccgccatctacttccacgtggacggcttggattcctcccctatggcggttgtagggtgttttggtcatttccgatacccctaaccgtcatttggagcctatataaggaggtcttcatctcacttcaagaacacacaattttgagctgaattagaatagactctattgtatcttttgtacgttagaataaggtatagagagtgaggggaagctctggaggagttcccggaagtttcgcgttcatccgacttctacctcgacgagtgtagcttcctaggaggaattctagaggagtactggagctgtcggtacactttgctccaggttcggagaaccttcttctataaactaagcatcagtgttcttttcttatgttatttaattacttagtctgagtaagatagatttccatctctacgggttcattgtttagtatttatactaagcgctctagtactaggactctggatagagaaggaagttcctgtaagtataagagtagtaattaataacttagacgtggtgtctaggttagagattacctttgtttattgtgtatcccatagatttgtcagaggtaggtggcaggtggtgacagccttgaattccgttctagtaatcctccacgttcggatacatcataaagctatagccggaaccgtattggcagaccagcaggggtcggtgcccgaagcaacagataggaaattatcttttaacttagcttacataattaaaatacatagaaagtcctctctagcctagcctatctacctatagttgttgtccttggatagtcttagccttaggtagattacacacgttccatgagttcgatatccttttgggggtcacccgaaggtgaagtgctacagcggtattccgtgcgcttgcggatttatctgtagtcgtaagaaataccaatagcgatgcaaagttcttacataatagttaggtcgactggccaaataaaagagtttaaacgcagcggaaaagataaatatacataagttcttcggtatgcccatctaccaaaccacacaggcaaccgactaggaatcaccctagaaagaaccatctcggaaactctggtacccgatgcaaagtaatcgtcactaggcacctcatatcctgcatcctagtctaaaaacaacaacaaaaggtgggtcaatacactaggtattggaagtcctacccaaaccttaggaaacctaggtctattgcaagttgagatcgatcaaggatggctcgatttataggcgagggaggagcgagaggcagatgcggaggttgttgtgatgcattcggcgtctcttgcgcgcgcaggctgtggtccgcagggaacatggcgggcagcaggcgtcggctttgcgcagggattgcagagggggtgcacgggtagtcagagggagccaggggtggtcggcctcgccttgtcgcttcgggcgtcggctttggcagggggcggcggcttcgggttggcgaggcgcactgcgaggccgactttgcaggcgggagacatggaggcaggggcgtcggctttgcagacaacagacgtaggtcggaggccttgcagacgaaggaagcaacggttgagttcgtagcgtctcgtcgctccgggcagagggcggcgccggttgggcgcggtggctacgagggcagcgctgggcgcggcagggcatcaggcagaggcggggcagaggcgagcgtcagctttgcacagccttgcagcgagattcgcgggcagaggaagaatgggcggcttggaggcgacgactttcggctcgcatcctatgtgttcgatggaatgcctgcaaggaaagagaggggaaagaggaagagagagagatggggtgctgggccactggcaggtggggtccagggtgcttgggcccactgatcagagaggtacagggatagggggaggtgaggaaaatttcttcccagggattttaagagagggctgagggtttgacgaattttttttggaatggctacattgctcaaaagcatgcgccatttttactggaagttactgtagtggtgaactccatttggtgaacttttgagatttttctcatgtgcagttattttttgaaaattcaaacaagtttccttctcttattccaatttaaattaattttggttgccttcatctttttaattgagatgcaaaagctgagttataactaattaaatttgttgtttattattctcatcattaatcttattacctttttttctctaatttaatttatatatgcaaaatgaaatgatgcatagaagatccaaaaacatccaaaacaaattttcaccacaataataaatgaattttttttcattatattgaatttccaagtttctacaatttgggttagttacatgtatggacgtgcactaagagggccatgttcctagacatttgcctatatgcatgtgaggctatatgcgtaagttcgactgacagggttgttgggtcctttaaggtgaggggggtgtacgtaacatcatgggccaatttggatatcgtctagaagacattgcttatggagaggttctgatataaattctagtaacaaatccttggttctttgggatagagtttgtcagctgaagtcttaaggaggtttaggagtaattgatctcagatttcagaataatgctttgtggatgaaaaatctccatcagatttataataggcatactgttcgtttggtaagtttgatatggtctacttactataatggcaaagtcccacatgctttgtctttaaaagatccttttggtggagagatgttttacaatttgtggacaattttagaggtttatcaaagtgcgcagcgggtgatggtgggacctgactgttttggaatgataaacttagatcaacactctatcccagggcacattcttttgcaagaaatcataaggactcagttcatcagacttccacaaaggatctgtctcaaatctttttgctcccaatgacagagtaggcttatcaacaatttcttgcaatgcaagctgcagatcctttggatcagctctcagatgactgccatatggtcttatgctagggttaatgatagattctcctctcagaaagattaagccataatctttatgcatatacaatctctaattatttaaattggatctcgaagagcaaatgtactatgaaagtcaaggtttttggttggcttcttttgattgatcgattaaatactcgagataagcttgatagaaagcattgtgcccctgatggaagtgatcttacttgtgtgatttgttcatccggagctagggaaactctgcaacatttgttcttccattgcactttcagttcgcaatgctaggcgcaatttggtttagtttgggacttatatttattctttgaagatatgttacaacatgcaagaggttcttattgatcatctcattttgtggagaagattttatatgcggcttggaatatttggaagcagcgaagtaattggctatatttttgataatgtgccatcctcagtctcctcttggatgacattctttaagaatgatctgtcgcttcttgttttttttttaaatgcagatgagagatcaacatttatttcctggttaaaccagttgtaaaactttttattttattttcttaatatataattttactttgggggaggggggttccctcacagtgctttccctcaaaaattaggatatggtctgtgtggctcataagagctggtctgtgtggttcatgagagctgtgtatgcatgtttagtaccacattgctagtttagtaagagtgaaacaacttataaggtcttgtatctccaaccatatcactcgcgggctaacccttctacacgaagcgaggacgaaagtgcaatggggtggtatgtgtaagtgggcctactcatcggttgagttgggctgtgagtttgtagagggcgggccattacatttggcatgccttgacgaggcagtttcgtcaagaatcagtgaaatttcgtcacaaggacataatcgcagaagatctgttcctctgtgttttttttcactagatccacttgtttcactcttaggccgaggttagttccaaaatttttctttaaatttctaacttttccatcacattaaaactttcctacacacacaaacttccaactattccatcacattatttcaatttcaaccaaacttccaattttggcgtaaactaaacacacccttaaaaaaatgaggatccagtagtgctttgtttgactcttactccaccagataaggattccaaagtggagtcctggcaaacagattctttgctcaaaatgtacacttacctacaaccatttatacctagacacttgttgggggttaggagtacacccctggcgcataataccctccaccttcagaggggagtgcagcgccaggaaggctagggcagaggccatgtggtcaaccatggggcctactacaagggatgcccaaaaagggtttcctatgccagcctttggcttcgaaagataatgcacaaggatagactacaacaggaaaactaagaccatgtttagatgggactaaaacttttaagtccctatcatatcgaatgtttggatactaattgtaaatattaaatgtagactattataaaacccatccataatcttggaataattcgtgagacgaatccattgagcttaattaatccatgattagcctatgtgatgctacagtaaacattctctaattatggattaattaggcttaaaaaatttatctcgtaaattagctttcatttatgtaattagttttgtaagtagtctatatttaatactctaaattagtgtctaaatatagggactaaagttaagtccctggatccaaacaccacctaactatcagtgtagttcgggatggggacgagcggacgacacaactcctaccactaaaaagggaggggccatgggtgtgtgccatcctttcaggggtgggctcatcgactggggctgcccccctttagttaggttgaaaatatacgattctgctcctggagggacccacaagtccgtggcttaaatataaggatgttgtgtaactccattaggtcataattgtaattttatttttgtaatttggggcctatcgttaacgacaaaatttggtaagattctttagtggattgggttaaggaaagagcacaatcaaccgatggaaacttatccatgagaccaagtttatgaaagaatcgtgaagactatggcatggcagcataattctatatattggttaggcttaatttagtagtttccttttatctttaggaaagtgtgtttagtgtcagataaggactttatgtttttcttttgtctttaggaaagtttttaggaaagtttcgttcttgtccaataagcacttatatctacccataggtataaatatgtacacccggggtcattataaactatctcacagatcgtcattataaactatctcacagatcaatacaactactcttgacgcatcgttaccagctttattgaggtttttacttatcatctgacggaacttggcacctgacatggggctgcatcggcttttgatctccggtgaagggtaagtcctacgttccgtcggcctaggcaattgtatctgctacgttggtgttgttcaaggctgcatcgctttgatctcttgcatcgctctggtttggttgatatattttcctacctatttattatatatcttagttaatctagtttggtagatcgatttacttgtatcggctgggatctgctttagggtttttgccggtatcggctaaatcgctttactagattagatttgctaatgtatccaccaccgtgaaaattagtcaaatacttgattttttagacttcatgcttcttaaaatagtttgtaatgcatcatccttagtcgtgctattagaatcataatggctagcctgtctttgattataataagggtttcatcgggatttcagccgatgagttatctggacattgcatcggcttactaggattgtatacaagttagttttagccgattgaaacaaaggtttcactaatcatctaattgtgtggattttatgacatcgaacctccagccgatgtatacttttaaccttcggatcaatatttattctatcatactaattttagccgattagtttctactggattatattattgttctattacattatcatcagccgattgtctttatattgttatctacattggtcatataaccgacatctcaaaaccttacggcatcggctggaactactctatcggcttgtcagccgatcagttatttgatctgttgtttacatatcttgtcaattgcaggatcaaactgactggcacatccgcatctcatcaatttttggacctacactggagctaagcatatctctcatgccgttgtgttcattgatttagtttgcgccaacacagttccggcaccatcggccgaacgcgaatttttcgtcaacacctatataaataggacgcatcctctgtttgattggggattggtatttttatgtctagtaaactacacttcacaactcagttgtgtctccaatcaagatcttcacgtatagtttgttggtacataatttgttcccagaacactcgttccttgggcacttctacatatcaccatccttacttcgaccataaaaccaacacccattgtgttgtaggtttctaggactctacacagtgcatgtgaacacttcaatttcttggaataaaaaatatgcagtagaaatgagaggcaacaggagaagtagtactacttccttggtggtgggtgttcttcaggagccgcttgtgttgcggttctggagaagtatcaatatcgatttcaagtaattttacctttctaccaaatctttctggccaaggaactaagacggtgtttgattgtgaaggttgggaaccttccccacccgtcacggaaaacagagaagcttattagcgcatgattaattaagtattagctaaaaaacctttaaaatgaattagtatgattttttaaaataaatttcccatagtcttttttgttgcaaaaaatacaatttagcagtttgggaaacatatgcgtgtgaaacaagggagtggaggttgggaatataaagaaacaaactcagcctaagagtacatgtgtacaaaaaagtaggaggaaaaaaaagaaccatgaacgaagcaacttacaggagctgataagattgtattgagtaaggtcttatccgtgtgaacaagataacatatataacagaataataacctttgacgttatctcgtgcccgcatcgctgctgaattagtacctcactctgataagctacaaggtgttgtataattattttctttccaagctgatgtttgtaagtctaaataatgctaagtatattcatcttgacaggtggttgtatgatgcccctttccatgctgactaacaactttaatcaacattataagtacaaggtcctacgtcgctacacacctttttaccttgcatctggctgccaagtaagctgcatcctataattttccagttgaaaagtttctgattttgggtgaaaatgtttgcatattgaattgactgttgttaatttttagtttttttagtctctctttgaatttgtttgaaattccacctgtagaaagtttctatatgtgcaaagtttatatatccaaaagttcatatgtgcaaagtttgtacatgcaaagtttctatcagcaaaaagtttatacatgcaaagtttctccataaatattggattaaaaaagctttattagttctacaaatttgtgcttagtaaaacttacagagcgaaaaattatggtttaggctagttttcaaggttagtcgaaagttgagagaggagcactattcttacactttgttaacacaattagagttaatgaagtttatcaattttcagagagttctttgatttgtgtttttgccgatctcggcggttaaaccgggaagaacccatgacattgaggcgatcgcctgattcagggggttgcggtggtgagctgggcggtcagactgatgactagggagcagtcagaccagatagcacttggcggtcatgttacagaataacttttaattccgttaaaagttttgctttttgtatttgtttcttgtgtctcatatcttataagtggtattagagtcacgtttagtcttttcgagctgaaaaaatattctttcaacccttttgttttctcccttgatttttctatcaaacgttttctatcacacgtttgatatcaaatccataattcaaattcaaatcatttagactatgtgatagaaacgttccaccggtttggttgtgaggaaacattcaaattattttgtatatattatcaaactatttcatgggtatagtaaacagttagtcattcatgagtatgaaatagaaagcttttcagaggataggactcaaactttttgataggcctaaatctggctgaagaagaatgctcatgacaggcctaaatgacctgcgcaagccactcatctatccttccagctccattatctcaaccagccgagcagcagtccccttgttcccctattcccttgcatccccaagcagctgccagtatggctggtcgtgatggtgatgggaaggacggatgaatgcagcgacagctgaaaggagaggggggaggggggagtgactaacggtgtaggtcgtggccgccgctgttgctgctgacaatgatgaaggcgtgatcgtatatgggaattagcaccgggcgatcacgttgttgcgcacgagggcatcgaaggaagaccaatccatccactggatttccaatgttttagccaatttatcttgaagagtctcgtgttacatcggaatgtagcactggatattttcgacttcaattcttcacggttgtgttgatctttcaacaattaaattttgatatttcttgtgtgaggccgaaatgtttcaaccgtgaattctccaatgtttcctgatggcgaaatattttctcccagtggtgaaaaaatgctcaaatttgggggaaaatatcgggcactcgatttgtagttgtgccctaggctgaaagtaaggttctgttcaagatccctctagagcagattgtttgatagacaagtcatgctgccatggtcgcaaatagtattacgcgtgcagagaacagcacaacacacttgcacatcatgttgtggagaaaatttcttctatggccctaaaatttttagctgatcctttacatgcccctcaattttctttgctctcttgtgtataccagaattttgattttaatcccttccatattcttatcatcaattgcctgttaataggtgcaaaagaagttggttttacccttaaatgtgcaaggaatatatagaaatttgttgaatctattgttggaaacgtactaatttgtttcatgacactataatgttcatatgtctttcaaatgagaagtatgatgcatagaaattataatatatattaaaaagtatatgtaacattttttaaatggtaaacattgttttgtacagcattccttatataagatataaaacaaggggactgatccgttgaagtaccatcataaaactatgctacatataaataaataaaatgtatattaactacttttgtcattatgtaaaagtaaactatgccgtgaataataccttgtacagtgaagtcatgaatataatagtcttataaaattaacgtacaaatccaacaatatactctacaaaattccatgtttcttttatgctaagggcgaaatgaacctatttataggaattaactggtcaactaatggtcaactaacagaatgggtatgaaattgatcaaaaccaattttttcaagggcatataagagagtaaacaaaactcggggagcatataagggattgcctaaactttcatgggcattgaaagcatttcctccattttgtatggacatgagggtgagttttgttctccttcatatatatttgcagcaccaaactagttataagttctagtacagcaaaatattttggtaggttagagttgcctcaactttattgattttgtaaaataaagctggattcaaatcagaatcctgacaaacaatattcaaaatagggtagagttgccttaactttattgattttgtaaaagttaggattcaaatcagaatcctgaccagcagtattgaagctggtataaatagttcgccttttatgtagctatgtggttgtcaaaatggcgaattggaggcgaagacatcctggtcgaaccttagaggattacgaccggtgccacatccagcgccgcgatgacattgccacactttggttagacttcgaaatgactaatcgtcaagttgttatcgcttgacgtcagtgtgtatttcgcttccttcccccttagagtcgtgtacagtattgatgacgaatcgtgttcgcgggacttagtaggggcggggcaaaaatgttctgaaacggatgatgtaattttttgctcctttgtataacacgtatgtgcttttgcccgatggagcttgtgcgtgtttttatgtttcttttcgctatcattgcattttgtaacttgtacgttcggaagggcgaggcgtgtcggcccccttgcatgttagcgaaaggaattcacattgacttttcagccctcatcattcgctctcgacttttggcatgtgcgtccagaaacgcttcagtatttgcataagtcgagtgtagcgacgatcgatatgttttccgaaaacgagctgtcgcggtttcaacgttcggcgagctgtgcttcggccgattcgtatcgcccccctggcgttttcgtcgatcaaacgtttgccttggggtttttccacgaaatatcatacacaaaaaaggcgaagacacccatgaattttaaatgactgagcgtcagtttgccattgcccagcgtcgacgcagcataatccccgtttttccttctttaccgctaattttttttttgtattgatctaacaacaagcgatgaagaagatgctcaagggggtagtccttcgccatttgaggactgcttttgttaatgaatcggatgtaaagtccgaatgccttttggcgggcaatggaatttatcagtaacttgtgctttttggcaaataaatggagtgtggtgcgtgttacggctgttcggctcgtactttgccctttttgcctttggcactggtatttttaggtactttgatcgttttgaccgttgccggctttcggtctttttagcacttcgacctttttaactgttaccggctttcggtcatttctttagtgctactagggttttgtcgtttgtccctttcggctgccccgtttgtctgcgggtgtgcaaccgatgcgaacttgatttcaagatttagcccctcgcacattttcttggacttctcggagtcaaaccgcttgttattgccggtaatgaactctttcggcacaccgaatcggcagaaaatgtttttccgaacagatttttatactagtgccgaaggtactgccttagcccatcgaaggcggcttgacactcaggtgtccaattgagtttgccggcccctcggagcatcttgaaaaatgataaatctctttcggttgctcttgggagcaactccttaacacattttcgcccctagtccttatcgccgtaccttgctggtactgtggcgaaaggcatgggtgtggcgaaacctgtttgcccgcagcccttggcgccataccttattggtactatggcgaagggcatggcgtgtggcaaaagctgttcacccgcagcccttgacgctataccttattggtattgtggtgaagggcatgggtatggcgaaaggctccagaggctagggtggcctcatagcccccgagcttggaagcaacatattttcgtccccagctcttgtcgccgtaccttgcgggtactgtggcgaagggtgtgggtgtggcgaaaggctccagaggctagggtggcctcgtagccccccagcttggaaacaacttattttcgcccccagcccttgacgccataccttattggtactatggcgaagggcgtcgatgggcgaaaccagttcgcccgcagcccttgacgccgtacctcattggcactatggcaaagggtatggcgtgtggcgaaacctcttcgccgcagcccttgacgccgtgccatattggcactatggcgaagggcgtgggttggcgaaacctgttcgcccgtagcccttgacgccgtgccttattggttcgatggcgaagggtatggcgtgtggcaaaacctcttcgcccgcagcccttgacgctgtgccatattggcactatggcgacgggcgtcggttggcgaaacctgttcgcccgcagccctagacgccgtgccttattggcactatggcgaagggcgtgggtggacgaaacctcttcgcccgaaacccttgacgccgtacctcattggttcgatggcaaagggcgtgggtggacgaaacctcttcgcccgcaacccttgacgccgtacctcattggttcgatggcgaagggtatggcgggttggcgaaacctgttcgcccgcagcccttaacgccgtgccatattggcactatggctaaggtcgtgggttggcgaaacctgttcgcccgtagcccttgaggccgtaccatattggtactatggcgaagggcgtgggtgggcgaaaccttttcgcccgcaacccttgacgccgtacctcattcgtactatggcgtagggtatggcgtgtggcgaaacctctttgcctgcagcccttgacgccgtgccatattggcactatggtgaagggcgagggttggcgaaaccgtatcgcccgcaacccttgacgccgtgccttattggtactatggcgaacagcgtggcgtgtggcgaaaggtgtatagaggcttgggcggcttcatagccccccagcttggacttaactcattttcgccccagcccatgtcgccgtgtcgcgcgggtactgtggcgaagggtgagggtgggacgaaaggctctagaggctagggtggcctcgtaggcctcccgcttggaagcaacttattttcgcccccaacccttgaggccataccttattggtactatggcgaagggtgtggcgtgtggcgaaacctcttcgcccgcaagcccttgacgccgtaccttattggtactatggcgaaggacgtgggtgtggcgaaacctgttcgcccgcagcatttgacgccataccatattggtactatggtgaagggcgtgggtgggcgaaacctattcgcccgcaacccttgacgccgtacctcattggtactatggcatagggtattgcgtgtggcgaaacctcttcgcccacagcccttgacgccgtgccatattggcactatggcgaagggcgtgggttggcgaaacatgttcgcccgcagcccttgacgctgtgccttattggtactatggcgaagggcgtggcgtgtggcgaaaggtgtccagcggcttgggcggcttcatagccccccagcttggaagcaacatattttcgcccccaacccttgacgccataccttattggtactatggcgaagggtgtgggtgggcgaaacctgttcgcccgcaacccttgacgccgtacctcattggtactatggcgaagggtatggcgtgtggcgaagcctcttcgcccgcagcccttgacgccgtgccatattggcactatggcgaagggcgtgggttggcgaaacatgttcgcccgcagcccttgacgttgtgccttattggtactatggcgaagggcgttgcgtgtggcgaaaggtgtccagcggcttgggcggcttcatagccccccagcttggaagcaacatattttcgcccccaacccttgacgccataccttattggtactatggcgaagggtgtgggtgggcgaaacctattcgcccgcaaccctttacgccgtacctcattggtactatggcgaagggtatggcgtgtggcgaagnnnnnnnnnnnnnnnnnnnnnnnnnnnnnnnnnnnnnnnnn

SEQ ID NO: 35142 - DNA, 1041 bp, Oryza sativa
gcccgcaacccttacgccgtacctcattggtattatggcgaagggtatggcgtgtgaaaagccttttcgcccgcagcccttgacgccgtgccatattggcactatggcgaagggcgtgggttggcgaaacatgttcgcccgcagcccttgacgttgtgccttattggtactatggcgaagggcgttgcgtgtggcgaaaggtgtccagcggcttgggcggcttcatagccccccagcttggaagcaacatattttcgcccccaacccttgacgccataccttattggtactatggcgaagggtgtaggtgggcgaaacatattcgcccgcaaccctttacgccgtacctcattggtactatggcgaagggtatggcgtgtggcgaaacctcttcgcccgcagcccttaacgccgtgccatattggcattatggcgaagggcgtgggttggggaaacctgttcgcccgcaacccttgatatcgtgcctcattggcgctatggcgaagggcgtgggtagacgaaacttattcgcccgcaacccttgatgccgtacctcattggtactatggcgaagggcgtgggtgggcgaaacctgttcacccgcaacccttgatgccgtacctcattggtactatggcgaagggtatggcgtgtggcgaaacctcttcgcccgcagcccttgacgccgtgccatattggcactatggcgaagggcgtgggttggcgaaacctgttggtccgcagcctttgatgccgtgccttattggtactatggcgaagggcgtggcgtgtggcgaaatgtgtcctgaggcttgggcggcttcgtagccccccagcttggacttaactcactttcgcccccagcccttgtcgccgtatcgcgcgggtactgtggcgaaggttgtgggtggggcgaaagtttatagaggctatggtggcctcgtatccccccagcttggaagcaacttatgttcgcccccaacccttgaggccataccttattggtactatggtgaagggtgtgacgtgtggcgaaacctc

SEQ ID NO: 35143 - DNA, 23826 bp, Oryza sativa
atgttcgcccccaacccttgaggccataccttattggtactatggcgaagggtgtgacgtgtggcgaaacctcttcgcccgcaagcccttgacgccgtaccttattggtactatggagaagggcgtgggtgtggcgaaacctgttcgcccgcagcccttgacgccgtaccatattggtactatggcgaagggcgtgggtgggcgaaacctgttcgcccgcacaccttgacgccgtacctcattggtactatggcgtagggtttggcgtgtggcgaaacctctttgcccgcagcccttgacgccgtgccatattggcactatggcgaagggcgtgggttggcgaaacctgttcgtccgcagcccttgacgccgtgccttattggtactatggggaagggcgtggcgtgtggcgaaaggtgtgcagaggcttgggtggcttcgtagccccctagcttagacttaaaccactttcatccccagcccttgtcgccgtaccacgcgggtactgtggcgaaggatgtgggtgtggcgaaaggctctagaggctagggtggtctcgtagcccccctgcttggaagcaacatattttcgcccccaacccttgacgccataccttattggtactatggcgaagggtgtgggtgggcgaaacctgttcgcccgcaaccctttacgccgtacctcattggtactatggcgaagggtatggcgtgtggcgaagcctcttcgcccgcagcccttaacgccgtgccatattggcattatggcgaagggcgtgggttggggaaacctgttcgcccgcagcccttgatgtcatgcctcattggcgctattgcgaagggcgtgggtagacgaaacttcttcgcccgcaacccttgatgccgtacctcattggtactatggcgaagggtatggcgtgtggcgaaacctctttgcccgcagcccttgacgccgtgccatattggcactatggcgaaggacgtgggttggcgaaatctgtgcgcccgcagcccttgatgccgtgccttattggcgctatggcgaagggcgagggtggacgaaacctcttcgcccgcatcccttgatgccgtacctcattggtcctatggcgaaaggcgtgggtgggcgaaacctgttcgcccgcaacccttgatgccgtacctcattggtattatggcgaagggtatggcgtatggcgaaacctcttcgcccgcagcacttgacgccgtgccatattggcactatggcgaagggcgtgggttggcgaaacctgttcgcccgtagcccttgacgccgtgccttattggtactatggcgaagggcgtggcgtgtggcgaaaggtgtacagaggcttgggtggctttgtagccccccagcttggacttaactcactttcgcccctagcccttgtcgccgtaccgcgcgggtactgtggcgaagggtgtgggtgtggcgaaaggctccagaggctagggtggcctcgtagccccccagcttggaagcaacttatttttgcccccaacccttgacgccataccttattggtactatggcgaagggtgtgggtgggcgaaacctgatcgcccgcaacccttgacgccgtacctcattggtactatggcgaagggtatggcgtgtggggaaacctctttgcccacagcccttgacgccatgccatattggcactatggcgaaggtcgtgggttggcgaaacctattcgctcgcagcccttgacgccgtgccttattggcactaaggcgaagggcgtgggtggacgaaacctcttagcccgcaacccttgacgccgtacctgattggtactatggcgaagggtatgggtgggcgaaacctgttcgcccgcaacccttgatgccgtgccatattggcactatggcgaagggtatggcgtgtggcgaaacctcttcgttcgcagcccttgacgccgtgccatattggcactatggcgaagggcgtgggttggcgaaacctgttggtccgcagcctttgatgccgtgccttattggtactatggcgaagggcgtggcgtgtggcgaaatgtgtcctgaggcttgggcggcttcgtagccccccagcttggacttaactcactttcgcccccagcccttgtcgccgtatcgcgcgggtactgtggcgaaggttgtgggtggggcgaaagtttatagaggctatggtggcctcgtatccccccagcttggaagcaacttatgttcgcccccaacccttgaggccataccttattggtactatggcgaagggtgtgacgtgtggcgaaacctcttcgcccgcaagcccttgacgccgtaccttattggtactatggagaagggcgtgggtgtggcgaaacctgttcccccgcagcccttgacgccgtaccatattggtactatggcgaagggtgtgggtgggcgaaacctgtttgcccgcaccccttgacgccgtacctcattggtactatggcgtagggtatggcgtgtggcgaaacctcttcgcccgcagcccttgacgccgtgccatattggcactatggcaaaggcgtgggttggcaaaacctgttcacccgcagcccttgacgccgtgccttattggtactatggcgaagggcgtggcgtgtggcgaaaggtgtccaaaggcttgggcggcttcgtagccccccagcttggacttaactcactttcgcccccagcccttgtcgccataccacgcgggtactgtggcgaagggtgtggtgaaaggggtcccatttcgccttttcggtctgggtcccccatggacggcgccagctgttgtcgaatggacaactatgccatgtcgaaaggcgtggttctctcaacagtagttggaatgtaaaagcaattgtattgattcgtgaaatattttttggggatcccccattacatggccctagaggtttatttatagccttagcacaagcttgcaccttctagggtttagggttacaggggattttagatggctgcccttatgaaagggacatttacatgggtatgcagtgtcatttgcacatatgggcctttaatgggctgataggctgggcctggtctatggcaaacgggcctaaaaggccgggggcggcctgttgggcctccttgatgccgaactcgtcatggcgaagtctttgtagttcacccgagataccttcgcccgagatgcctttactttcggaataccgacgcggctttccagccttcgccatcttcgcttatggctttcgccatagggcttcgcctgaatggccttgacgtctttggcttgaatccttgctggtactatagtttcggcaggtccgaccgaagggcttcatgacatgcctccaacaatatatattcttgtcagtaacattcgcatgtgcagtgtgttgtgttcatggatgtcatcgttacttccattcatttgggttgttaaggacatgcaatataatggtattagacgcatagtagattgtacgtactgatggtattacaagaaagcatgatagtggatgcgtgtgacaagcttgaaatggaaggcatcagggattcaggaagcacggtcatgttttgtgtgtcttcatcttactaaagctgcatgcatcctcagatagttagagcaacaagttactgttgtcagattgagtcggctgaattattgtggcatagcctatttgccttggagaaccaactggagcggatcttgtaatgaagggttcagttgtttgcttacttgagcacaactactgcaaaccaactattgtggtcattaatttttgctttacagtgaaaaccaataatttgcgttatgcacataacgtataaatggcatgcttgttttgtttctcatttcttttgtttaccttaaataaaacatgctgacataatgggttttgctagaatttgctctctagctacatcaattgtttctttcatctggagagataggcagaaactagaaacagagaaaatgaccaacaaacaacatactcccttcgtttctaaatatttgatgccggtgatttttttaaacaagtttgaccgttcatcttattcaaaaaaatttaaataactattaattcttttcctatcatttgattaattgttaaatatacttttatatatacatatagttttacatattttacaaaagtttttgaacaagacgaatggttaaatatgtgctaaaaagtcaatggtgccaaatatttagaaacggagggagtagtttttttccagctgcaacactatggatttttgtaattttcttcattgccatatagaggacaacaaaattgatttgtggccggtgagatctcatccgtgagcaacagaaatatacaagcaggtacttcaggaactataaaaaatttatctaagaatattcggagttatagaaagcgccaccacaaatcagatgagaaatcatggatacaaggaaaagtgcaaaacacgatggcactgatatgccatgcatctgtatgaacagcctcaattcgatccattggtcttgacgattggctaatgaaggctgatcgtaccaaactattctcaaattgaacccacataggtggggataatttacagtgcatcagaattcagaaatatcaggtcaataagtagcagtcaccttagctatccagtagccacactccaggcgcggaagttatagaggcagtggacatggtgctattagatcgagagagaataatgcacgcgagcacacatgcacaaacttggaatggaagacctcggggatttaactcacgcatcattagatcatgtattcacgccttgtaacgctcgagcagtgctcatccacaaaccattggattgagtcgccagctgtggagggctgttgagtgtgttcatcattgtcacgcccagaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattacagtctagcgaagctccggctccactcccacaggcaccgattgggtaacttgctggatgttaacttcattgctttccttagtctctgatttgatctcaccaccgatgttcaactgttgcgactgtccttgacttgcagaagaagatccaccaatttggagtggcttgatacgctgcctctggctactactttgtgcctcctggaaaacagtcattcttctcttacggttgtccatcctgttcttcttgtcttcaagtcgaattgctttgtcaaccagctgctgaaaatcaacatagtcatgtgagatcaacgtaactgacagttcatccttcaggccttccaagaacttctcctgcctttcctcgtcagtacgcacatcttctggagcataacgggccagacgattgaactcatgaagatactctgccacggtatgatccttttgcttcaatggcctgaactcacgcttcttcaaagcaacaactcctgcaggtatatgtgtcttattgaatccttttgtaaactcttcccaagtgattggttgtcctcctgctctgttcatccggaaatgatcccaccattctgaagcagatccttgcaactgatgtgaagcgaacacgactttctcctgatctgtgcactggagcaattccaacctcttctcaatagtgtgcaaccaatcacctgcttccactgggttggtagtgctagaaaaggtaggcggcctcacacgaagaaaatcagctagcttgttctgaggcggtggagcattgttgttcccttggttgagctggttctgcatctgttgcatcatcatgttcattaactaagtctattgagctagaacttgagccagagttgggttcccttcattgttattgtttccacttccactggcgcgagtgttcaccatctgttgcatattggagaagatggaagcagagaggttacactaaagacaagaccttaaccaggttaacactgatctgatgtgtgtagaccattatattgttcaagttgattaagcaagcaacccagtatagttacacgctcatcactgaacaacaccaatgatgggaatgcaaccatacctacacacaagcaagcaacaaacgttctaccctactaactgtccttcaaggatagtttggcggcataggttctaaggtaggatccaaacttcattccatcttgaccacttggcacttcggttcatcctcgatccacttgactgacctccataggttgaccacatcaacgtcttctagtttaaacaactagtttcagaactactcaagttgaaagcaggaggggagaggatgataaaatgatttatagagaattctagagaaggaagaaaggaaaattttcacaaatcatgttttcggaaaattagtccttaaggtttgaccatttggctcatcctacagtcaagatggctctgataccaacttgtcacgcccagaaattcactagtaatttccgaacttatttgtgcataaaatcttcgtccaggaatcagccgaggtacacaaactgacaatttaatatacaaatccatcataataataacgttacatacttacaaaagaaaagaaaacagcagcggaattacggtctagcgaagctccggctccactcccacaggcagctcaactggggtataagccaaacgtcttctcctttgcaacttgtcttcaattgaggtttgattgattattgcaaggtgagcatatgacatactcagcaagccacacaacaaatatgcaagtacacatggataccaaaggatagcataatatagggctcatttgcaaaagcagcatttagcaaacatttgagaattataaaacaatagagtaattaatcatcaatattaatcaacactgaacagcacacccatgctgcacaggcccaaccatcctgaacaaccatacccggctgcacagatctatctccaaaccaggagctaaacaaattattaccaattatatcatcatttattatggtgagaagtgtgagactaatcacgaaagacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcccggatcatagtcacccccttataaacaaggcatggactccccagcgaccctcgtgggcttatctccgccacttctcagtctggtgctccgcaatgaaccatgctatacaaaacgtaaagccgttgcccacgctggcttgtggttggcacggttaatgtttcacaaccgaaaatcgtgaaccggtccttaattgtcatgagcacgactctcaaaaccatgtgctcacaacccaccattatcaagttttagttggcaatttaattaattaaccaatcacgattgaccatcgtgaactatcattaagccatcattaaataatagtgaatcataagttatcccgattgtgtgctaatgtttctaagcatggctaagcaactatgtctaacatctagatgaaccaatatatataaagctcaactagtcaaattataatatcccaaggtatcaaggaatagaataatcaatgcaaacaggccataacaaaggaatagattcacaccacccagtaacattcgaaaataaatgcacagttgaaataaatagagaatttaaatataggatcaacatgctcaaaggaactgtgcttgggatctgtgtgacttgccttgcaataatcggtcttcaattaatcttcttgaacacttccggcgctctcacgaaccttcgaaacgacggaaacgacaagctaacacgcaaaacaaggaaaacagtaagaaactccaaataaacaatacatataaattcaacaaacatgtaaatcataattttagatgaattatgagacttgaacgacctcattctgacttcatatgaattaaatatgaattttacaagatttaatctaattaaagcccatttaaaaaggattaaataaatttaattctatttatggataattttaatatgtagatctttattttatacaactttagagacttgaaccaactaaatccgagctaagatgaattagttatgaattttcaaagattaaatcggattaaatcatttatatggatttttattgaattatgacgcaataatgaattatttttgaaaagaaaaagaggattattgcgtcagcggctcgggttcacggtggaccgggtgcacaggaacggtctacggaacggacggtctagatcaaccctatccacaacgaacggccgagatcgatccagaccacggcggtccacgagacacggcgacgatgacgtcggcgatgacgtcatcactggcgacggctcgggtggcacatgctcgccggcgaacgacggcgcggcggcgcgaacggagggcaccaacgggtagagggcgacgcggcgatccttaccgaggcatgaacggcggcggacggcgaccggacggtgatggctacgaggaagaagcggcgatgacggtcgggttgacgacgacggtggtctgccggcgatgacggaggggcggacgagattggtgacggcttggcgaccacggcggtaacctccccgagcggtgacgacgagcggagcgacggcggcgcacggctggacgaacggcggcgacggcggcgcacgggctcacgaggctagggtgctacaggcggcagcgggcaaaggcgagggtggcggcgagtagaggagacaccgggggtccttttataggggctagggggcggcggcgaaggcccacggcggtcggcggcgcgaaggaaagtctagggttcggggaagaaaatcgaatccggttcgatctcaaatccggcgatttccaaacgaaattagccgacgattccaaaagggaaaagatagagtggatcgcggggatcatttcccctctatcgattcggccggagatggaaaggagcgacggaatttggaagggcggcggcggcttgcgggtggctagggcacggctgcggcggcgtgaggttgacgacgaccctgacaggtggggccctcctgtcagcgggagagagagaggagagcggtggctcggttgcgggccggcttgggccggggaggaaagagagagggttttgggccgactttcagcccaaagccaaaagaggattttaaaacctttttcaattataattattcatgaaatgcaatttcatttattaaaaatacttccttggctcaaataaatcctagaaaaatctaggaactatagaaacaagagaagtatttaacaaaattttatctagcccacttttatattgagatttaacaaattaaaattagatcttctcttctaggcttttaagatcatttctaataattcccttttagacaacaatttataaattaaggattttaaacaagaaaagtacttaacataattataattagatcattaattgattactaattactgaactgttctttgtatcatttaggaattgagctctgagaaaaaatcagagaaaatttcagagagtataattaatcatggagaatttaataaaattaaatccaaccatgctttaaatttagaaaattttatttcccacatttaactttacttgaaaattaaagaacatttaatataaattctattattaatttattagataatttataaatcctgaaacgaaattcaggctgtgacatcatgcacatcctgccagcatggtactgcgaagaaggggttctagggcacacccctagttagtcatacgccctttgctatgtcttctaggtgcaccagctgtgaagcctacctacttattcgcttcctcggtgaatgaaacgttgtgtttgtagaaatgaattaatggtagccagctttcatcctctatgttatcaaaatattcatatgcaacaattagtgttataagcaacagtgttgttagtaatcacataaacccatgaatttcgagcagaggtattgccaaagaaaacatgctcccataacgctgtagttgaaatttgctcaccatttcatggattgattaggtttcaagtttcacctccacatacttgcgtgaattggcagcacaaaagatgaactaaaaaaccaccgatctttgtgttgaagcatttccggtttttcctattgccatttgaaaacaaaatcgatatggggccagtatgtcctaaattaatacacgccatagacaacaacgacatctatcgcacgtcgtgatcatggtgcacgacttgagttgtgacgcgcttggtcttgcttcttcacaaagtgctcagccagccagcaaaacggagggatgaacagaggaatctagatacccaaaggaactcatcacatgattacaacgaaatctaacaacagtttcgcaatacaatttcatttaacacaacattattagtttaacataagaactagacaactagttccttaaccagtcataagtaaatcagctagcaggtgaagaacacatggagaaatgccaacgcagacacgaatagactacagagcaacatgtgaaatccaaccatatgggcctcaactcctttcgcagatcaaccaagaatgtctcgcatttgaacctgacaatcagaaagagagcatacgctgcaccaaatctagactaaagacttaataatcaactagatataatgtatactttgttgattatgtgggcatgcatatgtttcacaaactcaacatgtaaggcatcgagatcagtcagcactggtgtttcccttaccactaggcctgcttttgctatatggtacctctcctccgacgagtcaggagaacgaatgggtggacccacaaatcgacttataggtcaattacctaattggcctataagtggagttgcgggtcaactcacctacagctatatgaaccattgtaaccataaattaatgatgtttagaaaatatgtggtaaagtctatacagaaaacttgaaattaagctaacatttttaattttaaattatttatttattgcttacaaaaactgcaaaaacatgatcacacaatgacacagatagcgtaaaaaccaagcttctattgcggttattataattggatacatgccattaaaaatttaccagttttgaaatatgccactagtattgatgtatttgaaaatataccattataatttcacacatattcaaaagataccactacttaccccttggatgcatttcccaaaaaattggaccaaaccgccccttttcccctcttcttccttcttccctttctccttcctcctctcctccttctcagcggcgacgtggcacgtcggtggtagcagtagcgtcagcgcggcgcgtcggcggcggcggtggccgcatcagcgacggcgcgacacggctcggtggcggcagctgtagcagcggcggcggcggctgtggtagcagcagcagcagcgcagcggcggcggcagcggcaacagcaacagcgcagcggcagcaagtggcggctgcagcaggagcggcgcggcggcagcgcgagcagcatcaggagtggtggggacagcggcggagtgagcggcacggtggcggagcaagctgcagcgcgcggcggcatggatagcagtggagcgagcggcgtagtggagaagagagagagggtagaagatcgggaagagagagatagaagatgagggcatttttgtccaatacatgcaaaatatgtgtctcagtggcaccactaagattaggaacaagtagcagtggcatcgttacaaatatacatattgtaatggtatattttaaaccggcaaaattttagtggcatggatctaatgaaccctatatttttagttgaatgaccagggtgtgctataaattaggagaaataattgttgcaggttaccaagaagagtgtgttttttttttgggcatttgcaaatttgccaccggttttttcaatattgcaaggatgccactcgaaggacagttctagtggtatttttgcaattttctagtggcagttttacaataacgattcaaagtagtggtaaatttgcaattgctcctttatttttctgtttattatggtggacaagagaaaagaaccttgtgaacgacaaggaattacatgttaaaatatagccattcgatcaataagtggttgctagggctattttagttgctagactgggcagtaaaccagagcaagcggcatacttacgagactttgagtataggagttaactagtagaactacacaaaacccaggatggaaatcacttcaatttcataaacgatggtattatgtatatacccaggcagctaacctatacctactctttgaaccgaagctgtcattaggcattaattcgatgcggctgttagtagctcacttttgccgattaacatctgtggggctgaacggaaccaccagtgaatatgctagccacacgctggagatggagggttcagtcactaattgcatactcaagatatggatattccgggccagacatgagttgatatggattagaggcaactggtaaacaataggaatgagagatggatcatttctttctgtctagttaattagttactacctactgtgatatattaactgctaaaaatatggatgacacatgagaccatactataccctaatcataccttaatcaatcttatgttagtcatctgatcatttgcatgagccataccctgcctccctcttaatggatatctattcttattatgcccatcgtagggtctgctagtccaagtaggtggttccaaaatgtaccctgattagccttacatttgtcgatgaccgtctattaaactaatagatgtgttagtattaattatctctttaacgagatctacatggttcttcattgatagatataaaacctccataatcataataatggattataagccccacatacctccatggcaggtgatctagacaagattaattcctaatgtacgtagaaattcttctctgcacgatacctcatgagtcatcacagctctgacagaacagtagcttgaggtatgtcacaacaggacccgacgtagcgcaccaagagatttttccaagctagttgaacccctaatgcattccattccgagttcatgagactctctactttttgtgttaggcattctatgtcctaagcttgtgttgggtgttccatccatggatgctaagccagttgcgtgcgtagcttggcacattggcatttatccaccaattatttatctaaaaccgacacatataaagtatttttcatcttttgttagtataaaattaaaatctggcacctataaccagtcataggtatgggcatcatatgagtccacaggtgccagtacagaactaagaaccggcacctgtaaccagtcattggtatgggctcctgtaaccagtcattggtaccggcacctataataacgtcgttcatatatgtgtttattgcgtacatcagttgtgaattgctcggcttccatcattgtgcaagcagggaagaaaggcagccctctttgatctatggctccaatgtgttgacgatgtggcttaatctattggcttctttaaaggagttaatatttataatgggtataccatctatatagaaagaaatgattgattaatttactggctttttaataatatctgttttatattagtgttaaggtaccagtaccgcaaaataaggacgaacctcctaattgctcatgaaaaacacactattttagcagtgtagaattgcctagattctattgacttatgttattggcttcaatgcatacacccaacaagtactattggcgcttctaaatagttggtaggaccagatttggcatcaacgagcataatttggcatcaacatattcatcctgcacgcaatacaagcataattaggagtttgctagctaaactatggccgagtttagatacaaagtttttcttcaaacttctaacttttccatcacatcaaaactttcctacacatgaaactttcaacttttccatcacatcatttcaatttcaacgaaacttccaattttatcgtaaactaaacacactctatgaaacaaccaccgtaaggtagttgaatagttgattctcatggcatagaacttcttctcttcacgattcctcatgagtcatcacaactgcgacagattctgccatgtatggctagccacagtagcttgagctatgtaacagctggaccggaggtagcaccgagagatttttccaacctcgttgaacccctaatgccttccattccgagttcatgagactctgtaccgtttcactatttgtgctaggcatgctatgtcctaagcttgtgttgggtgttccatctatggctgccaagccagttgcgtgcgtggcttggaacattgatatttatccaccaatggttccacttttgcgttgccgtggagttaagaggaggggcccggcagaaacattttaaaagtagtgtacccttgtgctaaatttctcgtggttcatctgaaattttgatcttctactactcgtggactcctgccaagatatcttcccgtaaaagcaaattatgtgaatttagaaaaaaaatgtttaaattccaaaatgtttttatttcaaaatttcattatgtcatagccaaaaatgtttttttatatctccatgcaataactagaatttggcaaaaagttatacaaattatattctttgtcaaccataagtatttttttaggaaaaatttgctataggacactcaaaaatcgtttaattggctgagggagaccacaagaacatgtatttgctgtaggacatcgcataagtgaaatcaaagtgtgttttgactatattcatatcacgaaacaaggtagtatatgtgaaatcaccgtgtgttttgattatattttgatgatgaacaattggctggtatatattttttttattaaagcacagtgagggaggcccccacggtatatgttaggcttgtatattattgattttgatattttgagattattggctgctgctgctgctgactaggttagcccggtcaaaccagacagtggtggccggtcagaacatcatggtttgtgcagttagactggccagcccgactgtctgactggccggctctaagttggttttcgttttgggttgtgttatgctcatggttagtttatgtttatggtttctacacgatttctacatatgtaatagtgttatgtgctaatgttgagtcaagtcggagagaatttgtgcttggatatgatttcttgttgtttgaatcatgtgtaggtgtcttgatggctcgggagagctttatcggtgatggatcaagagtcaacttggaagaaaatgatgtccacatgatcacgatatcatatgggatgcttagtctaaagaaccatgcacgtggttgatgtagattttatgtggcatatgatgggagattgtgtgcgtatggaataaggagtcaaatttggaaggagtccagacttaggaagaatgaaattcaaatcgtaaagttaggtttgtgacagcaggctgcctacctcggatataaatagaggggctgggttgagtcctcccagtatcgattatgtgtgagtggagtttagggaaaagttagcgtttcgagtttggtcaaattttctaagaggactattgttgttgcactttgtaaactttcatctacatagagaaatcattgatttatgttgactcgggtatcggtgactactgtctggtcagactgacgggctcagggcggtttaaccgaaggcagcgaagggggcgacaggtatcagcagggcagtcagaccggaacatcatcaccggttagaccggagatctaacaccggtccgaccaacttccggcagatttcgagggtaactcttagttctgcaaaaagttctcagttttagtgttggtaccatttaccccgtgtaggcttagttcttgttatttgatcctacagtttaatcgtattatatttatcaatttagaagataggcagcgtgaatgcatttctttgacttcactgtcttacaaacaaatttctccttgctgatactcaatgaacgaacaaaacaaaatcattctaaaaaaacatatttctcttttttttactacgtataattattgaacatcccttgaacatatataatatcaagaaaaaaacgcactaagcatctttggatcataccttggcagattcttgcagtaactagcttgaagagctaatatttcattattggtgaactgcatatacaatgttgaatggaagagaaattaatcatctctgattcattttgttcatataattccagatgcaatgaattcttcttgcatccaacttagctacagaggctgcaaaaaatatctcaccagcagataaatatggaagcaaatagaacgaaaccttgatcatctggagattggtgtataccaaattaagattacttaggaaattagatgatcaaatggattgcaccacttcgatgatttcctcatgtagagaccggtacacaatcaacacttttcttcacactagaacccaggctataaaaggtaaacaattgtgtggagttgtggacatgtgtacgccagcgttgccgtagtagctgcagaggcacaaaaacgttgcagccacgctgccgtgatgaatcgatgttctgcacttctgatgaaggctatgaaagcagcccaggatcttttatccatgccagacaattcggatgctaagcttatttggtgattctggagcaaatatataaggcgataaggcttggaaattgctttttgcgtatttatcttcctttatgcatatttattgcgtacatcagttgagaattgctcggcttccattagttgtgaaggcagggaagaaaggcagctctaatgaagggtgatcgaagggtcattctgttatgaaaatagatgcacaaccggcaatgatcactatagaggagatgactacaaacataggaaaatcacaatgggaacatcaccccttcccgtacggcttacaagagtatatataggggataaaagaaagacacctaataggtctcctaagaggaaactaatccgaatatattgtgggcccaaaattcggatcacatatttaacaatctccaccttgagacgaatttcctcttgtagcataaaaaacatcaatcaccaaaaaatacctcatgtaggtaaaatcaccgcgcgccaaatagtctctaggactatactttaacaccaaccaagcttgagcaaagctcaaacttagtagcaggaactgcctttatcatcatatcagctgggttatcatgagtacttatcttgcataccttgacatcaccttcggcaatcacacctcgaataaagtgatatctcacatcaatgtgctttgttctctcatggaacatctgatcctctgtaaggtatattgcactttgactatcacaaaatatattaatgcaagacgtaactccacaaagctcagtgtacaaacctctaagccaaagagcttctttacaagcttcagaaatagccatatactctgcttcagtagtagataaggcaacagttgcttgtaaacttgccttccaactaacagcacatcctccaatagtgaaaacataacctgtgagcgatcttctcctatccaaatctccaggaaaatctgaatccacataaccaataagtccatctctagatctcccaaactgcaaacaagcactagatgtaccacgtaggtatctgaaaatccattgaacaactttccaatgctctttgccaggattagccatgtatttactgacaacactcaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggagtactcactggttttgcatcatgcatattgaaacgacgaagaactttttcaatataacctttctgactaagatataacttgccagaatgtctttctctagtaatttccatactgagaattttcttcgctgcacccaaatccttcatctcaaattcactactcaattgtgccttcaacttttctatctctgatttatcttttgcagcaatcaacatatcatcgacataaagaagcaaatatatagctgaaccatcaacaactttaagataaacacagctattataattggatcttctaaacttctgagaaagcatgaaagagtcaaatctcttataccactgtctaggtgactacttcaacccataaagagcgaattgaactatgcttcacaacaggggaaaagacatcattgaaatcaatacctggaatctggctataacctttagcaactaaccttgctttgtatcttgcctcatcactgggaaacataccttcctttcttttaaagatccacttgcaacggataggtttcttctcctttggcaacttcaccaattcccaagtatgattcttttcaagtgactccatctcatcatgcatagtagttatccatctattgcaatcatcagaaacaatagcctcagaatatgtagaaggttcggcattaccttcaatttcttctgttacactcaaagcataagcaactatgttcgcttcttcaatatatctttgaggaggtttagtatttcttttgggcttatcttttgcaatagaacgttttggaaactgctaaacaatagaagaatctgaatcttcaataacaggtgcatcttggttaatagcaacatcttctttttctggtgcatgccctgaactgatcaagtgctccacctgcacacttgctttttcctgactctcaacaggaacattagtagaaggtttgtcatgtaacataaccgattcatgaaagacaacatttctactaatcacaacctttttggtttcaggacaccataacttatagcctttcacaccagacgaataaccaagaaaaatgcacttaatagctctaggctccaatttaccattatcaacatgagcataagcagtacaaccaaatactcttaagtctgaataatttgctggaaaaccagaccataccttaattggagtcttcttatcaatggcataactgggtgatcgattgataagataacaagtagtggaaacagctgccgcccaaaactgtttaggtaaacctgcattagacaacatacaacgggcctttgatataattgtcctgttcatacgctcagctacgccgttttgttgaggtgtgtagtgacgcacaatgccttcagacttgcaatatgatttaaatatcttagaacagaactccatcccattgtcagtacgaaggattttcaccttcctttcagtttgtctttccaccatagttttccactctttaaacacatcaaaagcttgatatttgtgcttcaagaaataaggccaaacttttcgcgaataatcatcaacgatagtcataatgtaacgagcacctccaaaagatgtcttacgagcaggcccccataaatcagaatgcacataatcaagaataccttcagtagtatgtgtagatgtgttgaacttcaccctcttatgcttgccaaagatgcaatgctcacaaaatttgagcttcccgatgctttgtccatctagcaatcctcgcttgctcaattctgccaaaccaatttcactcatatgcccaagacgcatatgccaaagattagtagcatcggaattagataatgaatcagaaactgctgcaacattacctaatatagttgtacctcgcagatggtacaggttggcagatttaatatcagctttcatcacaacaagagagcctttagttaccttcaaaattccgtctccaccggaatatttgtaccctttgcgatcaagagtacataaagagatgagacttctcttcaaatttggaatatgccgcacatctgacaatgtgctgatacaaccatcaaacatcttgatctgaacaattccaatacctgcaacctcgcatggtgtatcatcacccatcaaaacagtaccaccttgcacagcttcataggtggcaaaccaatccctattcgggcacatgtgataggtgcatgcagtatcaagaatccactggtcactagtttgtgcacaaccagcataagcaacaagcaattctgcatcagacttctcatcagtaacaactgcggctttaccttcctcttctttcttaccttttggtacatattttccggttctcttgtctttatcctatagcttccaacactcagagatatcatgtccatctctcttgcagtatttgcatgacttatacctgcctctggactttgatctcccacggtagctacttgaacttttatctcttgatttgttgtttgtgttcttctcctgttgcctgccccaaacaaccaagtcttatgcttgtgaatttgaaccttcagagggtaccatcttcttcatcttttctttggcatgcaaagcatcataaacttctttcaaagttagagtatcacgactataaagaatagtattcctgaagtttgcatatgagctaggcaatgaacacaataaaataaggcctaaatcctcttcatcatactttacctccatagactcaaggtcagcaacaatttccttgaaagcggagagatggtccatgacagacccatcatcttgcaacttgtgcaaaaataacttttgcttcaggtgcatcttactggtcagatccttagacatgcatatttgttccagcttcaaccacagcccagcggctgtctcctccttaagcacctcctgcaaaatattatttgatagatgaagatgaatttatgacatagccttacgatcccttttcttctcatcgttggaccaatcctgtgtcctcttgtcaaatccagaaagcgcatcatcgaggtcttgctatgcaagaacggctcgcatcttcacttgccaaagtgagaatcttgtgtctcggtccaagagcggtagatcatacttcaaactcgccatgggaattaatcctgaatttgctagaaagaaattagggtaaacctagcaaaacgcgaaacctggtacacttctcctgtgcacgtagcggtagatctgaaacttcctggtacacaagcttgtgtgcgcgtagcaattccacgtgaatagaaaatcacgtgaacaggaacctgatcgcttccctcgttgacttccttttcagactcgggaaccgtgcgatttagtggatgtattcacgccggctgctactcctggacgtgcgcgtagacggcttgctgctgctgcttgccaatctcctgacgcgtgtgccgtttccaggacgtgggctactgctgccctaatttcgcgcaggcggtagggatgacgccgatcagatcgatccggcgactcgatgatccggcgcctcgacgaatcggcggcggctgcgtgacgtgtagatcgatctccaaagctctgataccacttgttatgaaaatagatgcacaacggagacacgaattttacgtagaaaacccttgcgggaaaaaaccacgggcgccgaccggcaatgatcactatagaggagatgattacaaacgtaggggaatcacaatgggaacgtcaccccttcccgtacggcttataagagtatatatataggggataaaagaaagacacctaataagactcctactaggaaactaatccgaatatattgtgggcccaaaattcggatcacatatttaacacattcgaacaaagatgatcttttgatccaatggctctaatgtgttgatgatgtggcttaacctgttagcattttttaggagttaatataccgaaagaaataattgattactagaggtactggtattccgacttctgagtaccaaacatgtatcaacccagacccgcctcactccacgtcctgtcattctgctcccaaccggtctcgcccccacttcattctttccttttttttccaaatatgaatcaatccaccatcgcagcctagaaatcggtgacgcgccatggaggaggacgacggcaccgtggcggttgacgccgatggctagcggttgaatcgaaggcgctgcttcggaccttgcggcaagacatcgggcaacaccttaaccagcaaggaggtgttcacttgggccaagagcaacaaccgtcggctgctccatgtcggtggcattgacagaagaagcaagtaagcaaatgatactcctatttgcatatatatactctccgtcaccttcatgcatgcaaccccaatttctttttgcaaatcaaattaatgtgcaatctcgaatattacctgatcagaattgatgggctacaaaagttctacatttgtagatcgtactccatgtggctagctgtaaaggatagggtagagtccgccgatcatggaggttgtttgctatttttcttttgctcgtcgtctctatgacatgaacaagaatgtttttgcatatttttgtgcttgctagatgatggatggttgctactgtgtaacgccgagctcatctctataccacaacattacatccttccttgattccatcgtcaactaacgctcgccacccggttgtcctctccactacgagtcacaagacacagactagcctctccatccatatagcaagatctaacaatcctaccaggatctcagcttcacgatggatttttggctgaatcattttttcttttctagtttgattcacctatgagtaattttatcactcgtgtgtaattgagcctgtaaattttttcatttgtactgctattttgtgatacaaattaataattctcttatattgtgtattgaacacatcggttaacataatactacatggtggcacgagatcatgggctatatcgagagtaatgtggtaattgttttactcgcagaccacaaactctagaaaatatttataacttgtaaaagaattactagcattgtaagctggtagtaattcttttacgaccatctatgaatagtgccatacgatgtgggggcattcatgcaagtacatttgttacatttgaaggatacattcgtgcgagtaaatttgttacttttgaatgagtagatctgggaggctgggagtaaacggaaaacatcacagagtaaattcattacttttaaaacatgggaatacactaaaaaataagaaaacgtcgaaagaaaagaactacatgataaatactttactaaaacaaaaaaatagaaaaactcgagagtagaaatgaaaaacggaaaaatctagctggttcattttttaccaggccgtttgataaagcgtggatgagatggaaaagagaaaaaaaagaaacacaaaaggtgaggtggtaaaaaaaaagaccaagaaaatttgggatacgaaggaaaggtggagtggtaaaaaagggaaaactggaaggagggatctttgtgtgaaggtcgaactaatattcagtgcgcagtgccatatttgcgccaccgttaattgatctactggctttttaataataccgtgttgagctaccattaccacaaattaggatgagcatcgttaggctaattactcatgaaaaacacattatttcagcagggtagaattaccttgattctattg

SEQ ID NO: 35144 - DNA, 3455 bp, Oryza sativa
taattactcatgaaaaacacattatttcagcagggtagaattaccttgattctattgacttctgttaattttggcttcaatgcaaacacccaacaaatagttggtaggacatgatttggcatcaacgtgccttctgccagaattggtcagctatatatgcgccgagaacttgttcaccatgcacctgatgctagtataataaatagtttgctagccaaactacgaaacaaccacctgcattgcgaggtgaatatatatatatactcaggataggaggcatatacgggagtcgatccgcatggcgttagatcgttactctatgcccgttgatgcagaggcgggctttcctcctggaactatgagagccgcaagcaatgcaggccacaatttagtggggaatatgttgcagcgtgcatggatgcataccgagtaatctcctggagattggagatgaatcgcaagcactctcgtatctctaggagtgaaaagtgaaacttgaaaaggttctagaataagccacgtcactcagtcaataatagccattggatatagctggagtctataggatcgaatcacaataactaagccaactagagggggtgaatagttggtatacccaaaaaccgaaaacttttagcggaaataaaaattacactcgaattcaacggaagtcggtctggccatagtgaatgcgccggtctgaccgcctgatgaatgtcggtctgaccgatgtagatcgatcggtcgaaccgccgagatcgcctgctgccgactcctgtcgccgccggtctgaccgccgtgtgcccgctggtcggaccgccgaaacccggtgaaacacaaatcgaagaactcttaaagtagatgacaactttattgattctctctatgtttacaaagtgcaccaacagcactccttacaaagtttcgactaaactcgaaaccctaactcaaaactcaactcaattgctctcaaaagcgataccgggaagcctcacgctccacctctatttatacccgaggtaggcagcctaaagccacgaaccaaactcatactaggagtcctaaacaccttaggaaaccctctagttcaagacacaaactttacataaccaatcataccaaatttggactccttccaaatttgactgcgcatcccatacgcacaatatacctccatcgtatgccacatggaatctccatcaaccacgtgcatcaactctagcctaagtatcccgcatgatctctgaccaccacgaacgtcgtcttatccccaagccgactcccggtccatcaccgcaaatactctcccgaggcatcgagtcacctacacatgaaataaacaaagaaacgatattccgagaccaagctatctccaccttgactcattagtagcaaacaacagtattacatacgtatagtatcgacctagaagccataatcatgaaataatcacggatatccaaacaaacaacccgaaaccgaaacagacacagcgtcggtcggtcagaccgcgggctggccggtctgaccgcgcgtataccgccagtctgaccggcacacagtgcccggtctaaccggtccacataaaataacagaacctgcatattcacctgtaaatccaatcatctccaaaaccacttcgtgaataaattccaaataacaaaaccaataatctccaatgacaattgttcacagaataataatcaaaaacacctttgattttacaatctcccccttgatgaacacattggcaaacccatcaaaaatgtttttgtatttggaaaaataaaaacaaaagtggtaaaaagcacacttcgtacaaatgtacacatcgtgctaaaaaatccaaaagaaaacttctccccctttttaaaagaaagaaattccatcatgaactaaaaaatatgctcttctcaacaactccaaaaatcttcttccaaaactcatctcttctcccccttttgacagggtaccgagctcatcaagcataggacctatgttcattaatgtttaagagcttagcatacatatagcatatcatgtcatgtattgcaataaaaagaaaatgaacccatctccagtataacaagcatgcataaaagtataagcatgacccaaagattttataattaagcttgaatcaacagtcaaaattcatgatttcatacgatttataatgcaacatcttaacaagcacataggttgaagaataaacactaaacacatatacctattgcatttattactctttctacacatatacctattgcatttattactctttctcaaattagcttttgcacaaaacaaccaagagaagtttttaactttttgttttctttagcctttttgctcatatttttctcttttattctgggtacgtccctgtcgtcaacactgtttccagggattcggcacccattattttgctcacatcgaatacgtccttgtcgtcaagactgtttccaaggattcggtattcattttttttcatatttttattctctttttcacaatgagcaattaaagatctttgagcaataacaattcaataaagcatatatataaagcatttatagatcaaaccatatgctagcatcaacattgcatatttgcttaattcaagtatagaatttaagtgtcatgcatcatctcccttaaaagcaacatgtaaatctcatgaaaagactagaatacatgcaagctatgcgagacaaataaaccttcaaagtattgctagcatgcacaagaaaataccacatgtataaagaaagctctctttttctcaatttttctcattgtcatattattgcttgataaaaccatgaggtacaaactcccccttaaaccatgccaaaaggatgaattatgcccaattcaccacgaagaaaagcaaatcgattagaatccaaaggtttagtgaaaatatcagcaagttgcaactttgtgtccaaaaactgcaattcaacatctcccttctcaacatgatctctcaaaaagtgaaagcgaatatcaatgtgccttgtgcgtgagtgttgaacagtattcttagcaatgttaatagcacttgtattatcacgaaagagaggtactttctaaaaagtaagaccataatctttcaaagtaaataaaagtcaaaaaatctgtgaacaacatctagcagcagcaacatattcagattcagcagttgattgagcaacactagattgtttcctagaagaccatgcaattaatgatgtaccaagaaaatgacatgttccactagtacttttcctatcaattctacaaccaccaaaatcagcatcggaatattcacttaagtatatagaaaatgaagtagaataccaaattttaaactcaagtgtttgattcaaatacctcattattcgcttgaccgcttgacgatgtgaaacacgaggagaagcttgaaaacatgcacacaaacacacagcaaa

SEQ ID NO: 35145 - DNA, 581 bp, Oryza sativa
caaatgtgaaactttgggttgatgtccaaatcgaagttcataagaagtttttccaagtttagatctcaagaaaacccaatttgaaatataacatgcagtgttaattgcctcagcccaaaattttctaggagttttatactcatccaacatcgttctagccatctcaaccaaaacacggtttttcctttcaacaacaccgttttgttgaggaacacgaggagaagaaaattcatgttcaagacctcttttattgcgaaattgttcaaaagaagcatttttaaactcaccaccattatcacttcgaattcttttcaaagaaccaggaaattcaagatctaatcgaagaaacaaatcatgaaagtgttgaaaagcttcatccttagttgccataaagaaaacccaagaatatcgagaaaaatcgtcaacaataaccaacacataccactttcctccaacagatttcactctagctggaccaatagtgtccatgtgtaataactgtcccagtgcatccgtcatcacagaaacaatatgagcatgtgaagaagcaaccatctcagcatgatgacacggtgtacaaa

SEQ ID NO: 35146 - DNA, 550 bp, Oryza sativa
tttgcccgcagcccttgacgccataccttattgtactatggcgaaaggcatggcgtgtggcaaaagctgttcacccgcagcccttgacgctgtaccttattggtactatggagaaaggcgtgggtgtgatgaaacctgttcgcccgcaacccttgacgccgtaccatattggtactatggcgaagggcgtgggtgggcgaaacctgttcgtccgcacaccttgacgccgtacctcattggtactatggcgtagggtatggcgtgtggcgaaacctctttgcccgcagcccttgacgccgtgccatattggcactatggcgaagggcgtgggttggcgaaacctgttcgtccgcagcccttgacgccgtgccttattggtactatggggaagggcgtggcgtgtggcgaaaggtgtgcaaaggcttgggtggcttcgtagccccctaacttagtcttaaaccactttcatccccagcccttgtcaccgtaccacgcgggtattgtggcgaagaatgtgggtgtggcaaaaggctctaaaggctagggtggt

SEQ ID NO: 35147 - DNA, 1893 bp, Oryza sativa
  unsure (1)..(1893): unsure at all n locations
cgacaatatcgcctcatgctcaatccagagaagtgcacgttcggagtaccgtcgggcaagctgctcggtttccttgtctctgtcagaggaatagaagcaaatctcgagaagatcaaggcaatcgagaacatgaagtcacccacaagactcaaggaagtacaaaagctaaccggatgcatggcagcactgagcagattcgtcgctaagatgggagaacgagggcaacccttcttcgctctactgaagaagcaagacaaatttgtatggacacaggaagccaaagaggcattcgttgcactcaagcgctacctatcaaacccccctgtacttgttgctccccaacctaatgaagaaatattcctctatattgctgccacgccatattccgttagcactgtcattgttgtcgagagagagaaaatacaacgaccagtctattacgtcagcaaagctctccacgacgcaaagacaagatattcctcagatccaaaagaggatttacgcggtaatcatgacatcaaggaagctacgccactactttcaagcccacagagtcacagttgtctcctccttccctctcggtgaagttgtgagaaacaaagacgttgtcagccgcattgcgaaatgggtagtcgagctgagccagtttgatgtccactttgtgccacaaaaagccatcaagtcccaggtacttgccaacttcgtagccgattggactatgcctgataacaaatcagacaaccaagtcgacaacgaaacgtggacaatggcgttcgatggtgcactcaacagccaaggagcatgggcaggattcatcttgacgtctccttccggagatcaattcaagcacgcaatccacctcaacttcagggcgaccaataacacagccgaatacgagggactactcgccgggataagagctgcagccgcacttggggtcaagcgactgatcgtgaaaggggactccgagctagtcgcgaactaggtgcacaaagattataaatgctctaaccccgagttatccaagtatctcgcagaagtcaggaagctggagaaaaggttcgatgggatcgaggtccgacacgtataccgtaaggacaacatcgagccagatgacctagcacgacgtgcgtccagacgagaaccgctcgagcccggcacttttctggacatcctgacaaagccatcagtaaaagaggttagcggcgaagttagcccggccgcccccgacattagctcggaggccacagaggcagaacgcgccgttgccgatatcgagaccacatacgactggcgcatcccactaatcaaattcatcgacagtgaagagttgcccgaggacgatacagaggccgagaaaataacccgtaaagcaaaaatctactgcatggtcggcaatgatctatacaagaaagcgccaaactaggtacttctcaaatgcgtctcgtccgacaacggcagacacctcctccttgatatacatgaaggcatctgtgggtcacacgccaccggtcggacattggtcgggaaagcttttcgacaagggtttttctggccaaccgccctcaaagacgcatgcgacatggtccagcgatacgaagcctgtcaattccacagtaaacacacaaagctacccgtgcaagcgctccagactatccctcctacttggccgttctcgtgctgggggctagatatactcggaccattcccacgaggacagggcggctacaggttcctattcgtggcgatcgacaaattcattaagtggatcgaggcagtacccacgggggaaatcaaggccgataacgccattaaattcatgaaggggatattttgnnnnnnnnnnnnnnnnnnnnnnnnnnnnnnnnnnnnnnnnnnnnnnnnnnnnnnnnn

SEQ ID NO: 35148 - DNA, 1290 bp, Oryza sativa
taacgccattaaattcatgaaggggatattttgcagatacggactaccgcaccgcatcataaccgacaacggcccccagttcatcagcgccgacttccaggattactgcatcgggctgggagtcaagatatgcttcgcctcggtctctcatcctcaaagcaacggacaagtcgagagggcaaacggcatagtactacaagggatcaagacccacgtctacgataggctcatgtcacatgacaaaaaatgggtcgaagaacttccatcagtactatgggccgtacgcaccacaccgacaacatccaagaaggaaatacccttcttcctcgtgtacggctccgaggccatgctccccagcgagctacgacatcagagcacacgagtacaaaagtattccgaagaggatcaggaggagcaacaaaacatcgatgtgaatctactcgaagaacatcgcgaatgagctgccattagagcagccagttacaaacaagttgtaacgccccgattttcgttcgggattaaaaatcaattaataatgcatttttagaaattatattaaaagttaaatcaatttaatcaagtgaaattatagaggaaattaaaaatttcctttaaaaaagtctttggccgggaatattttgtaatattctttgtgccctaatgtactctccggaattttccgtgaattttcggagctcgagaaatagttttaatagcacaaagatcattgcatcaattaaaataaaaagaaaaaaaaaatcctccttcctctctttgggcccctttcggcccaatccctcctttctctcccgcggcccgtgcgccccttatctctccctctcgggccggcctcctccctcggcccgctcggctctctctcttcctcaagtctgctttacctccctcgcccgttttcccctctctctcctcgacaggtgggacccgaggccccacctgtcatcttcttctcctacctccagctccatccccaaccgccgccatggccgccaaatcctcccacgtcgccgcctctcccgcgcgactccctctcccgcgcgtgcgtggacgcggtcgtcgcccacgtccgcgccgtttccccccactctccccgcaaaatccggccacgtcgccgcctcccgcatctctctctcctcccacgttgccggccggtttctacttctctcgggctcgatcccgcctctcctcccctataaaaacattaaccacacctccctctccattttcccctctctcccaagcccttccgtgcacgaaaaccaccccgccacc

SEQ ID NO: 35149 - DNA, 11694 bp, Oryza sativa
cgccgaatcgccgccgtcgtcttcgccccgtggagcgccgccgcctccctccgcgggcgctccctccgtcgccgcgcctctcggtgagccgcctccctcctccttttcctcttcgccggccgcccgccgccgttccacgtcgccggctgctgccgccggtggccgcatgccgccgctgcgccttggcttggccgggccggcttcgtgccgcgcctgtgcccctggctgccgctcccctcggccgcccgatcggctcaggccgatctgggccgtccacgtggtggacgcgcacccgaggccacgtgtggaccatgtccaccgtgcgccctccccctttgactcgctgacatgtggggcccgcgtgtcggcgccggccgccccttgctgacgtcagcgaggtccatttcctttgtaaaaataaataataattgcgcaataaatcgagtttaattctagaaattcatttaaatggctcaaaacttctaaaattcatatctaattcatacgaactccaaattgggccattcaacttgcaaaattcatctaaaattgagctctacatgtttgtttactttttatgtactgtttccttggtttttattagagtttttcctcgttttgcgtgccagcgtgtagaatccgtcgtttcggaagtccgcgatcgcgaggaaaagagttcggaagatcaaagtgaagaagcaaggcaagtcacacattccccttgagcatgttgatcccaatttataaatgttttaccatttgcaaataaatatgcatgttttgctaattacatgggatccgagtattacctatctgctcgcttgtgccatgtttacttgatatctgtcctttgtcaaacgggggtaataaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattacccaactaaaatgcgactacatggtgggctgtgggtgcatggttttgtgagtcgcacccatggcaattaaggaccggttcacgggaaaccctggaagacttacagcgcttgccacaagcgggagtaggtaactgcttgatctgaagtatagctcgaccctttcctaggcaccggtggcgagggtgggcgtgatggagttgggtcggccggggtgtccggttgtccagctgccggattcaccgtggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatgtcggtgggttgtgtcttgtgggtacagttgtgcacctctggccagagtaaaactatttgaatagccgtgcccgcggttatgggcggtcgaccagattcaccgtgattagtcccaccttaataaatcgactcaatgcactgtagtccaggtgggttggttggttgggcctgttcaacgtggtgtagcgttgatcagtggagattcaatattactttaattactcaaccgttttactgttttcctcaataaaatgttttacaactgcctttatgcaaatagccacaaacccctccttgtatccccttgcacgtctgcatcattggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctactgctgcttttgtttcggtgtgaggactaagtgcctcttctgtaagtattttgcgctttatttacgtttggaactgtttattacttgtcgttttgtgtaccctggctggtcctggacagggatttaatacacaaaatagtctggaaatttgggctaaatttctgggcgtgacacaagtcctccgccgttaccacgagaagcgcattcgagcacgcatactttcgatcagcgactacgtcctccgacgggttcaaagccaagcagggcgaaacaagctctcacccaaatgggaaggaccttacacgatcacacaagtcttgtggccaggcgcattcaaaattgcagacggtgatggtcgcgagttggcaaattcttggaacattgaccaactacgtaaattctatgaatgagtcaatatcatccatacttataagacaccttacagcatcaagaaagcctatttttaggcgcatattacaatcaaagtgttcctgcccgatgatcccttacccagatgacacctagcgttgaaacctatcctcatgtccctttacgccgtcttgacaaggcctccgaggaacctaagggatcttcggctggggacgcccagagccgataaggccttgtcagatcctgtagagacgaaagaccaggtaagacctggtcgtgtaagagttatcgccgtgcgtattaaccaagacgcgtaatcggaaattaactttccaacttcacggctgggagctaggattagtgcttattcaaccaaggcaggtcaaaggtccaagagccttgtcctctgagaaaaatcctctgacgataaggctgggggctagggagagtgtacgactcaaacgactgactaaagtcgtgaactgagaacatactcttacacatgatatctagagtaagaaggatttgttaagatagattccttttctattttacaaaatactccttacaatttttacacaagtccaaagctatattacacttttccctaagatttctatcacagggtacaaagactaccaagaaggccaacgccagtccatagactggaagactttctccgccaacggcgccatcgacttcgccaggtggtctatctccgccggagtcctccgagaacgagcgaaaccttcatgaataaactcgaggtctaatccgggcggtgatctcgtaggcaagccaacacgtgccctccggcatatcggctcgatcgacgacattcctgcttcaaggcttcgtcaatgcgtttgccgacgccttcgagctgagtacaggccccattcagccacgaaatgtatccggccgccgactcctcaagatctccacggggtactcggagctctctacaaaccttggccatggacgtgcagcaactctttaagtacgagttgaaccacacctcacgacctcggagcgtttccacagcttgctctttctttacttccaacatagttctctcgagttccgctacttcaaatttcgtcttccaatattggatacgatgatctttgccagcaagagcactctcgagatctgttcaatatgggaacaactaagtcaagctgcacttctcttttgagaacacggctgatcaagtcggaggagcaaaaagggataaagggaccactaacctaaggaagtcgtcgccgtccccgtcctcgtggctaaactctgatctacatcgtccggcgacgcgtgtggctcaaacgcaagggtcgggatgatcgccagcgactcaggctgcccacgctgctggacattctcgtcatcaacatctctacaaggaacaaaaaaaggtactagagatcaaaatgctaaagaaaactaaggtgatggctgcacgtgcaaaggcggttagaacccattggagttttatacaagatgtctaaggagtacaagcgagtcaaaatcctactcttcaaaaagggggaggacagattcccccagatcgccaacttcttccatcacctccttacgcgtgtcgctagctgccccccgatccaagatctcgcgcagatcgagttctgggtgagccagcctcacacacgcaaggacgtggcacgccccggtgtagatcccgttggacgtctcctctccgatcctggccgcatgcttggagggaatctcctccatcgccaccgccagctccgcaagagaagacgtcagcgagaactcatcgggattcaccgggatggtagacttgataccgcattccccggcgagctggtgcagaccagtataggtgacccgcaacgagccatggatttccgacaaattgttcccgagctccaacatgcgatgcccgagtccctgccgttgtcgctcattgccggccaccaactccctcatcttcttgaggtcctcatgagcctccacctagtcgtgcgctagccggtcggcgcgctcgttcgccgacgccgccactgacctcgcctccgcaatttcacgaccaatgccgcggccaccagcctcgaggaggcgccccatttcaacctggagctcttcccaggtgaggacggcagccggcggaccacgaccagccacgggatcgctagccgggccgcttggtgtcacctcacggctcccgggcacgaccacaacactcgtcgaggctacagcgggagacgcgccggaagtccctccagactcgtcctgcgccgccttcgcccgcgccgccctacgagaaggctgtggttcagacaaagtttgacggaatcatgagaactcaaagtcattcacttacttctcgccgagcgtcacaagccgctgccatcgtggaggcgggggagacgcgtccgaggcctggagcacgatcgatatggagtgaggtggaagtattctgactacgtgatcaaatgacaggagagcttaccgagggagtagatgcctttcgacgatgtccggttacagaggagaatttcctcccctttgttggaacgtcgccaccacttgttgtggcagcgacagcggcagcatcggacgcctccttggcgaccttctctttcagtgacactgccacctgatagtccgcaagcggcccgatgatatcagtcagaggaagagcctacgctttatgaagtcaaatggcgatctcggaagaaaaacgcagaaggcccacggagaacacttacattgatggcatcgtcgcgttcggccgcccccttctcacaaaggggaacggggacattgctcgtcgtcgtcggaccactgatcatcacttggccgacacgatgtcccacggcttcactgctcagacctatgaatcgagaaccaaaattcgataagtcaggaggaacgcgcacacaagcatgtcagggtaaatgcaagaaagataccccgaggagaaacccgggttgtgtcctccggtccagaatagtcaaaggctggatggtctcgagcctggagcggctggatccatctaccaatgaagtcagcagcgacttcatatcccgacaaacctcgtactcggagatcgtcgacaacatcgatgaaggactgaagagaaggggtcaagaggggttttgcggtccaagacgaaatcttgtccggttgttcctaaggaacaacgaagacaggatccgaatcttctatctgaagatagaaccacctcgtccgccatttgctgcgagaggaagggcactggaaggggatataacgcgacttcaggccatcccgaagtcggaatccgacacatccaaacacgctatctgactccatccaacgcagctcgtagtagaagcgcaagagatcaagaaagggctctaccccaatgtgggcctcacaaagatgcgaaaaaatactaagaaaggcaatagaattggggttcagatggagcaaagaaagaccatagaagttcaaaatcaagagaagaatttcggaaggtggagggagaaaaccgcaaagaatgtagtcctcaatcgcaaccatgcgacctaggacaggctggggttcagtacatcctgcttccctctccatggtcccacgaccgggaagggcaccgtcctcctgaagcttcttcagcgacgcgctggtggaggaagattttccaagatccatcgccgactgcagatcgctggagaaagggttgagattgacgagctagggttttttgtgggaacggagaagacgaaaaacgcttacaggctggaggttttcttcacaacaggcagacttcaaaatggatccccaaaattcccttaaatagacacacttccgatggtgcgaattccaaggaaaggagggacatagccgccgaaaatttctgggtccgttatgcgcggcagttttttagacttcagtttaaattcactcatgaccgttgggcttcacagggtattctcgactatgtcctgtctctacggttcttacaccgggaacgacaacagcctcgacacctgaagtcactaatggttacacgagttcatttaagcagaagtcgggggccactgtcagggttacgggttaggtataccctttacccttcgatatacgctaaatatcggtatggcataactacgcgtatacggacactttctgcatatactaaggaaatccttcacggagtttgtagatggaaagagtcctactcggacaagactgggtcgtcaatgtatcgtgtaaggtccgatgtctccgagtcctacttagaaaccacctgacctgcgatataaaagggacccactgggaggacctaaggcatcgaatctcagaaccaacacaactcccacagcctacgaagtcggagcctgcaggagccaaatcgctggagatctagtcgaaccaactcaattacgatctcgccggatccatcgagttcaatctttccctttgtaacctgtgttttccatcatataatcccacatcaactggattagggctattacctatcaatgggcctgaaccagtataatcttcgtcttctgtttgcttgatgtcgtattacgtagatccttgtaccaacgtatcccaataccctctatatccggtctacgggtatcactcgtcgacaaccgtagtcgagttggttcgactagatcaccctagcgacttggctactgaagactccgacttcgtaagctgtggtggttgtgttggcggtgagattcgatgccttaggtcctcccggggtcccctttataccgcgggtcagttggtctcccagtagaactcgaagacatcggaccccacacgattcagttacgacccagttttgtccgagtaggactccttccatctatggactccatgatgaatttccttaacgtgtacagaaaacatccatatacgcgcaggtataccatatcatatcagtatacgacgtatatccaagggtagagggtataccttatccgtaaccctgacataatgcgtcttgtttcatatgctacatgtttgatcttttttggtgagttgtcatgtataagattggactccgataccaatgcctgtcgctctagttttttttaaaagtgcagattgacttacttttttgtctctccattttgatttttttttacttgctcaaatattttctatcctgctcaaatattttctatcaacattctatattgtttagattttcattttcgcagttatacatgttcctgatagaagtttcatagtcttgccattgtagcagacaacttttcgcagctttaggaggggattttttatgagctgtagttgcaaattttagctaaaatagaatgtttatattggcaaatttttattgtaagcactagttcatactacttcaatgtatcattcttgaggagatatgtgtattttcatgttgtggtggaaacacgtgtcaacaaattttattcccggtatgattatttatagatgtatcaagaaaagatgtacgacacatgaaaaactcactcgacgtacataatggaagcatctaaatttattgactaggctaaggcacatgctttgaggtaaaattttgggccacttagtggagcatggattttatgaagaattacaaggtttggacctatcacaaggaaattgtcactcttgaaggtgacggtaatgcagaagtgaagaggttttcaaatgtctgaggtagagaattttacaattgagttggtagtgataatttcgaggttgattttgatcaggaggatacgctacggcacgctgaatcagaggtgctagctagtcggtacagcacgaggattagacaattggaaggtgctaaagaagtcagcgaaggatctttttttacgatgaatccaagggatgtaataagaattttatggtgttgcgtttggcatttaaacttctcagattgaagggtaggcacggatggtccgatggtagtttcaatgatttgatggatcttagagtttgcttcctaagcctaatttcttgtaatccaacacatgtcaagctaagaaacacatatgtccattatcactaggtgttgaaaaaattcacgtgtgtgtaaatcactgtgtacagtgtcgtaaggaatatgtagacttggacagttgcccctaatgggacatgcaagttggtacaaaacgggtaacaggtgctttgataatgaggttatcgacctagatttatcggtgcatacaaagaaaaaggatccgactatggtgatattacatcagtaacatgggctatatgaccacttaaaatttgtgttactgaaaaccacaacactacatttttgaggctatagtagcacattgttgttttactaaagccttgacatgatgtagttgtaagagaatgtgaaaataaatatagagtaatgtgtataggcagtccttaaacttgtagaggtgtgtcatctaggtccctaaactttcaaaatgcaaattcaagtcccggaacttgtcatagtgtgtcatctaggtcccaaatcgccacaccccttctggatcctacgtggtgttgatgtggcctgccacatggaatgacgtagcatcattttgactgacaaatgggtcccatttaaaatttttcctttttcctttctattctcttttttccctttcttctcatttctatgtgtctcgagcagcagaagaaaggggcaaaagaagagtgagaagaaaccgaagaaaaagaaaaagaaaagaagaaaaaaaaggaaaagaacacatcacatccatgtggcatgccatatcagcgccacgtaggattctagaggggatgtgtcgatttaggacctagatgatatactttgacaaattctgggatctggatatgcattttgagaatttaggagctatatgacacaactctaaaagttaggaccgttaatgcactttactcataaatatatgtataggtgccacaactcagctagtgcgtgtattttgattagaagatcagtattccacacgatatatactttttaggccatgtaaaaaagcagcaactctgaccatctcgataaggatctatacatgtattgtttttcttggttataataataaaataacctgccgatttgaaactgaaaaatataatgattagcaaaaagtaagcgcatgcaaactaacataatttccagactatttgagtaatcatacatatcattgtctccggtgatgaaaactgtacacaaacaaaatcgaatccaggagccaactatctagttgttaagcttataatacaaataacaaagtaggattaatcaaaaggtgcataacagtgtttttaaccaatatacacacgactgctaggtgatgtcacgcattttagactgcattcagcagctgtggtcgggaacaaaccggccgctactgcacgtagaacggagcagttcattagcatatgattaattaagtattagtttttttaaaaaatggatcaatatgattttctaaagcaactttcatatagaattttttttttaaaaaacacacgtttactaatttgaaaagcatatgtgcagaaaatgaggggagtgagttggaaaactcaagtgccgaactcagcctgtttatgaaatgatttggtactgtctattcattcatggttctacttatttgtcacacggatagtacaagtactaccacgtacttctttctttcacattataagatcttttgggttttgagtagatttataaatggattatgcatgtgtttcatatgtgtgtctaaattcatttaaaatgtaaacataagaacaacgaaagtaataattagcaatatatagacagtaaacgacgattaggcagtgatatcatttcagcagtcagtttgaacaaaaattaaaatcatccaacgaaaaggacctatattcgggagcgtatcctatacacacagaccctcgcgtgtacacatcgtgtacaccaactaaaaattatcacaaaaaaatgtacgaaaattcatacatgtactttcaatagtattacatatacgtgcaaagtcgcatcttcaaattcattctacatagagaataacaaaaaagataaaattctgagaaaattgcaaccttaaaactgtcagattttttggtttttttgttacggctaaaatataatgaatttgaggttaagattttaaccctaggtgtaatacaattgaaagtacgtgtatgaatttttctagattttttggtaatattttttagttggtgtgcatgtgtgtacatttgaggacctgtgtacatagaatatgttgcccctatattctctctaacagcaagacaaggaaaaccaatgcagcagcggagtgtttgcagcccttctcctaccaacatctgcaagagagctgaggctcgattgtttacaggtttggctacatgagaaaatcacctattgtgttggcctgtatacctatctcgataggaatcaccttccatgcaaaactagttgcagagctggacatttcagatgcgtggtgcgtctcaaatcccacatgctttccattccgaccagctgcaaaaaccagcatgcaatggatcgatcatgaaaaaaattaaaggctcaggtaaactggccagcattccggtaaacccctgatgccttcagatttcagttccgattagtccccatcttctgtctagccaggtcaagcaattttctgatgagttgcatgctctgccgtgtagctgctaggccgaacgagctcaaataggtgtctgctacttatataaacagcagtttctctctaaaaaaaagaaagaaagaaaagaagaagaagaagaagaagaagaagaagaagaagatatgttcattaattaaccgaactctctctgagccaatgtctcacacaataccatgaaatgaaaaataggtccaacgtagcgaaaggaagtaatgttcatgagcgtctttatggtccagcaaattgtatcgctcggtactggtatcgctcggtactagtacgtatctaaccgttcattccggcatgggtaggatcggaagaaaaaaacgtgtggactgctaaagtcgtcctgctgtggcgtcgatgtcgtggttcccggcggcggcggcggcggcctcgaactcgttgttcccagcggtggcggagtccttcccgacggcagcgttgaagcaggcgcggcggcgtcaaactcgtcgttcccggcggcggcggcgtcaatgtcgtcgttcccggctgcagcggcgtcgatgtcgtcgttcccggtggcggcgatggcgtcgatgtcgtctttcccggcagcggcggcggcggctgagttcacctccaatagtcggcggagaagatccaggaggcggtggaggcatcgatccagggttcgattcctcccaatccatctattgc

SEQ ID NO: 35150 - DNA, 13268 bp, Oryza sativa
agttcacctccaatagtcgccgaaaagatccagaagccgttgaaggcatcgatccagggttcgatccctcccaatccatctattgcacgcgaagtaacgtttttatccttctaactctgttttccaaaaggtcccgcatcaagaataattttggtaactcgctgtaccaaacaatactagccgttagattgggctagatccaacaaccagcattcggtaccgtacggtaccgtttgaccataaaaaatctcaaagtttatacacagcaattagacacaaatatattgatgtgaaaagaatcagtgcacaacataaagcttgttatttctttgcttccctacccatggcatcagcaacatacatatatgaatatttatttagaaatacataaagtaaactaacattgtgacaaagtaatagtaatgacattccctactacagagagaaacaaagaagatggtattataggtgtcaggatagctaaaaccagcacctatagtgctttttctgcccacacatgcaccctcgataaaaatcggcacctatagtattactatcagtcagaagagccgacacctataatatattataggtcccagtttttacgaacctacacatacactcatattataggtattagtttatttaaaaatgaacacctactaaaaaaaccagaaggtgccgaccgaaccaaccaaccttatctgctcccagtcagcattatccccacagttctcctccacactgatgccgcactcacccccttctcctccgtcctccacatcctagacacactcccacccgccccctaccgcggcctctccccacctgcctccaccgtgcctcctccccaccgtggcggcaacagagatgactactctgctctcctagccgacggatccaggcgatggcgatgaccctctctgatccgccagatctggctggaggggaagtggcaggctccccatatagaggcaacggcggcgcccttccctctgcaatgatgtagcaattatggtttgtcccccatctaactttttctcattgtctgtagaatacctgccattgtctgtagaaaacagagaacaacataatagtattatccctattaactacaaaatatggattgtaatggaggctaacaaatagaaatatcttatcaagctcttacaagtatcttaccagcaatgctaaggacggtacaaccggtggctggctcgtgatccaactattgcaagggtcaaaactatactgataaaactatctcatactcgcagaaaactactagttcagagaacaactgctttttatgctcggtgcctttcttcatgcaaccaaccaaatcgaccatggaaaactcagtcatactccatccattgaccactgagagaaacctgtgagaaaatttcatccatgccacgacgagttcaattctttttggacattcatttttgttcagttctattctccaaaccattcgatgtcaaactggttctctatatatactagttatcgtgcacgtgcaaggcacgttttagtattatgtgtgtgtacagagagaacaatagtgacctagaaaggcagtacactccaacaaaatctcgagataaaaatagagtttcatacaccatagtaacatgtcaatttggatgattcctataaaatcctttcgggtgaatcacactaccttcgatacgcattacaaatttacaatagtgtgaactggcgtatcgaagctgctagttcatttgagacaatgattgaaaaaaaacacaaaagtgcgtacattatcaattataaggcatggtactgcgtcaacctggctcaatgaggcgccagcccattttccacgggcttttctcttttgcccctcccctctatcttctttgtcctgtaaacccaaacagctgcactcaatgctggcattgataagagttcatatccttgacaagctagaatagtagcaaaatatgtgcacaactatgtatgggtagttcatacaaaaattgcttaaaaacaaaaaaaaaaggaaagaataatgaggtagtttgaatctttcccttgatgaaaataaaaatgtgaatagaaggaaatcaacccttttcaggatgccatggagcagtttgttaccatattgtacagaaccaacaattaaactatccatttttttaagaactgacacataatgaagggagggaaaggaatataggttttgtatgtctaaaatgttgattgttccacgaaggctatatctatgctggtacaatcacgaaatatttttggatgtaagaatcctctacccaacacaaacatctatttgtatcaaaagattaggaaatggatacactgccttattacagtaataagatattttcccataagaaattggttggcagaaaaaagaaaccggagttaagaaataaagtgctcacatgggccagaaatcaccagataagagcgatatgacgctgaaacatacaactgggcagcacaaagacctactttggaatacaacctgccctgaaaatgcattccaccatgtaacatgagtactatcaataaagaataagggctccttgatattcaatagagaaagccaaatagaagtcacaaataggtataaatatacatgaactcaaatttgacataggcattcgattacccctaagaaaaaaaagtcagataaaatggagtgagctactctattaatatcaattatttgccaatttgtcaatcacttaatccgatttagtcactccaagcaatactaaacatcacagtaatcttataattttttcatgcctaactccatatcacacatgccatgagcatctgccactgacatgaaggatgcaaatatcagcagagaaaataatgatattcgcaatttacaaatcattagtgtcattaagtgtgttgagagaaaataattaatataaacagcaggtacacttaaatgtatcgccaagggaacaactttgaaaaagcttccaaaagcatataactaaacaatacaacaaacccatgtactgcacattttctacctagagaaaattactctcaatcattcatattgcgtaggtgctaatatgggtgattaggcacctatccttgtcctttgtttcaaggcacctttacatatgtttcatgctacaagctgacttgaattttgctgcacacactaaacgatatggattgaacccaatcctcgaaattacatgcaagtgcagcaaaatcatggaagagaaattagtgacaactaaccttgccaaagctcttgtttacatttttactatgggataagccccaacaacgaatggcatccatggtccttgcagtcttccaaaacacttatatttttttattagaactcagcataggcagcaatagtcaggcctcaggaccagagcagaagcattataccgtgtcatctggagcttgggcaacacattgatcatgtcaaggaacaaatcatgtccaacgaaccatctattagctacaaaacagaaacaaagtaaaagtgtgctaaaaatcgattgaagaaaaaaatagtgcatatagcatacccactttgcaaactgaaatatgcttggggaataatattgactaaccagcatttcatcgaacaccttttggacatgagaatcaatgatccttttgtccctaataatcctgaaaatagactgggaggcactcagacatgtaaaatgatcagcacataactcaatatctagcttttgttgtagatcaagatgaaacgactaaactaaaagggaaaacacagatcaaacatcattttcattgtagattcagaatttgacttcacaaaatataggaagagtaaaatgattttgtaccttcactgatgggggaggggataagatcagctggccacatcgggcttgagggccggatcacgtgggtgacatctgagtggcaggagtgcaggaggcagcgccgtggttgaggtcgaatcgtgtcgtgacagcgcggtgattggacggcgatgcgggcggagtggaggaggcagcggcgggtattaccggtggaagatggacagcgacggcggagaccgcgaggaggaccggtgcccggcgccgtgttggagtgaggaggatatacaaaggggaggggaagaatgggagatgcgatagctccggcgaaacctccggtgccgatggatggatggatgcgcggtggcggggagaggcgcgttcgttttgaggatttgtcgttgctgtgcggatgcacggtggattgaatgcggcagaggcggggtgcgcggcagagatggcgcgggtggaggggaggaatcgcgcgtggacggcggtggagaggataaggtagctaatcggtggagcgaggaggatagcgaaacaaattgatggttgagatgagatgagatgagatggcagatggacggatgagatgaaaggggttgatttcacctgtaggattgtcaggcacaactcctccttttgggaccacctatatatttgtcgacaaattttttcctaaaaatttgacagatgtaattatagtataatcgtagtgtaattacactgtaacttctatgtaactacagtgtaacttgtatgtaagtttcacgtaatttttaatcgttagatctattacaagatttgttttggtaaggaagaaaaaaaatcacagcacacatatatgtgaaaggatttgttcccacgacctctattttaccgaaataacatgttaacgagagattcttgaaagttatatacaagttacactatagttacagtgtaattacatgcaagttacagtgtaattacactatgattgtactgtaattacatctgacaaatttttggaggaaaatttgtcgacaaatatatagcaaattcgtctcctttttatattagtatatatatttttgtcagacccatgaacgaaataatttgatcagtgccaacaaccaatcctcataccatttcaattattacgatattacatactcgatcgtgagtattcaaattcagttggaagaactttaatttaaattaacacactaattaaaattaacacacatagtagttgtttttttgggagaacactctacataaaaaaaggtcaaaattactatttcgaaggaatcaagaacaaattcagatgaagcagtaatattggcaccgcagctccacagagacaggcgcctgctaaatggaaagtttgaagttttttctgaactaatagtggattccttcaaccgagttaaatggacaagcacaaagagatacgaagaagaaaaggaaggaccatgccgtgtgggtatggggtacccataatctccacagtagcccctgagaccttcacagtcgaaaagataatcttgtctcgaaccaaatttctccaaagccgagtgcttcaatcatcttcgatatggtctcccgagtacttttaacaaagataatcttgtctcgaaccaaatttctccaaagccgagtgcttcaatcatcttcgatatggtctcccgagtacttttaacaaatctgaagattgtggaaggctgaaaaataaagtcagctgcatcaactagatgcacctaataggtgtagcccccgactatatgtggttagttgaacaaactaagcatatagtcaaggaataaataatccaactaaccgaatggttttgataattatagtcaaccaagtgacttgatatcaatatatagcatatgtggtgtgaatcccccaaataacatgatctaagtgatataccgactactttgtaaaaattgatgcgaacaacctaaagttgactacatcattaaaaattcacataacaaaacagctataaaaaagcttgtatgctttaaataaagaaatttccaaagtattgggcatacaccatgcgcacactgctttaacaaatgtgcttaagtctctaaaacacacatggtttcaccacacctggaaatatatagcatatatggtgtaaaatccgagtaaataaactcataaaggatttaccaaccgcttggaaaatgaccacaatatataatcagcctaagccataatattagtcaataaaaatgcacacttacgtggcaaaaagcaataatatagtatccgatcaattgcttgataaacccaaatagcgccttgactatataaaaaagccagtgaggcagctatataaagctttactgtgaggcaccttttaaaatgcattgtaccaactccaaaaaagttgagtaactacggtataaaaggattttaaggtattgggcacataatcacgcgcacttttgcctaagcaaaaagatgcctaagtccctaaaagaacgtgacaggccacacctgaaaatatgggatgcagacgtattaggcctagacctaaagtatatctaccgatacccttaaaatatgatgtatagaacacgccaattaatatgctcccgagtgacaaatctcccaagtgatgtagatcaactgctctcatctgagtggcttctgatccgagtaattatccctcatggagaataccaaagtagatatgataattaaaatcccgactggcgcaagtactcagctgatggccctcacggggaataatgagtggtacagtcattgagcatgagaaatcaactcatgaccatgaatccatgttgaatatatccagaacaagtctaaattgaagatataatccccgcgtttgcgttgatgagcccccaagcttgtagattatccctctgtagtagtcacaattgtccattgatgatagctgatgcagtcggcatggagacgaaatgaccaacatgaagatgatatcacccatcaaagctaacgaaaatgttggtggtggtaaagacaatgacaccaatcaaaggtgatgaagtcacacagccgtggaagcgaagaaaccagtcgacagaagacaagtcagccagcaatgaagatgaaggcatccagcaacaacgacacaattatgcagccatggtggtgagataatcagtctgtgaccgacgagccagcaatcggtgacgacgagaacaagccgacaatgaagacgtagacgcacaccaacagcaatggcgaaatccgtcaaacatgaagatgaagaaaatagtcagcgacgacaaacgcaaccgacggtaatgacgattaacagcaacagagatgatcaaatatgatgttgaagttgcccaccaatagcagtagagttggctatgttaaataagcttgacaggatgttgatgatgatgacgatgtcggtgacctagtcaatagaagtgtagcagccaatgataatgacgaagacgctcatcagcatttgcgtagtaggtcaaccatgaaggcgaaataactagtcggcaatgacagaagcagccggaggtgaaaacgtagccatacattagcaatggcggagacgtcagggccgacgaagtagaggtgctggtgatgatgtcagtgacaataatccatcaaactgtcgagaagatatcaaagctcgagtagtttccttgatgcgagcgtgtgtataaagaagactgatgcaacgcttcttgatttatgaagacttaatgttgtagctgttggagatgcttcacttggaggaaagtagatgatgctgtctaactcgttgaatctgtgttaattggttgataactccacaaacgcccagacatgtagataaaatctcaaacttgatacttgaaaaatttggagaagccaaaatttctagtgaaataattggagttactcaagtagaacgccagctctaaagcgaagacaaaactgataactcctggagttgactcgttggctgattaattgattgcttcagcttgtcgaattttgagagtcttgtatttgtgtagcccccgacactttggttagttgggaaacaactgaacatagagtcgagaactgtagttttttgtcgtcaagtagtcattgcttgagtgaagatacgtgttaaagatgtccaagtagaaatattgaatattgaaataccacttgttgtagtaaaataacacggcatcatatttggtgacgcatgccaagatgtcagagctcttgccgacgttgtggttggtgaagtagcaaatcttgcaaagtggaggcaatagagtttgccaatgaagaaaacaataaagatgaagtcgctccaccatggtgacaaagtgcatagccgtgatgaagtgaacacgagtcagcggcaacagaagcaaaccaatagcgaagatgcgtagtcgtgaagataaaaacactagtcggcgatggcgtaaccagacggcgacggaagaagctgaatgatgatggaaacgaagacgtccttgaacggtggcaaaataggccagctgtgaaagtgaagacaccatgggcagcagcgaaggcaaactggcgatgacgatgttgccagtcaatgatgacgaagacgcgcagccatggaggtgaacaaaccagtcggcgtcagacaagacggccagcaatgaagacgatgacgcccatcagtagtgctagcggtatataccagctgtagaggcgaggacaccagtcaacagcagacgagacgaccggcggtgaagacgataaagccaatgaacactggcagaaccatgcagccatggaagtgaagaaaccagtcggcagcagacgtaggcacccaacaatggcggcataataggccagccatgtaggcgaagacaccagtcgacagcggtgaaggcaagccggtcggtgaagacgtagacgcgcaacaacgacagcataataggctagccgtgcaggcagtgacaccagtcggcggcggtgaaggcaagccggcggtgaatatgtagacgcctaacgacggtggtgtgaccaaccaaccgtataggcgaagacaccagtcggtggcgacgacggcaagccggtggtgatgttctgactgatccattcctggagtgtaagagataagcttaaagccatgaatcccttttatgcgtatttggatctggatcctgcagaacaaacatataggatgagtagtatctgatgtacatataatactaaaaaaaattcaagtattttaaaatgtttataaatatgtatttctcctcttgtcaatcttgatttctcctattttacgtttaaatactctgcccgactagtcatagccccaaagcaccgggagtcggcctaggcacttcccaaacatgcatatgggtggcatgagttcgtcattactggaaccaagtttcacggatcccgtttactactcaggtacttttgcaattgttaagagtagaaaataaattatcttatctctatgcttttgatttcttccgagtaatacttagcaccttgcgttactcggtccatccaacgagcccccatgtgctaggaatcggcccaaaagcaactatccattgacaaaccaaatggaaagcataggaagatagaactccataacttgataggcactttattgttactcggattatttcgcaagcaatcaagataaatattatgaaaattgttgaaaaatatgatataacatctgtagcccccgactcactagtctacagcgaacctgttgacatagtgaggcagaggagaaggaaaatatcatataaagaaaaaaaataatgaattagctttgtaatattcctcttgatgacggcagaggtgcctgatgtgggaacaaagtcgtccatcaatgataatgaaaacaccagccggcgcggtgcaagcaagccagtggtgtagatgacgaggcccatcaacggcggcggagtccgccaactgtataggcgaggacaccagtcagcggcgacgaaggcgggccggcggtgaagtcatagatgcccaacaacggtggcataataggccagccgtgtaggcggagacaccagtcggcggcggtgaaggcaagccggtcggtgaagatgtggacgcccatggacggtggtgtgaccgaccaaccgtataggcgacgacaccagtcggcaacgacggagacaggccagcggtgaagtcgtagacgcccaacaacagcggcataataggccagttgtgaaggcgagagcaccagtcggcgtgacggacgaggtagccggtcggtgaagacgtagacgcccaacaacggtgatgtgaccgtcaaaccgtataggcaaaagcaccagttggcggcgatgaggcagccagtcagtgatagagtacaggcgatgatacatgcaaagacaagaaattgcacatcaacctgtggttagatatttgtaaaaagaaaataatttatataataactaatagatccaaacacatggtttgatttgtgcttgacgaagaggcttgcatgaccataaacattaaagcatgtgctcggttgcaatggcttctccatctgttcagcagccgtccctgtataggacttgtagagccatcaactgcatggtcaaaaggactcggccgaaccgacgacagaaaaagtatacgcagataatagattaatctgggaaaaaaataaaatcaaagattaattttaataatctgcagattgaaacagctaacccgatccctaaatagtttgatcggtgtgtaattcgctgatcagcctgttggtctagtcccatataggcaccgctctgcctgtacgcgtgtacagagacaaccgagtgatctaggcaatagcagtccggaggatagaccaaaccatggttgcatgcaaaataaaagctcaatatattagtcagattaatcagtagcggcatttatagcacagcatatatatcgatgcatgcatgcaacatgcacgcgtgctaatttgcatgtccgtgcgtctggcaatactccatgcataaatctgcccgtggaggccgcagggcaagatgggacgcaggagctctcctcaggcgccgagtcatcggtgatacgtccatgtggaggcgatcaatggatctcatcagccgccagtgcatgcacgcaaacaaagcatctcacagaagatcgattcatgattagaaatcaatctgataataatatattgaaacgacaaaccggttgatgtttggagtcatcgaattcgttgagattaatctcaacgcctattttagaattgattccatcgcactcgtcgacggaaaactcgatgcatccccaacctagcacgccaactgtcgaaacatgaattcggcaataataaaaaagggtagcgcactagacctaaaattggatggatgcggagacaaaagatttagacaggttcaggccctctcaatgagaagtaataccctactcctgtttagggatttgaatccgccgagtgtattatggatctgacgatctggttgtgtgtcatatgccctctagagggcctcctgcccaccttatataggacggggggcaagattacaagatagaaaccttaaccaatacggtatcggtttcctaaatctactttacaatattatcaaaccagtactttaggccgttccgtaatatacaagaaaacgtaatacccaagttatgatctgttacatattccatagatataagctatcccctataactagtcggataaccatgccgtgtgggtatggggtacccataatctccacaattattataatggaaataattaaggaggtaactctggctcggacgtccgatgtttggggaaaaatcgggcgctgacgtcagcgtccgatttacgtgtaaaaactactttaaactgatttttctcttaaattacttatccaaatcatgattcgattgcaccattaaattcgttgcaattaaatctttaaaacaagaccacacatggatatattccgacgaaattttttttagcttattattgaattatttttaaatgttgcacgatgttccaccaggtatatcagaattgtttcactaaatagatcgaaaatgtttcactcatttaaatcgggtgttgtttcaccttatataaaaataatgttttagcaaatagagaaagaatatttcagttcactgcaacatttgatccatacatagtgaaacattataagtacactaggtgaaacatttttcggtggaacaaaaaatgaaacgaattcccttgatagggggtttctaaaatatatgggttttttttgttgcaatggaatatttcagttcactgcaacattagatctatacatagtgaaacattgtgagtacactaggtgaaacattttctgtggaataaaaaataaaccaaattcccttaatagggggtttccaaaatatgtgggtgatttgttgcaacgacgcgttccataatatcaaaatccactgcaacatttgattcgtacatattgaaaaatcgcaagtacactagctgaaacatcataaacctactggttgaaacatcaaacgagatcatatgcaacattcaaaaaaatatcaatatagaagctaaaatatttttttatcaaaatataatcatgtgtagtcttgtcgtaaagatttaattgcaatgaatacaacaatatgattggatcgtagattggataattagtttaagagaaaaattgttttaaaactagagcaacaggaggcgcgggcgccaaggcgtccgatttttttttctgacgtcggacgcgcggcacggggtattctccaataattaaccatgattacgtcaaacttgtaaaatgtatcacaaagcttatatatatatacttatgtcaaagcaaatttatttagagaatttactacgtgcatgtcattatatcaaatttactatgcatgtattgtattaagtacaagtttactgtatatttattcattcagtaaatagtcccactgcttcacggatatcgattccacgagctggcaactggtaactcttcctattgacttgcatcagtagttacttttgaaatctgaaaatacaaaattttaatggttttctaagtaaatactactatgtatcttatgtatctttatcgtaaaatgaccagaacttaggtagaaatattatttatttagaggaccctaaaataaaaaatttttgtaggggtgcttgtgtaaaactagcaggagaatttaaaaaacacaattggattttcaatgtgaagaagtcacgtgaacactctccataatcccttttttacaggaaccttttttacttctgcttgtgtgtaggctttggtggcaaggaaggagaacgtgtggatcgtggattccggttgttcacggcacatgaccggtgataaaaattagttctcctctcttaaaagggcatccaaaactgaatcgattatctttggtgatgcttctaca

SEQ ID NO: 35151 - DNA, 868 bp, Oryza sativa
cagcatggcatggcgcatgccggtgcgggaaaggcactgtagggcggtgcgacagacggtgggcgcgggcgatcggcgcggaacggcacgtacaggcagaagacggcggagaggcggggacaaatggggatggccggtagactcgtcgccggagtagacgagtggctgacgagtccgtcggcggcggactcgtcagcaccttcagcaggatgttgcggtcgagcaggatgttggccggcttgaggtctcggcgcacgagcgactccggcttggtctgatggaggaacagcagcgccgtggttatctccgccgagatcctgaaccgctggctcctcgggatcgacgggcgacggcgtgccggaatcttttttctttttatttttgtctctgcccgcttctgaattttctgatctgatttggcgccgcgttttggactttgggaatgtggttatgtgctgcatatgtagtatattggtttctctttggaatgttgggtaaagaattttgtcgagagctaacttgcacacttgtatatatgcatggccttaatttgcagtcgatggcttgcatcatcagtgattttgcagccgtccaccgaggcgcggcggtaccagcagccgccgccggcgtagctagacacgtacgtggtgcagatgcccaaggtcaaggtgttccgcgtcccgccgccggagaacgcgcacctcttccagcactacacccgccgcgcgcgccaggcgccacgcccgctgctcctgcgtccgcgtctgctcctggctcctcctcatgctcgtcttgctcatcgtcgcgctcacggccttcgcccccgtcgtctacctagtgtttaagcccaggcagttggactacacgc

SEQ ID NO: 35152 - DNA, 718 bp, Oryza sativa
  unsure (1)..(718): unsure at all n locations
actataaggattaagctcgggcctctgttgcaaagcactaccgtacttccacatgtctagtgggtaaggcttagtttgtagctcagactggttataaacaaaagtacacggatgnagatggacgaagtcgggggtcgatggacatctctaggacaaatgaaggctacacgagctgcggcccggtagtcgagatgtcatggcacagggttggtgtcctgctgctagggggctcagtcctgcctgcctgtcccgggggttccggccgtaggtgggattgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcatggccttgattaataatattgtatagctctaggatcgtgtttacaaaatagctttgggcaagtaagtgacttttaaatgctgtttactgca

SEQ ID NO: 35153 - DNA, 785 bp, Oryza sativa
aacattgccgccaaatcttccgatcaaccttaagtgtagggtctttcaaatatttaatcaaaggaattctccaatcctcttctgtatcctgggcacaaatgtccgaaattacaattagttcggcctttgaatcaatcgggacgtgccccccaaccttctgtctagaatcggtcagaccggcggcatacggccggtcagaccgcccgggttggccggtcagaccggcggcatacggccggtcagaccacccctagtcaccggtcagaccagccgtgcaacgcaggttagaccgcccccggtctgcatttttgccaatttcacccaaaggtttgaaatcaagcaccggttcttctaatataaaaaatactcccttcttcacattataaccatatgcttgccatgctaaatgatgtgaccatggctatcattgataaaaccattgctcacatcatggataaacaagatgataacaagatcaagtcctccaattattggaatccaattcggccacctgctactgtgctgaattcaaatggccgccaaatgtgcatacgagctccgttttgggtccatgagtacttgatagaaagctcacggagtcgtctttccaacggatctaccctcattgccaaattccttcttagtgggctgcaattgcagaaacaaggtgttgcgtcacctataatgggccaagtggggcccatgtggggtgtgccccaaccaggtggagcatgaccctagggtccccttggttgtcctcctacctccataaatagctaggtacc

SEQ ID NO: 35154 - DNA, 618 bp, Oryza sativa
ccccccccccgcccgtgttgcgcccgtgctcgcgctgacgacgcgcgcccgaccgcgtggggcccacgcgtcaggccgccgtcgccttcttcctccagccgccgcccggcttccctctctcccgtgaaccctactccttccctccctcaaatccgtgtgattcgctcatgggattccaaaattaaataggggaaattaatccccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttatctcgttttagccccatcccgagcctccccgtggtccctagctctctccccgccgccctcctctctctcccacgctgccggccgcctccagccgcctgtgccgcctcgaccgtgcgccggccggccgcgccgtcgcctcctccagcgtcgccgctaccccctccaccccggcctgccctccgtttcccgcggagacccccggagctacgtttccgccgtcggcctttccttt

SEQ ID NO: 35155 - DNA, 630 bp, Oryza sativa
ccggccaccccatgtcggtctgaccggctacggctgtggggcccaatgacagccgttgtagagtagcacagtttgaccggccacatacctccggtcaaaccggcagagcacagagttgggggatttcgcccccaacggctagttttggttggtgggagtataaataccccccctccagcagcaaggggactctcttggcacccaattcaattgcatacaccccttgcacctctctcacacccacttgagttttgtgttcatacatctagtgtgttagagggttaattagccaagagtcaagtgcattgcttccatttgtagagctagtgtggcacttgattgatcatctccacgcagggtcattgcttgttattcttggaggttcccgcctcctagacggcttgtggaggagttgcccggtgatctctccgagaagattgtggaggaggtccggtgccggttgtgagtggtttggagttcaccaccttcggagtgaaggaagaactaccctagtgatcgaggcttgggtagtcctctccatgggccggctcccgccttgcccaccccttgacaaagggggcgtgcggtggcttcgtggttgagcggcggagttgggctcgcttcaacggg

SEQ ID NO: 35156 - DNA, 4957 bp, Oryza sativa
  unsure (1)..(4957): unsure at all n locations
tgatatatatgtgaccatcttatgctcatgaatgaatatttcttgaagttcacattgagatattgctcttgtgtttgtgatatgttgaaatgtgaaattgaaattggctccatatttgctattgttgttatgcatatgtttagggggagcttttgcttgtcattacaatatatgtccatgtgctctatgtttgattatatatatttgtggtgtttgtcatcatttaccaaaaaggaggagattgaagcatctaggccccggtgttaattttggtaattaatgacaagcactaattgtggactaaccattgtgtttgagctatttgtttgagttaggttcagttatttgtgtgcacatggatgatcattgatggattaaaattgatggcgcaaagcaaaaggaagagaagacggtaaacaagtgttttcattttaaattgctcgaggcgttgggcgatcaaaattgtgctagtttatttatagctttgccgtactattaagaggggtaatgacctagcaaagagatgattttaattgccacattaggtcattatgcatttagacttgtcctctcatttcatcacacacacaatcatttatctcactgttttcggcctgaccagggccggtctgaccacggcccaagtgccggtttgaccggcaagggcactagtctgaccgcagggtctaggccggtctgatcgccgcctcaatgccggtctaaccggccggccatatggccaggatggtgccatcccggtgtgccgatcccgagccgccggagccgtattcggtcagaccgagctgatggcggtctgaccgagccgaggccggtttgaccggccaccccatgtcggtctgaccggctacggctgtggggcccaatgacatccctacaacggctagaaaactagccattgtagagtagcacggtctgaccgaccacatacctccggtcagaccggcagagcacagagttgggggatttcgcccccaacggctagttttggttggtgggagtataaataccccccctccagcagcaagggaactctcttggcactcaattcaattgcatacaacactcaatttaattgcatacaccccttgcacctctctcacacccacttgaactttatgttcatccatctagtgtgttagagggttaattagccaagagtcaagtgcattgcttccatttgtagagctagtgtggcacttgattgatcatctccatgccgggtcattgcttgttactcttggaggttgccgcctcctaaacggcttgtggaggagttgcccagtgatctctccgagaagattgtggaggaggcccggcgccgattgtgagtggtttggagttcaccaccttcggagtgaaggaagaactaccctagtgatcgaggcttggggtagtcctctccgtgggccggctcgcgccttgcccaccccttgacaaagggggcgtgcggtggcttcgtggttgagcgccgcagttgggctcgcttcaacggggagtaggaacccggcaagtttccgaacctcggtgaaaaatctctgtctccttgtctcatttgattgtcacattaacatttgcgcaatttatatttttagagacattcttgagatcatatcaccctaggattgctaaacatagacatagcagtgtgatttactttcctagagatataattgagcccctgtcaccctaggtatgcatatcataacttagttgctaagttagagttgaccctcccaagccaagcaatttaggttagttttgattaggtgtcatttagttttaaccgtcaattcacccccccttctagtggcattttggttccntcaaagtggtatcagagcttggtctcttttggattgggcttcagcgcctagaaagaagatgtcgancgaggtgaaccatgtaaggaaggctcccaagtttaatggcacaaactactccacttggaaaattaaaatgtctactcacctcaaagctatgagcttccatatttggagtattgtggatataggctttgctatcaccgacacgcccttgacgttgattgatcaccggaacctccaactcaatgcccaagccatgaatgctttgttcaactctttgagccaaaagtagttcgatagagtgagcaaccttgagatcgcatatgagatttgaacaagtttggcggagatccatgaggccagaagcgagtacaaggatgccaagcttcatttcctcaagatccaatatgagacattctccatgttgcctcatgagagtgtgaatgacatgtatgggaggctatgccacagcaacctcaaggaacacctcaacaacgaccatgggcagatttgattgcagatgtcatgaaggagcagtttgggcttaggccgaaagatgctggaaatttgtatcgacaaccctatcctgaatggtttgagagggttccactacccaatcggtttaaggcaccagaattttcaaaattttcaggacaagatagtacatcgacttacgagcacattagccgatttttagcccagtgtggtgaagcatcggctgtggatgccctgagggttaggttgttccggttatctttgtctggatcggcctttatttggttttcttctttaccatatggatcaattaacagttgggccgatctagaaaaatagtttcacaactatttttatagtggggttcacgagatgaaattgtccgatctgacatcgatcaagtagagacatgatgagcctgtgcatgagtatattcagagattcagggagatgaggaataagtgctacagcttaagtttgactgatgcccagttagccgatttagcttttcagggtatgattgctccaattagggagaaattctcatctgaggattttgaaagcttgtcccatctcacacagaaggtaaccttgcatgaacaaagatttgcagaggctaggaagaattctaggaaggttaatcatgtatgtccttacatgtatgggtcggacgatgaggatgatgattctgagatagctgcagcggatggggtaagagcaaaaggattataccatgccaatgggtaaagaactctagaaaagaggagaggtatgactttgatatcactaaggctgacaagatttttgacttgttactccggaagaagcagattcaacttcctactggtcacacaattccatcggctgaggaattgggcaagaaaagatattgcaagtggcataattctgggtctcatacgactaatgattgcaaggtcttcaggcagcagatccaagcggctattgaagggggcaaaatcaaatttgatgactctaagaggccgatgaaggttgatggcaatcctttcctgttaatatggtgcatacagctggccgaacaaccgataggggtcgtgcaagaggttttcaggtaaattcggctaagattatcaacaaatatcagaggaggtatgaaaagtagcaggagaagcattatgaagaagatgacgatggctttgatcctcattggggttgcgagttctttagattttgctggaatgaacgtatgaggctgccgtctattgaggactgtcctgggtgcagttatgttgcgaagagctcaagccgatcatatagtaggggcaatcggctaaagcagacaagacttcctgttcatcaaaggttgggtctagtgaaccaagatcatggctaggaggacgatgaacataggaaaactcaatggtgtccttccggtatctttgcggagaatcaatagagaagggttcaaagattgaggagcagggagccctttcaggaagtcgagcaggaaatcaaccatcggttgaagaaggcaaagccgaagcaggagtggcgtgttaagaatcaagttcctgtagctgaggaagccccaccccatgaagcaaaaaggttggccaaagaaaaaagtgttgtagctgcttcggtcatcatggttttcacattgcctgccgaatctgggattaagcaagaagatattgtcgaagttgaagaagaatcggctaagttgattttttcaccagagcaggcagttttcgagaaggcagaggggacggagaatcggcatcttaagccattgtatataaatggttatgtcaatgggaagccgatgtccaaggtgatggtcgatggtggggctgcagtaaatttgatgccttacactacgtttaggaagttgggcagaaatgctgaagatctcatcaagacaaacatggtgctcaaagactttggcggcaatccatcagaaaccaagggagttttgaatgtggagctgacagtcggcaacaaaaccatccctacaatgttctttgtcatcgatgggaagggttcttatagcttgttgcttggaagggattggattcatgctaattgttgcattcattcaaccatgcatcaaggcttgattcagtggcaaggtgacaagattgaaattgtgctagccgacaggtcagtcaatgttgccagtgccgatttagctctttgggagatggatggtcttgattgtttatctggaaaagtttgggatggagattttttaaaagtgtctgattctgatatatagccaattgaagatggagaacccaagctattattttgagggcattgtggagggttcagatgtctacaacaaggacacagtagatgatctcgatgacaaacaaggacagggttttatgtcggccgatgattgggaagaaattgatataggtccaggtgatcgacctaggccgacatttattagtaagaatttatctgcagaatttagaaccaagttgatagagctgttgagagaattcatagattgcttcgcttgggagtattatgaaatgcctggactcagccgatcgattgttgaacatcggctacctatcaaaccaggggttaggccacaccaacaacctccgaggagatgcaaagctgat

SEQ ID NO: 35157 - DNA, 10292 bp, Oryza sativa
aatttgtctggaaggttagagcctattacaccattgttgagattgaaagccaatcagcagtttacttggggggcagagcaacaaaaggctttggataatattaaggaatatcttaactctcctcttgttttaattcctccacagaagggaataccttttagattatatctatcggccggtgagaagtcaatcggcttagttttgattcaggagcttgaagcaaaagaaagagttatattctatatcagtcgtcggctcttggatgcaaaaattagatattcccctgtggagaagttatgcttgtgcttatatttttcatgtacaaggttgaggcattatctgctatccaatgagtgcactgtcatatgtaaggccgatgttgtcaagtatatgttattggctccgattttgaaaggaagggttggaaaagtggatattttccttaactgagtttgatcttcgatatgagtcgccgaaggcaattaaagggcaagctatagccgattttattgtggaacatcgtgatgattcaatcggctcagttgaaattgtgccatggactttattctttgatggatcagtgtgtactcatggttgtggtatcggattagttataatttcccctaggaggacatgtttcgagtttgcttatactatcaaaccttatgcaactaataatcaagctgagtatgaggcagtgctcaaagggttgcaattactcaaggaagttgaagccgatgctattgaaataatgggggattctttgctagtaatcattcaattggcaagagaatatgaatgcaaaaatgatacattaatggtttgtaatgagaagtgccaagaattgatgaaagaatttaggctggttactttaaagcatgtgtcccgagaacagaatattgaagctaatgatttggcgcaaggggcgtcggggtataagccgatgatcaaagatgttaaggtcgaagtcgcagcaataacagctgatgattggaggtatgatgtgcatcaatatttactgaatccatctcaatcggcttctaggaaattaagatataaggcattgaagtacactttattggatgatgagctttattatcggacaattgatggggtgttgcttaagtgtttgagtgccgatcaggctaaagttgcaatcggtgaagttcatgaaggaatttgtggtactcatcaatcggctcataagatgaagtggttacttcagcgtgcaagatatttttggccgacaatgctggaggattgttttagatattacaaaggatgtcaagattgtcagaaatttggagcaattcagcgagcaccggcgtcagctatgaatcctatgtcacgcccagaatttctatccaaaattccaaacgcttacatgcgtgttaaatccacctccaggaatcagccgaggcacacaataacaaattgataatagagtactatcaaacagttaattaatattcgcaaaataataaatttttacagtggtggatagttcctctcaaaagaatagaattctacgcagcggaaataaaaacaaaagactgaacagctatggcgactccactccacaatggcgactccactccacaagcaacttgacccgaacaaagcctaatcctccggaccatcaccttcactgaagtactcctcctctgatgaatgaatattgcaagaatgagcatatgacatactcaacatgccacacagcagatatgcaagtgcacaggataacaaaggatggcataataaagcttatttgcataaacagcaattaataaacatttgagagaatagtaaaacagttaagtaattaagcaatattaaataaacactatacaacacacctatgttgcataggcccaacctcatctgaacagccaaccccagttgtacaaatcaaacctccataccaggaatataccattccaaaccaggagtcaatttaattatcacaagttatcaccagtaatgagtagggtgagactaatcacgaaaaacattgttagacccgcccataaccgcgggcacggctattcgaatagttttactctggccagagatgtaccactgtacccacaagacatagctccacaacatgttaccatgcgcctcaataccaccacgatacctcggaaaggaactgtgacaatacccctcgcacaacacaactcaccacagtgcaccacacctcgatcataatcaatccctctacaaccagaggcatggactccccagcgacccccacggacttctcgctgcttctcagtctggcaccccataatgaaccatgctatacaaaaggtaaagccgttgcccacgctggcttgtggttggcacggtaaatgtttcacaacagtagctcgtgaaccggtccttaattgtcatgagcgcgaccatcaaaaccatgtgctcacaacccacctttaatcaggttttaattattaattaattatcataacacgattaaccatcgtgagttaccattaaatataaccataattaataatgtagtatgattcatcccattaatgagctaatgtttctaagcatgactaagcaattatatatatagcatttagctgaaccaaaccaatatataaggttctagctaatcaaattataacccataggaaaataaagtcatcttcggccataattaattgggaaaggctcaccacctgatgacattcgaaaataatgcataagttgaaataaaacattagctttaaactggttcaacatgctcaaagggttgtttgggatctatgtgacttgcattgagcttcctcaaatgcttctgaaccttcctcaacgtaaacgctctcctccagaacgtcggaaactagcaaatgaacaaaatcaacaaaacagtacaaaaacaagcataaacagtacatgtggatatttttaacatgtagatctcgattttttatgaatttagcaacttgaaccacttgaatccgagttatgatgatttagttatgaattttctaagtttaatcgattttaatctactaaagaaaaaataataagaagagttatgacatcatcgatggcatcatcgccggccatagctcggctccacgcaaccaccggcgatagagtgcttggccgggctatccgaggacacctctgcgaagaggacgacgacgcgaactcaccggtacaaagcacaatgacggacgacgacgaacgacggccggcgacgaggtccgacggcggcggtcttcggcggctgcgaaggggcggacggggtgctcctccaccgtgtgaacccgatggcagcgacggaaggcggcggcgacggccacagcagcggcgaggcgcggctgaaacggcgtcggcggcggcggtgctacgggcgacggctgcggctaaaacttgaggcaaatggaagaggacgactaggggatgctttatataggcttggattagagagatcggactccaaacgagaggatttgagccggaaaatctgagggttagtttggagagataaactcgaaaacgaatttgattcggataaaaaagaaagcaattagctccgattcttggggggaaaagatagaggacaacaaaggggcaaaaaaacccctcaaccaatcggactcggagatggccggaggcggcggatttggtagggaacggtggcggctcggtctcggcttggccggccggaggttgaagacaaccctgacatgtgggccccatatgtcggcggctgaggggaggagtgggccggcggctcggctttggccgacttggactgcatggcgcgcgcgaggagagaggagttgggccggaaacggcccaacggcctacgggagggttttaaagactttttcaattaaaataattagtggaatgatgtttcatttattaaaaatactttccttgctcaaataattcccagaaaaatctagaaaatagataaccaagcaaagtatttactgaaattttatctagctcaattttatgttgaaatttttcctagattattagagttcaacttgtaagcttttaaaataatttctaaaaatgaattaaagaatgaattattaaaataggcgattttcagggcgtgacatcctatcattaagccatggccattcagaggttggggaattgatatgatcggcatgataaatccaccatcgagtaaaggacataagtttatattggtggcgaccgattatttcaccaaatgggtagaggtgattcctttgaagaaggttgattatggggatgcgatacagtttgtttaggagcatgtaatctaccgatttggtattcctaaaacaattacaaccgatcaaggttcgatctttgtgtccgatgagtttgttcagtttgccgatagcatgggtatcaaattattgaattcttcaccatattatgcacaagctaacgggtaagccgaggcatctaacaaaagcttgattaagttgattaaaaggaagatttctgattatcctcggcaatggcatactcggttggccaaagcattgtggtcttatcggatggtttgtcatggatcgatccaagtccctccttataaacttgtttatgggcatgaggctgttttgccatgggaagttagaattggctccaggagaacggaattacaaaatgatttaacagccgatgagtattataaccttatggccgatgagagggaagatctggttcagtcacgtttgcgagcccttgcaaaggttactaaagataaagtacgagttgctcggcattacaacaagaaggtagtacccaaagatttttcggaaggtgaacttgtatgaaagttgattttgccgattggaactcgagatagcaaattcggcaagtggtcgctgaattgggaaggaccgttccaaattcataaagttgtatccaaaggagcttacatactgcaaggacttgatggagaagtttatggcagagcactaaatggcaaatacttgaagaaatattacccaagtttttgggttaacgcatgatcggctaaggttgccgcagaaaagctagccggcgtgtacgcgccggcgaggtgcacgccgcgcagattttttttttccagattttttttcaacgtgttaacgtaactaattcgtttagttaaggataattatagaattaacagaagatttttttaattgaaatttttaagttagatttgaaaactttcgagttaaaatttaaattttaaggtcaaaatttgaaaacttttaacttaaaactttgaaaaaaattttaactcaaaattcaaatttgtaagttaaattttaaaaactttcaactcagatttaaaaattttcaacttgatatttgaaaactttcaactcgagattgaaatctttcaactcaagatttcaaaactttcaacttagatttgaaaactttcgactcaatattcgaaaactttcaatgcaagatttgaaaattttcaacttatatttgaaaactttcaagccaagatttgagaactcttaacttaaatttaaaaactttctaactcaagatttgaaaatatttttaactcaattttgaaactttcaactctaaatctgaaattttctctcttatttttcaaacattaaacttaattttcaaaccttccaattcatatttaaaattttcaactcaactatttatttatcattctataaaaaaatctaattagtgctaaacaaaagggattagtgctaatctctatagattagcggcattcaacgcaaggctgagccgtattccagggagcaggtgcgcgcgactttacgttgcggcgcgtacgcgccaattagcatcccccatgttgccgatacatgatagccaatgtgtttacatcgccttgagatggccgatatggttatatcgcccttagatgttttcatattgtaatcggttgtgatttgccgatgtacagtggccaatatggttatatcgtccttagttgttttcatattgtaatcggttgtggtttgccgatgtacaaatggctgatattgttatatcgcccttagtcattttttataattttatcaatgcttttgacattgtaaaattaggggggcacatatatggaaaattgcaaatttttgagcgaatttagaagttatattaattggcacgaaggattatcaggatagtaaagtactagagtatcttgaccgattacaaaaatttatgaggtctattacaaataaagtcatcgagacaagaattgttggatagccgaaatggccctttgcctaatttgttctacttcttcaatggcttgggcgtcttgagcatcggttccacggatgattttcaaagacttggtcagatcggcaacattcttgatagccgatttgagtctcactttctgctcttcgatagactttgggagatcggccaactttctatgttccatatccagctcggcattgcattcttcaagttgtgccaagagctcaatcttgcgagcttcgagccgatcaatattggacttaatcggacccttagatagctgatcaagtttggtcttctcttcatgaacaagctgtcgattggcttggattgtggcttcaatgtccttgcgctcccgacgttcggctagtcttagcttggccttctccagcttgaattgatgttgttcaagatagactgctggagtaagaacatcggctagctcatctgggattagagctcggatttcatgtagcgagtcctaattggcccacagtttaccaccaagttgtctagtgacgatgcttccagccgatgagatatgtcttcgagtgttttcttcacgtcatcgggcaagagaaccaaagatttgctggtggtgtcttcttctgtttcttcgttaagataatctctaatgtcaaaagagaagagatcggctaaaacctgcagaaacaatttcaggaagattgagagctaagtagatatagtcgatctaattttttgcatcaggaggaaaagtactgggatagcaggagcagttggttgtacttctgcctcaatatgatgactccccacagccgatggagttcggtcactcgacgattgttgtacaggggaagaaggaggaggatgaagcagtaaaagaaacaagtgttatacaaaatccgctgaaatcaactagtaaatttaagaataacttactggtggagctggtttgaaaattggtgctgccgatttcttctttacaacaattttcttcttctgcagctacaaagtctatgagtaatcggccaaaaagtgaaataattacaaaagatattgaagggagctgcttactcttaagagatgagtgggggcagaaggagtcggcgttgtctgcttgggtgaagccgatggtgttctttctgtgtcactcacttcggctgcagcctgatcaacattatcctcaatgtcttcttcatccagagcttgctcaatagatggatccaggacaggcagatcatcggttggtttaggtttcttgagtttggccttcttctttggggctagagttaatgtatctgcggccgataacctcgttcttctcttcttacctgtatcggctggttctctgatgaatccttgaagaagagttgaggtcttgggggcattatagccaatgacaggaggggatggtccacctccattaggaattaaacctggggcatattgaatatttataccactattgctttgatgtggaggggaagattctgttgtctgcaaaacaggaacaaaagattagtcaagtaatgaatcggctgacatttatgtagtttagtaatgacaaagtttacctggggtatgacatcaaggaatagatctgtcatgtatatcgaggccgtttgatgaaatagatgcagcttccattcacccccaccatctgtcaaagtttctgctcttgaatcctgccaattcgatattttcaatactacccagaggaggtccttggaggttaagcagccgatccatcatcagagttgatgagatttctcctcggcactggatcttgtcggcaaagaataagccgattgggagttggcccaatccaagttgcctagctgaactcattgggtggtacaattcatagaagacttgtatgtttctcccttggtgaatgccgacgggtaagatgcatgggctgattgcagctgtgaaaacttctcggactttttggtatctttcatggttgatgtcttcaaatctgaagtctgatggtagtttgaggtctgctgaatattcataaggaaaccagactcgggcatctttttgaaagccttcataaaagctgcagaaccaatccttgagtagttcagccgatagttttgcaccagcatcagctggtgtggatgcatattcttcatatgtcatgcatctacgatgagtacgttactctccatcatcgtctacaatcagctctaaccttagaaattcagcttctgtcacagatggtcgattgataactttcataaccatcagatttagccaagtctgcaatagccaccatggtccacctgctccaactactgagccaacagctatcttggctgatgcatcattcagcatttggtatagatagccgagaaggattctgcccaaaggaaattgtctctttgattctagggcttcggctacaaattgccagttgttcgtagggctgcaactggatccacagaaaagaaacttttctagccacatgagtaaaaaggccacatgttctcgaggagtaacagatccttggcccatatatgctgccacatagccagaccaaccacctatgctttttgtcctgaaatcgaattgattcttggtgttcatactcatagggatagccgatgaagttacatctaaaccgatgatcatggtaatgttgatcaaagttggagtcattggcccttggttgaacaagaaggcgttgatggtgttggaccagaaataggtggcggcagccatcagaggttcatccttagcagaattggctatggtgagggcaagcgcttggccgatcccaatctcatcccagtgaactttcttactaggcgatacgtgctggtaccatttggtccaactcttctcaggggtggttttctcaagagatggccaagacttgaaagtattcttctagttacccagattagggttggctaatctaaaggggattatgctggtttcaccgatgataaaatcagtggggtcaagattgccgattggaccaagaaagtagtggttttcatgtgacaggctgggaatagcaactaggttggaaaggtgctgcaaatccaaaggaatcaagaagaagaaaacaagatgagaaaaggggaaatcgatttcatgcgaggaaaagggatctagccggtgagaacttatctcagcatactatgccgatggcgcgggcggaggtctaaccggagacgaaatcacttggggatcgcctcgagcgtcggagaaatggccggagagagaaaggagaaggttggcttcggcggtgaaaacggaagtaacggggtgaagattttttagggcgacggttagtatttaaagcgctgaggataacggttgggaaacgacagattgcgaatcttgctcggagtggtatatggcaaatccgaaacattaccaaatattccggacttggggggcatgtgttaacaaccaaatttggttatatcagtatcggagatgaggataagatcgaagtggaaccaaagatgaagatcgttgcagaaacagagtaggaatcggctggagtccggatcggctatgattggatcggctaagtccgagtcagactgggttaagtgatacagccgattccggcaaaatgacttgtgtacgacatcgagttgagttgataagcttcaagatgattaccacgcatggatagagtcctgagaaggcaattgtatctattgattaggatattttatgtaaattccttagagatatgtttgggcaaaagtctgccgcaaagacttatggtatcttagagtttgttagagataagagtcgtgtccgatatggacatagtttgttgttttcgggaataaatagaccccgaaccccatgtaatcagttaacacacacgttcaatacaatttcggcgcatcgccacccttttgcttttgttttatttcgacgagttcttgctttcaagttgagctgcatcggtttcgatcttcaacaagaggtaaaacttgttatgatggcttgcattctcgggattagtgcttccatctttatgatactctaatcttgtttatgtaattcgtcgagttatcatatatcttacataa

SEQ ID NO: 35158 - DNA, 5102 bp, Oryza sativa
ttaggttagatgtcgacgttgatttagattatataagatatctaccactctatgaaatttccagcggcttgattgtgtagatattgttcttcttttcatacttaatgctgcatcagttgagtttgatctattaagtcgtgcttagaatatcaatctctagcctgccttctggttgccgattagggtagtatcggggtttcaactgatcttatctggtttaattatatttgctctatatgtttcgttgacatgttaaacctgccctttatattaagatcttattgcatctaagtatattaagcttttgtttggtatattctgcttgttttaatatcttaacatggagttgtatcggagtattagccgatacatgctagatctatctgatcggctatgctatgaacatatatagctttgttgttaatatatatttcggtctaagtgatttatactgtctcggcacgacgaccgatctatcccaatcacttgatttaaatatatatcgacatcaggattatatattgttaatatctacagccgatcgagtagatttagttctttattatctatttataactgccgatcgatttacatatgacatcggcccgaagataaatgatatgtcatcggcacctagccgatcggctatcgtttatggatttaaccatgatttctttgtctttatttcttgttgattgcaggatcaaatcaactagcacacttgcatacccgaaggcgagttttggacctgcactggagttaagcagatctcccaggcctcgtgttttatgtcaacaaagccataaacaccgcttgccatgcaaccaataggctttatttgcatcgtctcttgaaaaagacttcctatgagctaattgttgggaggaagccaaatgttgcctattttcgagtttttggttgcaagtgttatatttatcgaaagggtgttagactaaccaaatttgaaagtcggtgttgatgaagggtttcttctaggttatgcctcaaatagcaaggcataccgggtctacaataagaacaaaggtattgtggaagaaaccgccgatgttcaatttgatgagactaatggctcccaagaggggcacgagaatttgaatgatgtaggtgatgaaggcttgatgagagctatgaagaacatgtctattggagatgtcaagcctattgaagtggaagacaagccatccacctccactcaagatgagccatctacttccgctacgccaagtcaagctcaagttgaggtggaggaggagaaggcacaaaatccacctatgccaccaaggatacacaccgctctttccaaggatcacccaattgaccaagtgttgggtgacattagtaagggtgttcaaactcgatctcgtgtcgcttcgatttgtgaacattactcgtttgtttcttgtcttgagcaaaaacaagtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacgggttggtggtgagaaacaaggcaaggttggtggcacaaggtttcacacaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacttcccggttttgaagatcctaaaaatcctaaccacgtttacaaactctcaaaagctctttatggtttaaaacaagctcctagggcttggtatgaaagattgagagattttcttttgtcaaaggttttcaaaattggaaaagttgacaccaccctttttacaaagatcattggtgatgatttctttgtgtgtcaaatttatgttgatgacatcatattcggttttactaatgaggtattttgcaagaaatttggtgatatgatgtctaggaaatttgagatgtccatgattggagagttgagcttcttccttggacttcaaatcaagcaactcaaggatgggacgttcgtgagccaaaccaagtacatcaaggatctacttaaaaggtttagcttggaggatgcgaagcccatcaagacacctatgacaaccaatgggcatctcgaccttcatgagggaggtaaaccggtagatttaaagctttatcgttctatgattggtagcttgctttaccttaccgcatctaggccggatatcatgtttagtgtttgcatgtgtgcacggtttcaagccgctcctaaggagtgtcacttagtggccgtgaaaaggattttaagatatttaaaacattcctctactattggcttgtggtacccaaaaggtgctaagtttaaatttgttggctattccaattcggactatgccggttgcaaagtggatagaaagagcacatccggtagttgccaaatgcttggtagatcccttgtgtcatggtcatccaagaaacaaaactccgtagccctctctaccggcgaggcggaatatgtttcggcaggtagttgttgtgctcaattgctttggatgaaacaaatattggtggactatggtatatccttcaccaaaactccacttctatgtggcaatgatagtgccataaagatagccaataacccagtccaatattctagaactaagcatattgatattcgccatcacttcctaagagaccatgttgccaagtgtgacatagtcattagccgcataagaaccgaggatcaactagccgacatatttaccaagcctcttgatgaaacccgcttttgcaggttgaggaatgagttaaatgtcatagatttctctaatgtggcttgagatggtgcaccatggttgcttcttttgcattgcgtatatttgctctcattcacgcttatgctttggatttactgccatttggttcttcattacgaaaatgaagcatgtcacattaagggggagttttgcactcttgcatgtgctctacttccttttatatgtgagcaaatcaactagtggtgctagtagtattttcaaaatgcccaagtcaacataagtcaaaacttttacaaaatcaatgtaatttgaaaactatctcttagaaaatgtttcaaaaggtttcctatatgttttccaagcctcatattgcaagaaaaatgtttttttgaatgaaaatgccatttttgcccgcttttgaagaaactagattcttagttttggccaaaatgagattgagaaggaatttgagaaaagtttcaaaacaaagttggtagagaagaggatttgaaatgtttttggtattcaaacctatctcaaaaatcaaacatttcgaaagttgtttgaacatcaaattcgcccaaaaacccctatagaccataaaaggtcacctcctagcactcaagtgagttttgttgcaaatcttcataattttcaaatgttataaatagttggaaatatttcaactcacacatttcaaatttgctccaaaaatcaaatttttgttgttttttattgtgtgggggtagccgaactgtgcaagggttgtgcacagtcggctggagcgggcggtctgaccggccatataggcccggtctgaccggcctggagctgaccagccacatagggccggtctgaccggcctagcaggtgggcccagggtttttaccctttcttctccaacccgactccctctctctccttctcatcccctcacttctccatctcgaattttcttctcctctctcctctcccaaaccctagccacctccctccatcaaaatccattcggtttgaccatagatttctctccggttacaccgtaagtgaatctcctcctctttctctctctattccatggactgatttgagtttttattgagtttgtgatccatggcatggaaccctaggtgaaggaagaggtgttcttcgatttgcaccaatagagggtagtttcttggtgtgattcaactccttcaaccagtaaatcactctccctcttgtgcattgctctcaatcggtctattttaatctctagggttaagggtacttttccccctttgttccaatcttgatgaaatagacctacaccttgatatccatgctcaaatcatgtgcaaattttgtcctagtatgtttagaatcatttgtgtggtgtggaaattttgtggcatgagacttgtcagtggcggtctgaccgggaacaaggaggcggtctgaccggcttgttcccggcagtctaactgggctcgagccgccggtctgaccagcgtgcatcttgcggtctaaccagcaggtacaccccggtctgaccggcttatgtcatccggtctgaccgcccctgacaggcagtgcacaccttacttccatcttgccaagtgccttctaaaattgttgcttatccatcctttgctcctgtttttcagctatgcctccccgcactcgtcgtgatcgtcgtgagcccacgcccgatcccgtcagtgagaatgaggaatcaagcggagatgagtatgttcaaagtgaggatgaaaatatggaaaatgttgagggggatgaggtggaagtaagtagtgatgacaatggtagtgatggtggtgatgacaattgtcacgtcctgataaattcatcccgaaataaaattcattttctaaaaggaataatagaattaattaaaattcggaaagaaattggcaaacactaaaatacgtacaagaaaaattcgaatgtggcctggagaatttttgttaaattctccttggtctaaaatgagccctcaaattttacttgaattttcagagcaccggaaatatttattaaacaacaacaacaattatcaaagttcaataaaaagaaaacctaaaaataatcctcttcctcctttgggccaagcccagctcaaagtctcccctctctctctttcggccgcggccgaagtctccctctcctccctctctttccctcctctcccgggcctcccctccc

SEQ ID NO: 35159 - DNA, 13251 bp, Oryza sativa
tgttcgtcgccggtacgccgaccgacgtcgccgtctcctccgttgacgtcgcagcgtcgccctccaccccggcctgccctcggtttcaccggaacgtcgccgcgaacatctccgtccgcctcgccggagttgtttggccgcccgtccctcctcgcccgtgcaccggtcgggcacacctccaccacctccggcatcgcagcggcaaggtcgtcctcggcatcgtttcccctccatccaaacccctccgcggtccatcatcgtcgtctccgatcgttctcgtcgtcgacgtcccatcggtcgcccggctcgtcgtctcgcggcgccgcctccgtcgtcggcaccgcagcggcgtggtcctcgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccggcgcagccccatcatcgtcttcgtcctcggctccgcgtcgtcaagtctcgtgccggccgtgtctcgccttcgttcaaggatcgccgccgaagtcgttccctcgccgtccgtctccgccgcgccgttcgtcgttgtcgttcccacgcctcgtcgcgtggtggtaaggttctctctccctcgctgccccgtccctgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtcctcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggtttgcggtcgtcgccgaaggttcggaaggccgttctctctgagcaaggcaagtcccatcatccttgaacatattgaatcccagtttataaaattatgttgctttaaattattgcattatcgctttatttaaattcccgcgtgatcactgttttatttagccatgcctatttacctttgttatgaccttaatattattgttattgatattattaccttgttcaccctaggaaaataaaaccccaactagtgggtactctatttatggttccactagtatgaatttaggtagatgcttcgctgattaattaggtaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggttccggccgcaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggtggcttggaacgagctgggacccagggtcgggttgccagttcggtctgaatcatcgtaggccttgggttaaggcaggttcgtgtgggttcatggccttgtttaataatactgtgtagctctaggatcgtctttataaaatggctttgggcaactaagtgacttgtaaatgctgtttactgcaaaacttaacccctatattattaccccttgtacccccttgcattaattattcatctccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgccaggcctgaagcgcctttgtaataatgtaaatattatcgatataataaagatgtgcctgttatatcatgtttgtgtggtgtaccccggcttttcctgggacggggattaatacactagcgttcgggaaaaggcaattttcccggtcgtgacaacaatggcggtggtgatggtgaggatgatgaggcaagtgatgatgggagtcctctcgatcccaccatccaatttatgctaactttgaggaatgctcagcaatacactatcctccgacatcatgatcaattccggaggcctaatgattgtaatgatccaaggttccatacacggttccaaaagtccgtgtatgagcaagtgtatgccaacaaagccttcgccgaacacaagtggatttcttggaggcacattggtgagacaccggagtttgtggatttgcaagagatgttctgacccgttgggattgatacgattgtcaccatgaagcaacattttgatgaagatctcatatctaataggttaaggtgtgttgggccatattttgtatgggtatgggctattactctatattgtgtgttctttatcgttttgttgaactctatgtcatttggacccttcatggtcttgtaatagcctatgtttatttgtgagcccttttaggatgatgtgtgacttatgtgagttgaatggttaagtgatgtgaacttgtgcgatgatggatggtatatgtgatattgatatatatgtgaccatcttatgctcatgaatgaatatttcttgaagttcatattgagatattgctcttgtgtttgtgatatgttgaaatgtgaaattgaaattggctccatatttgctattgttgttatgcatatgtttagggggagcttttgcttgtcattgcaatatatctccatgtgctctgtgtttaattatatatatttgtggtgtttgtcatcaattaccaaaaagggggagattgaagcatctaggccccggtattaattttggtaattaatgacaagcactaattgtggactaaccattgtgtttgagctatttgtttgagttaggttcacttaattgtgtgcacatggatgatcattgatggattaaaattgacggcgcaaagcaaaaggaagagaagatggtagactagtgttttcattttaaatttatcgaggcgttgggcgatcaaaattgtgctagtttattaatagctttgtcgtactattaagaggggtaatgacctagcaaagagatgattttaattgccacattaggtcattatgcatttagacttgtgctttcatttcatcacacacacacaatcatttatctcactgttttcggcctgaccagggccggtctgaccgcggcccaagtgccggtctgaccggccagggcagccggtctgaccgcagggtctaggccggtctgaccggcgggtgcgggccggtctgaccgaccagccatatggccgggatggtgccgtctcggtgtgctgatcccgagccgccggagccatattcggtcagaccgagctgatggcggtctgaccaagccgaggccggtctgaccggccaccccatgtcggtctgaccggctacggctgtggggcccaatgacagccgttgtagagtagcacagtttgaccggccacatacctccggtcaaaccggcagagcacagagttgggggatttcgcccccaacggctagttttggttggtgggagtataaataccccccctccagcagcaaggggactctcttggcacccaattcaattgcatacaccccttgcacctctctcacacccacttgaactttatgttcatacatctagtgtgttagagggttaattagccaagagtcaagtgcattgcttccatttgtagagctagtgtggcacttgattgatcatctccatgccgggtcattgcttgttactcttggaggttgccgcctcctaaacggcttgtggaggagttgcccagtgatctctccgagaagattgtggaggaggtccggcgccgattgtgagtggtttggagttcaccaccttcggagtgaaggaagaactaccctagtgatcgaggcttgggtagtcctctccatgggccggctcccgccttgcccaccccttgacaaagggggcgtgcggtggcttcgtggttgagcggcggagttgggctcgcttcaacggggagtaggaaaccggcgagtttccgaacctcggtgaaaaatctctgtctccttgtctcatttgattgtcacatttacatttatgcaatttatatttttagagacattcttgagatcatatcaccctaggattgctaaacattgacataggagtgtgatttactttcctagagatataattgagccactgtcaccctaggtttgcaaaacataacttagttacttagttagagttgaccctcaccaagcctagcaacttatgttagttttgattaagtgtcatttagttttaaatcgcctattcacccccccccctccccctctagtcgacatctcgatcctacaagtgtgtgtgtgagagtgtggattccagttgtgtgggcgctttttgtggtcttcgtaaagagttgtgagcacttgcatcatctccaggagttgcttgcatcatcttttactcttggaggttgaggactcctatacggctaggtgttgctccccagccactgatctacgtgtggttggccgggagaagtttgtgaatgccagatctcgcctccgcaaggaaagagatacctcttagtggaaggaggggtgcttagtgcaacctcttgagaaaagggttagctaagacccggctcttagtgagctcttcaatagagagtagaatccccttaaggatttgaactccgggaacaactttgtgagcttcatcttggtgatatttcttcatccctctcctctagctttgcttgcttgtgccgctattgatctagagttatcctcttttgttcgactgctctgagtattttcggaagttccaaaaattcttgcttagttccgaaaattcttgcttccgctttacttaagtttttaaattagcctattcactccccttctagggctaattgaccctttcaaaaatgttctctgttgtttagtgcagatgtcccggatgagctacgggagaatataagacaggctttgcaggttgaatcaactgtttttgagacgaaatatctgggattacctactctggagggtaggatgaaggctggaaagttcaaaactttgaagcaacgttttgctaagaggctcactgactggtctgaaaaatatatgtcgtctggggctaaagagattctaatcaaatcagtcgcacaggctatcccgacatatgttatgggagtatttaaattgcctgctactgtgtgtgatgaatatacaaaatgataagagacttttggtggggagatgacgaaaacaaaaggaagattcactggacagcctgggagaacctgatcttaccaaaatatatggggggattaggttttcgggacttacaactgttcaatcaggctttactaagaaggcaagcttggcgtcttattcagtatcctgacagtctttgagcgagaattctaaaggccaaatattatccgaactgtgatctcattgatgctgttttcccatcggatacctcacctacatggaaagctgttgaacatggccttgagttacttaagaaaggcttaatttggagaatcggagatggaatttggaaggaccagtggattcctagagaatccagctttggactatcacgccagagtgggagatgccgcctcaggtgggtttatcaactgatcaatcaggagacaaacacctggaatacaaatctcatccatcatgtttgctcccagtatgatgccaatgaaaattttgaagattaaattgccgcaagtcagaacagaggatttgctagcttggcactatgagaagacaggatttttctcagtccacagtgcttaccgactagccttgacaaatcatatgaatatatctgagttgggttcttctagctccgagacaagcggagaacgaaaaatttgggcaagcatatggactacactagtgccgcaaaagattaaaatctttgctaggagattagccagggaaggtcttactacaatggttaatcggaagaagcgcaagttggaggtgaatgcaacttgccgtatatgtggatatgaagatgaagactgctttcatgctgccatctcctgtacccgagctgttgccctgagatcactgttacgggaggtatgggagatgccaaaggagagttgtctgatcaggagtggaccggattggctcttaatcattcttgattccatcaatccggagggccgggcaaagttcctcctgcttctctggagatcatggtttctccggaatgattgtgtgcatggctatgggaaagcatcagtgcagggaagctcaattttccttcagagctaatgggagtccttaacaatgaccaggattggtgggaagttagatgagaaaggaaaaggtcccttattctgcaacagagtgttctgaaggagaactgtaaccaaacccctgccattaatgatagatggactccaccaccgacgggctagacaaaggctaatgtggacggttcgttcgtccagagttcaggctgcgcgacctgcggggattgtcatccgtgatagcactggttcggttctgcttaccccatggagggtcattaatcactgtagctcggctgaggaagcggaaacgattgcgtcttgggagggtgtaaacctgtcagctgaatgggtgaaacaacctttgatccttgaaacagactgtgcaaatttggtatgtttgctgaagaaccagggaactgatagatcgaagctgtgccatacacttcatagcataaagtctttgttggctgttttaccggattttagaatccagaagactaggagagaatgcaatagcgtagctcataatctggccaagttagctatgcgaacaaatcactcagcagtttggcgcttgcaggccccttcatgtattcttgaggcactcgctaatgactgtaattatatcaatgagtgatcaataaagcattctttcccccaaaagaaagcatgagaaaaactgtacagtgtttatggaatatttacaaaaaggggaaaagcgtgagtcctaaggtactatgctacaaagaccctttgctcctgccaaggtccaagtttttgcctcctctttgatcttggcgactagatttgttgccgatagctttttgagttcgaacaccgattgatttcaccatttccatagtttctaagaagtcagaaggataaggctacgcaagccttttttttggtacctacggggtgaaagccaggttcgaccatcactcgtggatcgtcacagggttcctccaatttgttggttcgatttgatcgtaagaaatcaaactccaaaccttctggtgtatccacattccgccatgaggtgtaggcctgtctccatggtatgccggcaaagaggccagcgggcagtaggcattattttgccatccacgtgttgcgagtcggtctgatgtccatactctatttttgtacgattagctatgcaaagaacttattttctcagtgcctagggcttccatatgatcgtggtgtagtttgtactagtagatccaaggaattgccttaggctagaccatgtatcatacacgtgtacccaaaaagaccaaacctatataattagagatttgctaggaaggtaactgaccagacctatatataattagagattcgctagaaagataactgacgataaaattcgatccggtcacatgtggagcgtacagacgcgcggtgaaataaaaggacatctccgcttagttacttttctgtttttatacatatatttttagatatacgtttcgtaggtttttatcggagaatacatttaggagttaagacaatcaaaatatttttaaacagtccttagacttaccaccaaatgctaactaagtcttcgggttgatgccatgcattttagttacgataccccaaaatttatatatatataataattaattatcacgaaattaaatatttagtaaatattgtacaaattatgaaaatagtaaaaaaaatatcactgctgatttactggttatttaatttccggataattaattattataaataaaataatgggtacaattatttcacaaccaaactcaagaaaactttgatggactggtggggtatataagaaatcggaaatcatagcaaacacaaaccattgaaaacatattggaatcattctaatttaacaaaaatgagatgcgccaaaatgaacactcactcggttatacaacacatttgagacgttggacagaattgtgaaagcatgatatcttcaaggtcagcaagcccgaaacatacacgtctgaaatgatgaggaagccaacctatatcactttattatttaagatgttaccttacaaccgcaatgataactagtataaattagtgttttgccggtatttagtcatcagattcaccccctctataaattgcacaaaagaaaaaaagaaaaaaacttaagagggcaaaaaattacataattacatttacatggaccagaacatcttccaagatgtatccgtgctaaacgtgagcctgatattaaaaaaaaaagaatagcaagaaagtcactaatatataaactacagtaagcctaaacgcaacaaaacctactcccagagcttttcttgatcggttcccacttatttgactgttgcttgaagacatcccctcaactatctccttggccagctctgtttaaaatgcttttttctaggtataccttcagctttcacgcaagacatccacgaatttttcagtcagctagcaaaagaattagtttcgtcatctgagactgctgggccgctcatatacttcaatagaactccaggccacaggtgggcagcaaagcaaggtagaataacatgctttccaccacagcttgacttagttgaagaaatatggggatcccaggacatccgtgagatcaaaatctcccctctctggcaatggaggaaattttaattcagggaaagatttctcaaagctctccaacaactgcaccaaaaaaatactgtcagttatgcaacctgtcacttcaacactcactatcacacaaagaataacacagaaaaaccagcaaatgccaacacggtaaacatgcaaatcatgcactgcaaagaaaaactgtattaatactgatatttctaggatattatgaaagagaacacttatctcagactatctttcagctaccctacatagcaaataaatggaaatgcttaacactcaacaactttagaagcatgggaagacaagggaaacacacatttattattctcaattgcaccattagacaaatatttcacactgaaaaaatgctttctgaggagagatacaagcagaaacaaattaatttacccaatactctcacctggtaacatgcttagcaacaaactaacgcaattgttattagaggcattctcttcctctcttttattagttatttaaactatagtaactatctattgggaatgccctaattatgctaggaggtgcacataactcacatatttcgatggtctcattctcatattaatccatatatttgttggggaacttgaaaaataatccaagcaaaattacttaaggagcaagaaaagtatgccagaaaaaaaaatctgatttttcttaagtgatattctgaacaagatagaatggttgttaaatatctgtgataataaccgggataagaaaatacacacattttcgaggataggcgtatcatagagttccacaaacttctctcgtagtattttgttcattgtatcaacatcacaagcatgtgtccaatacgaatcatgcactcctgcattgattttaaaaaaatgttgcgactaatgtacttctccttaagcgcttaatgcaagggataatataaacacttcccagaacacagtaaaactggtacctgcaaaatttagtccttgccttttgcaagcaacagcggtcatcatcatatgagaaccgtcaagggagtgcacgaaatttggaggaaaagcagtcctctgccgcttcaccataacctggttgagtgaattttagtgtaaagtatcaagtattctaaagatctattagattccaagatacaacagcaagtgatgaggaaaataatccatttgcgtccacagttcaataacccattttctgcacaattaccacagggattgcacaggcagtgaactgatcagtaagcaaatgagcaaaacatggcatcagtctttgcagattgtacatagtgctgatgttgaatgatgattggagtaccacagttgatgcgatgagctaataaattgcagttgccggcctcagcttgtttaagcagatgtgcaaaatataaaaatataatggctgttcaccttgatttggtaatgtcaaaagttcaaaccagacacttaacaagagcatacttgtggactcaaaagcttgttttctcataacacatgtgctaaacaaaactaagttctaagcgggaaatctgaaaaaaggcactagcacccggtagtcagtgactggtggaatgtttttataaaaaataaaatagaaaccaagtgaggtgtttactttgaggaaaggatatgggttaatcctagttcatccgatcttaacatatgtccacgatgaatgaaatatcaggaataaagccgtgacacaattcattagatgacccattgatgggaaatctggtccattccttaatcaaaaagtgcactacactactacatgtcatcatcacacacacttcgaccagcaaccagctgatagcgatattgtcagaatgtggaatatagtccaaattgataataccttatctgtttcacgttgaagagtcaggacttgtaatgatgttttaatctgcaaagagaacatcaagaatgccactttaatatcagaacaacagaaggcacatgttgccttattacatcatgtctgaggcatattgcaagttggcaacaataaaataaatacttataacacttacaagatgcctcccaagcttgcgatatggttgaacaactgggagtccaagaggggttgtccatctcacaggttcattttcacaagcaattacctgtcataaagaacaggtgaggtaattcacaacttgcgtctttcctaaattgcaataccaattaaagaggtaggatgccactgtagaaaagtgacatagacatggattttgttgatgcaaaaattgatatagacatgaattttattgctgcaaaatgtatttacagcatcaaattggtataatgcagctgtcttaggataactatcgtaccttggcacagtcaccaagccagttcataatgctgcgggcagcttggaacatctcaccaagtgctgtcagagtaacctatcaagcatcaaaaataaataaataaataaatattatatggtcaatttaattacacttatgtaggataatgaaataaaacagttccactgaataagacattcgaccttagcagcatagcatgatgcactaaaaagttctgaatcatcacaaatcatgtctctctcctttaatcttctttttatttgctcacgtgctccaacataagtgacaccatacacagatgtcatcacagtttgctttaccaatttcctgtcaacctgcaattgataatcaagcaggtaaaagattaaagggtaaactctaatccatggacctctcaacagcaaggttatgtatcaaccgaacagcatcaagcaccaaaacacccttctatcactatttcataggcagcaaacttttacataaacagatcaattaagtgaaagaaaagaatcccgaagtaatttcttctttcattccctgagcactgatttaacaaatttccaaaatggcttataagacaactcactgtgaaccattttgggcaaaattggatgatgaatcggtacttatcattcaaaaatatgaaataaagtgttgtttaggaacctaattagccatttttaacatatagttatcgtaaatagcattagagaatttaatagattgtagcaaaacatcagatggcgattttcttgaggactaatgttttcaggcctatattcatctgaaaaccaaatctcttcgattttgaaaacatccatcctgctagtcatgtgagcaaatacaacaggaactaaaaaatatatgaagaactacctgatcaagtagcagacgtgcgcgtgctgcatcaggatctgtagcaggatcttttagcgcatcgttcttcataatttccaccaccctagcacaagtacagaaactatgaaccactcgccatcttaattctaagatatggcatcagttgcatcaagattgataaactagacctgatgatcctcaaatctagatttaatcaatttt

SEQ ID NO: 35160 - DNA, 1900 bp, Oryza sativa
atctttctctttccccctctcctcggtcatcctgattgagcttgccaatcgactgccgaaaaccagggaatctcagcaccagtcaccacagaagcgattcccggttcttccactccagatccatgttgtcactaccgcacatgtgctcccgtcaacagtatcatctgtgcatgtgctcttgtacttgaggcaaacctagtaatctggggataggaagagaggcagagcttgatgtctacgtcagaagtgtgctatttggatctgctcatggtgaaaactggtatcaagaaggcagtgcatgcctcctttgcgtcctttctggttttcccctcttgtaaattttttcgctctagcgtttgatttatcatgtacctagtctgggcggagtaaagttgctaatggtcaattctcctagctttttgggtttatttgagatcaatcttggctagatctgttaattatgcataatggttggaatttaacattaaaaactactccctccgtttcataatgtaagactttctagcattgctcatattcatatagatgttaatgaatctagacacatatatatgtctagattcattaacatctatatgaatgtgggcaatactagaaagacttacattatgaaacggaggaagtaagtgattgaaatttttgcaccgaagctaagaactgcatggatctagcaattggtggcatatttgtttgattcctcttggatttatctcatgtaccaatttgatttgttacttcaattaaccatactatgtcttgtagttactactgcttgctgtgtatctgatattttttttcttttttgaatccaagcaagctggtggtgatatgcagctggagaaggttgccacaatcatgttttttcctacaagaactactgctacaaaggctatccaacactagatggctaataaaatgtgtgtgtactatgtagttagtgctaatgagccagtcaaaactcaaaagtattctcaagacatgtaaatgtgggaccaagaaccagtggcaggtatatcatcattgtctttcttctgtgtattcagacccataacaattaattagtacaggtaactacaggtgttaatatattgttaacgaatatacaatagctaattcccatgagcaaagtgggtaatctcaccacccaagtgacaaggcaaccaaattcaatgttcatgcaaccaaccaaccaatcaaaattttatgcatgcaaaaatctgaccaccctcctttcctagccaaccaaacatctcaaatcttaatcaaggcccaaaggatacaggcaaccaaacaagccattttttatctgcgaagccaggccaaggctagccaggatgagacatgtgaaccaggctgggaaaatgcagacaaccaaacatgcccagtatgttgcaatggagcattgcatcctaccataaacaaggtgcaatgctaaacacaatgccatccaaacatacctggtagctattccagtataaacatctgcaggcttctccccggcaactaagttcacagcaatggctcccaactacatgaaattgataagaaaatcattaactctactagccaaaaaaaaaatgatgatgatgatccatgcctgactaaataatccttatgaaaacaccaaaactattcaaacacaaactgaccttatcccttccaagagcagcatagtgctgcaggccattacaagaaccatcctgaaaaaggaaaatgttattgtagttatgattaaacatggaagtgaatcttagcgaaaatcaaaactgtgttgcgagtagactgcatttagaaggattaaaacataaacaaatttaacaacacactagattttgctattctgtctaggaaattagtggtggaaaacagaatccagtgt

SEQ ID NO: 35161 - DNA, 7781 bp, Oryza sativa
taaaaaagaaggaagcaatgttagacatcatttttaagtctgtttatcacgttgagtcaagtcagtataagaccaattcagcgaagtgagcaactagtcaaccaactacttgtggttcgaaagcagatatggaatgcctacaatatgcatgagatatgttagactgcatcagttacctacctagtcgaccaaccaattatgattaggaaataacttgcaacaatgattcaagtattggaaagttataactcacaacaaactctattaatacaaatagatgataacaactgagatgaaccataggaaatgggcgtgcagtgccatatgaaaaatgtatcagtagcaaaaaaaccatatttatgagaacaagagccccatcaaatgatcactacatagctatattgcataaataaggaatttaccaattgatcattgctctctaaagcaaatgagagaaagttaaggtacctgatgcacaggaatatgtgagatcatcgtttctggtgaggggcttcttaaagcttcagtgagatttatgcacactgcaaggcattggaatggatcctcagctccaagccaccatcgtttgccttcaagaggtctatcagctgagtcaaatatgtcctccaagtgattctccgtgaatgcaattcggccatcatacgataacttgtcaacaccaccagcatataaatttgctagatgtatctttagccagcgcaagcctgatttaccaagcggacgaccttctgcaaactccaaaactccccggcaaagatctgaacccaagtggttcaggtaaggatgcattggataagcacggcctctaaaatcaaggttgtgtggatagtagaaaccatcttcatccttcattttgcgagctacctgttaccaacatgagtattcattagatgaagcaatgaagtgagtaaatgatggttacccgttatagtctcttacggcaagttttagttctacatcacatctctgggagtgcctttcactattttccttcttggctgctctcaaggtccatctccatttcttcaacttgtcttcatcttctgtgtcaggcttctctggtaaagcaacctagagtacatgaaactttttagttgatatctaaaactaaagtatcttgataaaaccaccaccattgaatctgagtcacatgctcacagcattattatgagaataaatgacaactcacatcagtgcgatcgaccaagtcagcaagccggccaccacttgaccatattctgtcgacaatactaagaactcttttgttaaccctccacttggtgctcccaagagtatttaaggcctgtgaccaataatgcattaaatggttgaaccacaaaagctcctcttggcatttaggtggattatgatagatctcatttggtgcagctgttttagaggttttggtgtttaaaaattgcttttcttttaatcaaagctgcaaatgataatattattgtgttccgaaaaacagaactagggttcctgggaggagctggaggtgcgtccctgggggtggagaacgttgccgacagggtgcagaggccgagctggggaggaggctggcattgggtgcggtcaggggtggaacagtgggtggaggcgagcattgccagggtgagaaggtgggtggtgtcaatggcagttgcaaacagaggcgaacagccaatcatagtcatgagatgcagaggcaagcagaagcgagcagcatgtggaatgtatcgtggggatggggatttgggtgggggggagggggggttgtatttagggttatgacccagacacccagtacacttatggcaattcatgttaacagagtggatatgtagagtatagagaattttctcttcataaaaaggcatcaacatgtcaatgtccaagagcatatgaacaatagaagcaactgtaacataacaacaggtgtgctcaaatatcttatgattgtatcttaaaaattattaatataatttgcataaaaattatgagcaagttaaatgaatacctcaaacacagattgcatttgttcccttggagctcttctgacagcatctctctgttgtctagctccatgggtgcgcatcacataggatggtaaaaataaatgtgcacccttgtcatacctatagaatatttgcatgatgtcaatagagagcagtctgcttcatattcagagtgtcaatgcaacaatggcctcaccaaacagcaccaacttgcactgaactaatcagataggactagaaaaaaatatctcgactattaggtgcaataacatattatttaaaatataccacatatctaatttgttaaaatggatagtatagcagccaaagaactccaagaaacatagataagcaaaaggtaccaacccagtccaactgataggcggaattaacataggcatataaggtatgaccatatgctttgcctgtcaaaggaaaaacattattcatgaggaaatcaaggaatgcaagatcagaagagtcttttgacagaatcaagacgatagcagaaggatccactcactgttctatcaagcccttgccggaccagcggatcacacttgatcacaccatatcgccgactactcttcctgtttgattacaatgatgagttaggacgaaacaccaaactgcttttgtaaaagaagatataaaattagagttgccattattactgttgctctcttgccacagttctcatttcatgtgtgaaagcaggacggatatcaggtggaccatctgctgattggctagcaggtggttgtatgtaggctgtctcaatcataagctcaattaaacgactaccaacctaagcagcaagacatagaaactatcatcagtcaaaatagtgttgtaatgaaacattatattaaccagattcagcaagagacacgtacttttgcatgagcatcttgaccccatggcttggagttatcttgcttctttactatatttcttacttgccgtattttttgctttttcatcagatcagtgactttctttcttagacgctcttgttctttggcaatgtctgaatcacctccttcttcttcattatccatttctttattgctttttttctttgtcttctctagaaatttgtggattcgaacctatacaggaacaaagggcaaagacatatacatttattcattagcagcagcaatgttattgcataaattactgtcgccataattggtgcactggcaacaataatagtttagtcgaaacaaaatattgaaaattgaaaattaacatattctcaaaatatttaagaaaataatagacgaatgagagccaataaaggtataatttcatggcataactttgtttggacaatagttggaatttttttaactaaattggtgggttcagagggaaacatgaactagctagataatcaaagctctgcaagaatactaccaaattatatctgaaaaacacgaacactattctcagttatggtagaaaaaattctgcatatttgacaaatatttttacctgaggttatttgaaggagccccactgctagcaaagcacaattctaaggaactaaccaaatcatataggcttctgatgaggcctatattaggaggctcttgatctttatttcaaccatggttcaataatagttgaactcatacacacatacttctccaataatttcatacaaccatacgtctccaaaagaaaaataaattggtaatgcaatcatgataagctctaatgatgttaagcgctgaaaactgcaggaagaaatatatttaacttaatagtattgaaatatagaacattttgaattctgccagcgttcatcctaaaggtccaatggcctatggtcatatcatatctccgcacctaccgtggcatgtcgtgatgcgtgtaaaatattttgtgacccaaggactgatacccctgaattatgttttgttctcattcctaaaagctatcattaaccaataactattcttgaatggagcgcagagttgaaaagtaaaacaaacaagaagatacagaactcagccacagccgacaaacctcatgttctattgcctcgccgatctggcacgcagcctggatgactcggacacttccatcgccgctaccggtcatgagtagacccatgagcttgtgcatggtgatgacggccatcatatcagccgggagcatgttgaaatagcgggcatgggaggcccgcgcgccgcgctcacccacgagcttctgctcggcaatgatctggtctcgcagtggctcgaaccagccaagaaagagcgacttgacatagggcaggttgggcgccagcttctgctggcacatgtcagcaagcagctcgcggtactcctcggcggcctgctcccacgcctccgtctcaatctggatctgccgccggcgcagcatcgcatacttgtggtacccgaccccgtgcaccgccatagcctcggccgagtgcttccctctcccggacctcctcatatgcccctcctgccccgccgccggaaccgccatagcctcggccgagtgcttccctctccaggacctcctcctatgcccctcctgccccgccgccggagccggggcggagacgctcgggtccccgcgggcgatctccccgatcgcgtggtgcaactcgtcgacctcctcggaggagacggactcggcggcgacggcggcggaggaggacgcgaaccgcggcagcgtctgcgacggcgcgagacgctgtgaggcggcagggaggaggaggaggaggctgcggtgaagagggtgggccagcgggtcgcaggaggagaggagggcgaagccgagacggcgggcgggaagcggcgccacatggggggcgctagggtttggcggcggacggtgaggtgtaggtggagaggaggagatggcgaacacgagattggtgcggtggccggagttggggaggagggcatcaacaggagggtggcggaggaaggggaatggcgccgcgccgccgccgccgccgccaacggaaggaggggggtgcggttgggggagccggtgtttggttcgatgcgggggctttcgcttaaaccctcgtggcacctgggtggttgatcttgaggggtttaggggctcagatttttttggccttctcatcttcgttaaacaacatgtaatattgtaattatacccttcttgcttcggatttgttacattctaacccctcaggcaagccaaacctcatctctggctctctgctgacaagtgacaaatgtggcttagttcaagatttcttaataatattattcatgaggtgattattttttttacgaaatttaaaatccaaacaacatcaaaagttttagaattttttttttgtccttttagatgagatcatgtagtgagcaagtagatcatgcgccaagcagtgattatattaggagatcaatcagtatacgatataatcgagtatatcgattgttggtagtggatgacaatcaaaacaattaggaatgtcaacgagctgatcagctcgaccgagccaggctacataggctcgagcttgagaaaagctcgagccaaatctataccaccttgagcttttaagtaggctcgctcaagttcagttcgagtatacaatacttcctccgtttcacaatataagtcattctagcattttccacattcatattgatactaatgaatctagataggtatatatgtctagattcattagcatcaatatgaatgtgggaaatgctagaatgacttacattgtgaaacggagggagtaatatttattttttataatatttttttataataaacaatagttttaggttaatcatattaaaaagtaaggacttgtcgacgtttgatgtcgcgattccggtatttgcacagtatggggatcgtttggtaccaggatatatgcgagattaaggtaaaagagacggagatgaggatttttatataggttcgggcccctgaattgtcaggtaatagccctacatcctgttggccgaagccgatcgttgctcttattcaccataatcacaccagtataatatttggagtagcctatctaactgttgtcgacaacagggtagtcttcctcctcgagttcgtgcccggcgagatcagagacagcgctagatccctatacccggcctctgtaggtaccggatagggtcagtccaggcatttctctgatgtcgatatccggcggtgtgtcttggcgtatattggcttgtatgttgatcttgtgtcttgatctattgttctgtgtcccctctcctcctagggggccttgtattttatacccataagtgtccccttgtccaagagtagtccttgtcgtttccatgtagaactctggttgtcttcccttctccggaactccctccatatccgaagtcagttttcgtataagacatggtatgtggtgggtcctgccgagatttagtcaactactattaggtatgtggtatccatatagttgtttatcacatgaatagataagtatttcagaaaaaaatacatgcaaaaggccaaaaatattgaaatgtatagactaacttttatgttattccaggatagagaaaaaaataactatataaaacttctagtatggccaatcattataactctttgagtccacaatggcattttcagtatttttgaaaaagtattcggccaaatggcatattgtaaaaagtatagaaatatcctgatggtaaattattgaactagagcaaacttaatgtgatagaatagattatctcttaattaaacatagaaaggttaaaaaaaataagtcaaaactaattaccttacacaatttatacagttcatgtcattcgaggaattaataagtaagtaatacacgattgatgaggctagatctgtctctaacactaacactaaatgttgaaattaaaactaagcaattagggacatggccatattctagtcttgaaaacggaaggagtaattatgaactgtgtgacctaagttcgacgacaacgctacggtgagaaagatgaagttgtggagatcgtggatcctcccggaatcaacttgacatcattataaggaaaaaaatccatcttgcctccctcaacctcaactgtagcctgagttcgctttacatcccttaactataaaaccaagagactacctcaactattaaaaccaatgcatagtagatagtttgcataatgatttcatccgacatggcactttgacttgttcatggtgatgagtcagtttataggacccacctttcactgaaccctattcatatctctccatccctctcattgccctctctgtgcatgtccaccaccacaacctgcacatcgggcatgttcgttaccgacttaccgtgatcccttacatcaccggcaaagcagcctccaccccaaaagccacacaagaccatatcgcctagagaggaagactatgataacgaggatgacatgccaccgccgccagtgcgcatgagcctagagtcctcgttgtgtcagtcatcgccatcccctcctccaacgtcgccactacctccgcccactgaaccaatcactacatgtcgcgttgggtctagggaaattcactggcggagcagacactgtggtcgtgcatgtcttcctaatctacttcttttcgattttgctatatatttgtcgataaattttcccccaaaaatttgacagatgtaattacagtacaatcgtagtgtaattacactgtaacttgcatgtaattacactgtaactatagtgtaacttgtatgtaact

SEQ ID NO: 35162 - DNA, 6392 bp, Oryza sativa
tttatcgacaaatatataggcagtcccacttcttttatatccggtacatgcaacatgctaattccaatttgcttgtgtacattttgatacccgtgcttgctaacatatctaattggagctttctggtttgtccccagccagctcagattgttgcctgatggaagcccatcctattgcatgaacactagctccatctcgcgcctctgagaactaccgcatggaacgctgcattgacatgggtgtgaggtggtagcgaggccaaccaacttcagatgaggaccgagactgacacctcttaagccactagatcgacgctgtggaggagcccactgctaggagccaaagtcgcctgctcggactgtgtcacgccctaaagttccccttgctagttttaaatttttgtttaataaatcgcttgaagaaattggttcaaattaacctagagctaattctttatttaataaatgcaatcaataatgggaaatggcattgtgggatttttcttgggttccacatgtcataatacattaacaggatttttagtggaattttcagagcctcgaaaataattttaacccatttaaaatcaattctaagcaatatttaagtccctggtaattcattttccattttctctttttcctcttattgggccgtcggcccactcctcccgcgccgccctcctccttgctgggccggcccacgtcccctccctcctccctccgggtcaccgacaggtggggcccacctgtcggccccttattcctcctctagccggcaaccgccgccgcctgccccaaccgccgctgccgcccacctcctccgccttccgcaccccactacacgccctccacgtcgccggccaccttccccacacctcccgcaagtgcgcgcgcccgcaaatgccgcaaatggcgcgcgcgcccaccttccccaactctctctctctctctccacctctccatgttgccggcaaattgggcccctccccggctacgtccgcctcccccttcgactataaaacattcccccaagccccctctatcttttttcgctctcgccgcatcctgccgtgctctctaccgacattgcgccgctctccccgagctccatcgccggcgaccatctccagccgcacgccgtcgccactagcgccctcgctgcgccgcaccaccaccgctgatagcttcgccgccgcggaagctacctcggccgccacctcccgtcgctgaaatcccaccggaaatcgtcttccccgccgccggtgagcccctccattttactcgccttcggccggtgttgccagttgccgcgaaccacctctctccctctgaatcctcttttttgctttcctaggtcactccggacgtcgtccacccgcttgcctcgccatccaccgcttgccggcgtcgttcgccgtcatctcttctcgcgccggccaacctcggtgagaaaccccccctctcctcctctccttcacccgtgcgcgtcgccgcctcctgtgcgcaccgccgccctcgcgccggtcgccgcccgcaccttgccatggccggccggtcggctttgtgccaggccgcgccatgcctggccgccgccgcgccatctgatcggctcccggtcgatccggaccgttggtcccgtggaccggcgatggaccacccgtgtggtcccggtccacggtgaaccggcgctctatgagccgctgacatgcagggcccgcttgtcggtgccggcccccttggatgacgtcagccctgggtattattgcgcaataaatcaattaaggccttttctttattagttaaaacacagattatcttctaaaaatcataactaattcatccgagttccgattaagtccattcaagtctcaataaattcataaaaatgcatagaatccattaaaaatggttgtttcctgtttcagtagacttatagcatgttttgcttgtgtgcgttgtttgtcgcgtagattttggccgtttcgtcaatctgcggtttcttgaagacgttgctgtggtctcatcagtgcgagagcaaggcaagtcatacattacaattgatcatattgtacccaatttacaaatatcctgtattttctgctaaacgttgcattcttatacgatatcatgtgggatgggtcctattactcagctatatgttgtttcccttacgccattgataacgtgggtattaaaatgactagatgttggtttaggagatgcttagccgtgcttagttcaactagcacacaaatggggaatcacattaatgcatagactttgtttattggcatagttttggattagtgccaccgcaatggtgttagttaattaaaatacaccacatggtgggctgtgggtgcatggttttgctagtcgtgcccatggcgattaaggaccggttcgcgggaaaccctggaagaatttatcgtgcttaccacaagccagcgtgggcaacggctgggcttgtagtgtagctttcctctagctgacgtacccaggctagggtgggcgtgatggagttgggtcggcctgggtgtccggttgatcggcttccggattcaccgtggcacgagaggggattgcccactaccttacgaggagtgggggtgaaacctgaggtgtggtgcgattggttagagggggttatgcgaaggatcctgtcacggcctctttccggtatgacgtggtggcatgtcggcacacggaaacgtgtcatggggctatgtcttgtggatacggttgtacacctctgatcagagcaaaattattcgaatagtcgtgcccgccgttatgggcggtcaaccggatttaccgtgattagtctcacccctaattagctaatgaactggtgtagttcaggtggttggttgggcctgttgcaatgtggtgtagcgttggacagtggttggttaatattgattaattactacaactgttttactgctttcaactactgcttttaaatgcctgctttattgcaaatgaacctctagcctcctttggttatatcttgcatcataccttctcttccggtatgacttgctgagtacagtgggtagtactcagtcttgctctctctccccccccccccacaccagagttgaaattcttctcagttggagctgtctcgaagaagttggtttcgtcgcttccgataaggatgcctgtggaatggagtcgcccgctacaggagtcaagttttcaggcttaactcgcttttatcttttccgctgcatttgtaatcttttatatttttgtaagacgtggatctgtatgtcaacaattgtcgtttgtgtaccctggctggtcttggacagaggtttaatgcacattcaccttagaaattctggttcgtgaatttctgggtgtgacagaccgccactgcctacccctcattctgcacctccgtggcttgtcccaagcttgatgccacgacggagcatgaggggaggtgaggagttgttggagatcaaaagagatttggtgtattatttacatggtgtcctattggtattctttttctaatgattggattgaaacatcagataaaaccactttgcaatgctaagggagttactttacactggttttgatagttgagagagtttctattttggctttttggttgagggacgtaaatcggactcaggctatagttgagggatgaaaaaaatggacttcctcctcattttaatgctttaggcccacctgtccagacaacaagatggctgaaatgggccttggaaggtgaaacccacatcaatttcaagctagtactagtcatatgcccgcactgctagtcccaatgggattgttcatagaatgtgtttgcttttgttgttttgtgctttggtgaagttcatcaaggctgtttaaactaatataaaagaagttatttttttaaaaaagagagataatacaaaagaaatagacgtgtggaacttttttattcatgaaaagaatgcggtactttactcttcttttatacttgataaatatcaaatctaccatggggaccatgttagcttcaattgttcattttgggggattagctcaagcagcgatgtaagtttttagttttgctgcatctaactatacttcccgaccatgacatgttgttctcagatagtgtcatctcgaccatgacatgttgtttgtccatgcaactgatctatttgtagtgtttacttctacttgattgtgattgatataatgtattgcattgttgggcaaagctttcataattttattggtgggtatctatcttttacttgaagtttgatatattaagaaaatatgatatattttagtcattgtattaccttgacaatacacatatgttcttgtttgtcccaaatgtgaagtgaaacgatttgctgatctaagttctgatgagacggtgaattatgggttattgtgaaggatgttgacgtacagctcttgcaataccataaaacatcttcactcacattttctattgaagtttggtgtatgctactaaattaagagtttgtttgttttttcatgattaatgttttactcgtatcactaagaggagtaccatattggttttgattgtagggggtctaaaatatgattatcttattgtgtgtgaaacaaagatatatttgtttcttttgatcaattgctctatctataccttttatatacctgttgtagaattttgtttcttattgtattctttggataaaaatatttagctatttgctcaccagtacaatgcttatcaggatggcccacaagctagtcaaacggttccacatgtccacatccatatcatcccagaaagaaaggagattttgagaaaaatggtgaaatatatgatgcggtttgtggcatagctctccaatcaatcttctcttatccaatatttcatcacacaatgcttaaccattgtctttccaatagatcgatgtcaaagaaagagaattaaatgagaagcttgatctagacatagagcgaaaagattggaccatggaagaagatggctcatgaggccaattacctatgttacctagatacggggatatagatacagatacgtgatacggggatacgaggatatggcactttttagaaaacaaggatacggagatacatctatatatatagaaatttaataaaatatagaaatttgatgaatttggaaatttaataaaaatacaaaaaaatgttgaacttctttaagaaaattagtccatgcatatttgtagctaaatcatgcttgcaaatgtataccagatcggtgagtactaagctagcacatgacctccaatatcccttctagtttgtagtcttgtatactatcaccgacgtccacacagcaaagaacaaagatagtataaattagtgtaagacaacaagaagtcctcaaaatcacaaaatataatgttctttcccttgcttgttttaccttgaacctccagccgcagtagcattaggaatagatgcagctagttaccaactctaaaatccatcaaatctatgaaatttggcattgtttgtcccaagaaaataagtgaggagaacatagatgaaacaagatgaattgttcgacggaagaaactcaacagccaatatcttactacctcattaggcatgaaagaagcaatcggccactggcgatagctttgcgccgagggaccacggcggcgcggcgcgcaacagtggaggcgtggagctggtacacctccagccgtccggcgccgaggccgttcactcgctttatggcagtggtggttcttttttttttttgctgtactcagctacgatggcgcgcggcatgctaggatcgatcgctgctctcgcgggatggagcgaaggatacgtacgggatacgtatcggagcgtattcgatacatattcgtatcccctcacgtatctgagacgaatacgtcgttttagggacatatcagggtatcctagccaatgagtactgtgcacttttcccttacatgcatttcttgtaacctgtctctaaattgcattggctctttcctagaaattctttgtaattgttgtcatctagcatgggaatccagtggtccttcaactgacattctgaattgatgtagtaattttgttatcaaacattgatgacacatgtttgttgtagaaatatgttcttaactttttactaataaatatttatctttgaaactagttatgtcacggactcacgttatagcagtagttgtttgttggaagaaatatgtttttattgacatatttctctctttatatgatactggttggtgacaatttttccatatgaaattaaaccaccataaataaaagatggtaacaaaatgtctcatgtgtcctttctataagtaatactccctccgtttcacaatgtaagtcatt

SEQ ID NO: 35163 - DNA, 13415 bp, Oryza sativa
ttttgtttagttaatcatgtcagtcagaaagcgtgttatgctcttttgcttatgtgtattgctacagtaaaaattctgtttaaaacatgttctatattgtgaaaagtcggaaatgcaacataggcatacgagccatgcatgatactcttatgactatttatttctttgtccacgaaaccaacttcaacgagaattacgggtaaacaagatatacaagccatacatgatacacatctaaccaactctaactacatgcatgtcaagagttctagttgagtctcaaaagtaccaagattcaactcagattccccactacaactagaacaaaaactttacattgcatgcgtagggaaaatgatcatacatttgagattgagtgatttgcacatggttcaaatcaagccaatagtacgacgtctatctagcaacccggatgcaccaaactccaatatcaggaaaagacaaaaaaaaacattcttagctacattatacctttgccttgctctatccaactcggggtcaaatgttgagcttggatcaacagttgtgaccatctgatcggaccatatttacgccaaggtcctaaccaacctttgtcaagtctttacaagcttgaactcatccttgtcaacatgatgttcatgtcttgatgaccatcaacacatggtgtcatccattagtctcatcacgacaatacataactcaaaggaaaacattagtcctgacaaatcagttgtatccttccatagatgactaatcggttgcatatgaaatatatgaatacaatagttgagtactcatcaagaccacaagtgccaaatacttgcatgtaagcttaagtgcaaagatccaatataaactagataataccccgcacgttgcagcgggacatagtgcataccaacgaaagagggaaaattcaatgagaacatttgatccatcacaatacatgtaacaaaattctatgagaatatttgatctatcacatttaacaaataagtgaaattgcgttcttgcccctctttttagggtttttgattttatctcatttgatcaactatagaaaaaggaaatacgcaccaacaaatgttccctcttttttaggattttttattttatcttatttgatcaactataggaaaaagaatttcatgacaacaaattttggaaataataactcaataagtagaaattcactgagagatcatgaaagttttgagtattactgtcggatataaaaggtctaaaaatgtgtaatgatcataaacctgtttgttgcaccttgctataaatgaccacctgtaatattcttttcatcttgatatatatggttgattgatagagatgggttacattatttgactgaaataaattatactgcaataagaaagaaactaagttacgggatacaaccttgaaatttctaaaataatcactttaattgaagaggaaaactgaattctcttctgaatcataacataagtgaaatatgaaggtacatattagtgatcagatttacattcccaattggtgaagcatataatgtattggcacgcttaatatgatctactccaatatgaaaggagggggaatgtaacataaaatttcataaaggataaaataagtgatacatggtgtcaccaatggacaggcagacggaaagcacacccagtgaactcaacaaaaaaaaaacttttgttttaatttggtaagccaattaactcaacatgaaagaatgagggaagagaagaatgtaccttatccaacttgaagattgatgaggacagaaaacgaaaagttgagaccgtgcagaaacacaaaaacaaatctcagctggtgtttgtaatggaacaatgtcgctgaaggacatcatggttgattcgtagtagttcaattactacgaatctcagctggtgtttgatgggttacactatgatttaaaggtgggtgtcatgacagccatgaaacgtagatgagggtttcctagttttgccatacatgaaaaaggcatgaaggcatcacgccgtggaatctcaatgatttgggggagcgataacgatcgcgacgttttcttttcctgccgttccaattgatgactacgggaaaagaacgatctgttttgcatgatggctggactggtgtggtggacttcaatgggcttcattgtaggcccgtccactagaagcctagggacatgacgtttaacgctgatcaaaccacacaattccaatctaatggtccaaaacaattaagatgatgtggcaaagcgagagagcaggaaaataaaattagtggggatgacttgtataggtatatagcactacatgaattctaggcttctgtgacgattacattatgacgatatcagcctgtttcgtgtcactgcctgccagcagtgatgaaatggctgtcatcacaaaaggtgggtcactaaccagcttctgtgaccaccaaaggacatcgtcattgatacaatgacgatagttctcctgtcattgatgaatgacgagacaaattcgtcataacaaattgaaccgaataacaccacgtgtatgatgacatgtgatacagatgacaaggcaggtgatgtagcaaatgacatggcaattcacattcggcccatatacatgggcttttttattctcaattacaattggcccaaatattttttttgacccagctacaaatttgcttttatgggccaatccaattaaaaagcaatcacagaatataaaccacaaccatttgaataattatattataatcacattccagccataattaatttcccagctcatacaaaagcaagttccagcattcagtttgcaacatgttccatacaaaagcacaaaacatgattacaaaatgatccatccaccatccaactacacaagtcccagccgactacaaagttcctataggtagtgccaagttcttgcaccaaaaaattccacctagcagccactacattaacacgagccatcaaattccaagctcagacacctcattcctgccatcaaaaggtgcatgttttcagttgctgatgaataaaaagtccattttgtttggatttggaggcaaacaaatgagcaaacagtgtttagagagtaataatccagcaggtaaattgagtaataacaatatattgatatggctcttttccagcaagtccaaacaaatggctcttttctagtcacaactaaatccaaacaaatggctcttttgcagctaataatccagaaaaaatagagtatctagattaatcaatgaaatggctcttttccagtcacaactaaacaatatctaatttcacagtaacaacaactataaataatccatcaagtaaattgaaataggcaattttgatacacaccatgaacaaaaaattcagccaccaatgaaacagtacaataggcttgatatggatgcaaatgcacaagaaacaagttaaagctatgtacctgagcatacaactagcttagggaggattgatctgaccttgtccaaatgctattatttgtcaaaagaggtcctgatggtgaagtgagggattcccgggcatgcatatcctcctagcaattaaagcaaggtttcagttttgcattattatataaataaaggttcattacgatttatcacatcttattaattaaaaaaaatagcacatcttacctcactacacaactgtgtccttggagattccaaatgtataaaagaaaagacaagttttacagcggatctaggagtagcagaatcaatctagacctttcatattttctcatccgatggactatatctatttatactaccaccttaaccactagcagtagaacttataaatcaatgtcttagatttatactactaaaggagatcactgtaaaagcccttaaaaaaaaggcatctgcttggtcaatcttacatgtttcagatagcataaaaagactccgacatctcgtgcaaaaattgaacttactgtttacacccaaatttggcacctatggacgaaatagaggaaaattgccaaagtttggaaagtaccgggtttccttcacggggccggtcagaccgctggtatatgggcggtctgaccggctagtagggccggtctgaccacaggtatgtgggcggtcagaccagcagggtctgagtccaagtctgttttcgtcgggtctcaggtttccttgctcgggaagacatgttttgtgtttccattggtttctatcccgagttggacatggaggagggcctgtagagggcaaaaccaacccctatttaagggacaaggccggttcattgtaaaacccccaaatagaatttacttgaatcgttcttttactatgtttttctattttaccccagtttagtccatcttcgtcggtttgcgccgtaaaccgtccgccgccactgcgagagtgcgacatctctttgtaggtttgtcctgaaaaccttccgttttgcccacgagacgggtagttatcctcatatcgatctaaatcggcctagaggctgattttgatctctaaatcggctccgctagccggtttagctgtttttcctcaaaacccatcttgatttggccgtttggctagattgagatggttggcgactccatacgaccgcaaggcgtttaggtgttgcgatcgtgcttgtcgacttgtcaaaaaagtcaacacgatttttgacgactccgctggggaacgatgtaaccggccatatcacggccgaattttgtttaatctagtcatctcgtcgaatagtttgtttcggccaaacggccgaaattaatctataccttaattagtcgctgcactgttcttatcgctggattaatctattcggcggcgaagctatttggtcgtcatcaaattcatataagcacttgccgtgtgtatcgaaaatcattatcaggaagcagcagacggcttagcaacgtttccttattgtttcacacggcaacagagaaaagatcaggctactagagccgatctaccgggtcacaagcagcagaagcaacatcaatctgttagcacatacattagcacatctactgaagagaattaaaaaaaaatcaaagccgattcatattgtttcggctgttattgtgagatcgaatttctgaatttttgcttacacacgaggagacagaagcaattctattttagttgcacacacgcttgttatattcaaaggaaaaatcaacaccgtatattaatttatttagtcaaatatttcggctatgagctatatggccgaaattaatcaaggaatttcttcatcaaccatgatgagcgagaacgagatcatgccgatcacattggatgatttcgaaggagaagaccgcaagtccatggaggagtacatcaaggagatcacacaggaggcgttgatgagggcgtgcactaggactcgtcaaggcgtgatgaccaagcccgggccacgtcctaagttcgcttccgattttgtaagcaatgaagaggtaacacaatctatccaacaagtagcatctacaatagattcatctatgactgtttttaaagataggttagatgcaacttttgagggtaaatttgatgagtttttaagatttaaagtcggccctctcttggccgattttatggtaaaagataaagcctctaccactgctagccaagctcctatagatcaaacaagtagtggaaccaatggagtggcgcatatagccggtctgaccgggcctgatggccggtcaaaccgcgacttcaccgtcggtccgaccagccaaacggccggtccgaccgggtattatcccggcagtcagaccgggactcaggccggtctgaccgcgcctctggatgtcgctcagaccgggccctagaccggtcagaccgacgcaatcataccgattcaggggatagatccaatgaccaattctagttatttgtatcatcttagaacatttaatcctcctgtatctactgctgcgactaatccccaagttcccccacatgttcctaatgcttataatgatgttgctagggggtatcatcccgatactaggcaaggccaatataatcatattgcgccgcaaacacaacctattaggccaccaaatccaccaccaaatcaacataggcctgataatatggaggaaataactagtgggattattagggataaattcgggattgaaactaggaattgtgctaaggtttaccaaaagccgtatcctgactattatgataatgtgccatttcctcgtaattatagagttcccgaatttaccaagtttagtggtgaagatagtaggaccacatgggagcatgtaggtcaatttttagcgcaatgtggtgaggctaatagtgatacttttaaattgcgcttgttttctttatctttgtccggtaccgcatttacatggtttacttctttaccggcaaattatatttatacttgggctcaattagaacaaaaaattcatgatcatttttgcactggtaaaactgagcttaggttgtctgatttaacatcggttaggcaaaaataaaatgaatctgtcattgattatattgaaaggtttagagatattaaaagccgatgttttagtttgaaaataactgacaagatttggccaacattgcatatgatggattgcttgattctattaaagagaggttgaatggccaaatatttcttaatgttgatcatgtgttatgtgttgcatgaagcactggctcaggaaagccgggtggatgataatagcttaaatgctagtttagatgatagtgcaatatcatgtgtagccgaaccaagcgacggttcgaattgtgttaataatttttgcaatgatgccatagcgattatagccgaaccaaatgttggttcggattgtcttactagcttggatgataatgcaacaaccattatagccgaaccaagtgttggttcagattgtgttactaaattagacaataatggaatagccgaaccaagtgatggttcggattgtgttgctagtttagacaatgacatcattgaaaatatagccgaaccaagtgacggtttggattatatcacaagcgaaagtgaaatagcattgtcacctaagaccgaatcacaaatcagtcatgtggatgttggaaaagataatgataatgtcttgcgggatagtagtgagatagaatctaaaatagttatgcatgtatcttgaacatgtagattcggtcccatatccgtaaggatttgaggtgcccaacttcatgaaattcacaggtgagaatgctatgactacaatggagcatatcggccaatttattgatcaatgtggtaaggtcggtagtaatgatttgcttaagttaaaattgtttcctctttctttgtcaaactttgcatctacatggtatagtttacttgctcctaattcaatttctacatggtcataaatggagcatgagtttcatgattattttaaagatgcaagcttgatggagcaaagaccgattgatacttcatcggtcacttgtgaaactatttcggttacatctatgcctaagaccggaattgttagtgatcctctccctgttagttttattgatgttggcaaaaagaaagggaaaagtgttattattggggatcctcggcccaagaataggataaaaaatgcgaaggccgaagatcataaagttgcaaagggtgagtcatctagttcccaaaagaccaaaaagccgaagctcacttttgagatgcttatggctaagtacaataaaggattagccggtcaatgatttgataatcaaactagtgattcaaaaagaccaagatcatcttgtagaaaaagatttggtcaaacaccaaagcaatcggagccatcaactataccaactccatacaaacctccggtagtgatgccatggtatccatatccaatgtcaccatttggttatccttttatgtattatatgctgtggatgcatcaaccacctatgccgtattatcaagagtggaaggaatcacctaggtcagtaccaactcattcatttaactctagtcaagaccgtttcccacaaaagaatcggtccggtggatcaaaggtgaaaaaggtaaagaaggtgtgggtgagaaaagaagccaaagctccggaggtcgtcactattaaggaggaatctcaagatgttcaagtacctactggcacagttattaagaccggaccggaccggtggtcagaccggaaaaaaccggaaccagagcccccgccggtccggtccaggtaaaagatgttcaagtacctactggcacagttattaagaccggaccggaccggtggtcggaccggaaaaaaccggaaccagagcccccgccggtccggtccaggtaaaagaccggtatgcaattgagccggctatgaaccggctagaccgcccggtttcggagaaaaaccgctattaaaccgggaataaaaaccgctttgaaccgggctcttgacggctggcgacgaagcgcgtgcatggccgcatgggcacgcgctggtgggggagaaaaatgagtgaaaatacgcgctagggtgaattagaacccaggaccacatgggaggaagctaactcaccgaaccaccacgctaccaagcgccttgtgtttggacagaatgattaatatatttaacacgtattgaaccggattagaccaacggcctaaccggttgaaccagtgaaccattgaaccgagagcctcaccggttcaattaccggtccggtcttaataactatgcctactcgagatgcggcgaaaactatacaagcggagaagattgaagccgataccgttactgtccacatcggcggtctgaccgaggcgtctggccggtctgatcgccagactacggccggtctgaccaaccctcctggccggtctaaccgacggcttgcagccggtctgaccgggcccagaggccgatcagaccgaggggcattaaaggtgagcgggaaaattgagagcaacacaggagcttctacttcgcccaaaactattaagaatcattgtttagctcctggaaaacaaccacagccgaagtggataccttctggcttatctcgctctcaaaagaggaggctacagcgtcttcgagccataggtcaaaaagaaaaagacgccgaagatgtagagaataaaacatgtaataatttagagcctcgaacgacacctaagcgagtgtggagacctaaagaagtaaaagttaaaagatcggtgatttcatggagtagtgatggattcaatttgatgagagaagaatcatcggtcattaaaaaaagggtttgttggaaccatgccaccctaattttgcaaaatttgagatatgccacccgtatctcaatgacatgtaggacccacatgagtcaatgacatgtgggtcaggatggcatattacaaattttgcaaaatttgtgtggcatggttcaaattttcccttaaaaaataagtctccttcacatgatgctgtggatgttggtgcggtgttcgtcttgcctttgaaatcgtgcagtcgagaaagccgattttgcttggggggcaagacattattatgcttatgaaggaaccaagagaggatgaacggcgatagatacaacatcacatctttgagctgtcgtttgttggatgctaaggcaatgtatgggtttattgtgttcatcatcatattatatgcctatgccatgttagaacattgcttactatctagcacatgtgtgtttttgcttatcaaattgatattatacatacatgttgcaaataccagttctaattagtggaattggtaagttggcatataatttgtttgaatgtatgatttggctcatgagtctttgatatttatttgaagccaaattatggatgtttttatggatcgccatataatatatagatttcatatttattgcaccatgaaaattttgcttagtaattccgctaatgtcaatggtgaatatgatgatttgctctagagtggttttctttaggaacattgggattattaatattttgcatacatgctcaagccgattacttacatttgtagtttattcgaatctatgcatgtgacacatatgattttggtgattcattattgatcatacttcaattggctaagtgttttgatgccatgatgattattgtttcaaaagccatttgaattagtattcatctagacatgttagttggatgttatagtttttcatatgtctagagagaaggaattttggtccaataatttgatacaccaagcatctggctattatgtgaaaaaaaattatatactaaaggccgatgcttgatttcaaaagtttggacgaaattagcaaagtcatagaccaggggcggtctgaccggcattgcacggccggtctgaccggtggtaccggcggtctgaccaactctgcatgaccggtctgaccgggtagatagggcggtctgaccggtattgtgtggccggtctgaccgatccccgacaggggctggggggcacgttacaattgattaaaaggccgaattaattgtgaattcggacatttgtgcccatgagttagaaatagcttggagaattcctttgaatagaatatttaaaagatcctagtcttaaggttgatcaaaaattcagcggcaagagttcaaatacactttgcttgatgaagagttatatcgccgaaatatagatggagtgctattaaagtgattggataatgatcaatctagagttgctatgggagaagttcacgtagggatttgtgaaattcatcaatcggcccataggataaattggttgcttaggagagtggggtttcattggccgaaaataattgatgattgtttcaaatgctatagagggagtgaagcttgttaacggatcggcaatgttcaattagcgcctaccgctgtgttgaatcctatcattaaactatggccgttccgaggttgggctttagatttcattggtcaagtttatccttcgtcatcaaaagggcattggttcgtgctagttgcaatgggttacttcactaagtgggccgaagctgtgccgctcgagaatattacttacacggaggtaattgactttatttttaaagcatattgttcatagattcggtattccttaaactttgatcgaagatcttcttttatgtccaaggaggtgagaagttttgccgaattttatgattttaagttgttgagttcttctctttactacgctcaggctaatggataagccgagtcgggtaataaaatattgttgaaattagtcgaaaggaaaattgaagaacactcaaagaagtgatatgaggtgctttcagaggcattatgggttcatgggatatttaaacatgatgctactaaagtcactccttttgagttggtttatagacaaaaagctgttttgtcggttgaggtaaatcttggctttcttcagtatttcaagcaagacgacttgttgattgaagattacaatacctttgatagaaggcaattttgaagacgtcatcaacaagcgtttgaagactttgaggagatgaagatacttcaagacggtgttttcagagagcaatcaatgggaaatacttgaagaaatacttcccgagcatttggcaagatgcttaggaagtcctatggccggtaattagattatcgccctgagataacatgttctatgcttttaggttcacgtatgttcaccaaaaagacgggggtatgtgtttacacccaaatttggcacctatggacgaaatagaggaaaattgccaaagtttggaaagtaccggttttccttcacagggccggtcagaccgcaggtgtatgggcgatctgactgcaggtatgtgggtggtcagaccggcagggtccgagtccgagtctgttttcgtcgggtctcgggtttccttgctcgggaaggcatgtttcgtgtttccattggtttctatcccgagttggacatagaggagggcctgtagagggcaagaccaacccctatttaacggacaatgccggttcattgtaaaacccctgaatagaatttacttgaattgttttttttactatgtttttctattttaccccagtttagtccatctttgtcggtttgcgccgtaaaccatccaccgccgctgcgagagtgcgacacctctttgtaggtttgtcctgaaaaccttccgttttgcccacgagacgggtagttatcctcatatcgatctaaatcggcctagaggctgattttgatctctaaatcggctccgctagccggtttagctgtttttcctcaaaacccatcttgatttggccgtttggctagattgaggtggttggcgactccataccaccgcaaggcatttaggtgttgcgatcgtgcttgtcgacttgtcaaaaaagttgccaacacttaccaatgtggtgaaaacaactggaagaaaaaaaaacaatgcagagcatccagctaagatcgatgtataaagcaaaatatatcattagtcccttatgttctactactccatttcagaacattagccagctttattggtaagttcaatttcagaacataaagtcgacagatagcatcgagagtatcatcacatttttacctatgagctcatcctatatacaagatgctattataaaagtcggtgcactgtgttagcttactagattccaatataacatagaacaataaaatcaacggaggaaagaaaggcaagcagtgagacacaatacttgtgcagacgaaaacagccagccacaataaaacagtccatggcatattcatattataaattatagtattatactagcaggaatcagctggaagctatgaaaataggagctgctacataaaacaggactagcttggtccccggacaaatttaggaattagctttagctcttactgaaaaggtaacagcatgaatgaatgaatgaatgagttctagggggctagactgctagggttacacacacagttcaaattacagctaaacagaggcaggaattttggcacgaagcagttcatagccagaaacacttcgatcaatttcatccgtaaaggaacaccagaaacacgaattcatcgtagtgttcgatcgtatctgcgagacgcgactagaccacacactaatctaagcttcccacgcggaggaatcgccaactacacgagctctcacacgagtaaaacaaataaaatcaaaccccccagatctagcaactccgctccggagaccagggttttgacctcacttacgtcgcgggggttgggggagattgagatttaagagtgagggagatgaagtgaagggacttgtctagtgtactgactggggtggcgggagcggagagccctgtcatggtcggtgctccattgcatggtggacgccgccgccaccggtaactttttcgccggagggcgccgcgg

SEQ ID NO: 35164 - DNA, 5333 bp, Oryza sativa
  unsure (1)..(5333): unsure at all n locations
cgcggcgtcgtcgaagacttcgcagcagacgacggagccctcggcggacggcgggaaggcagatcgcacggcgacgaaggagtcctcgccgncgtcggtgaagggaaggtagacgcggcggcggaagtcggccgcggcgtcgtcgaagacatcgtcgccgccggcgaaggcctcggccgtcggcggggaggcagatcgcacggcggcggaggagtcctcgacggcggcggtgaagggaaggtaaacgcggccggcgtcggagtcggcggcggcggcggtatcggcctcgggcatcggcggagtcggcctcgatggtgaggaggagcgacgacggagtcggctgtggcgtcgtcggagtcctcggcggtggcggcgtcggcctcgggcgaggaggagcggcagcgacggcgaagtgaggaggagggagaaggatgggagagaaaagaagcgaaccgttttttttaatggtataggtgggtaattttttttccccaaaagcaggtgaaagcaggggtagaggtgcttttgagttgtactacaccaaaagctggcttttggcaaaagtagctgtggcttttgagccctttggttggcttttagcttttgcaaaagcaaaagcaggttgaaaagctcaaccaaacacacccttaacagtatttaccaaattgtatggataaaacgaacatttcaccttaaattttatttttggcatgaccgccaagattggcgcctaaaaatttggttccagccacaccaaaattttggcgcctctccagcattaacttttttttcaaaaaaaaatacaaataatatcttgtactttttaattttaatttatgagaactttaaatttaattttagactgatttttatgtttcaaatgcaaaaatcataaacaacaaaattgtagaactcatcgagatctacaactattgtattggtcctttttacaaataagttcatttgaacaattcaaattttaaattttcaaaatttaacaacttcaaacaaaaattgggtttaataaataattttaaatggaaaagtcaccaaaaccaaagttgtagaacttatcgagatgcaaaatttttattttggtcatttctccatctgactctatttgaataatttgaaatttgaaaaattcaaagtttgagaacttcaaatataattttttattagtgaacgacttcaaataaaaaagtcatcaaaaacaaagttataacatcaatatctataacttttattttggttttttcttcatccgataaagtgatagtaacattgttcacaaaatttatatatctctcttatagtttataaactatataagagatgtgtaaattttgtgaacaatgttaccatcactttatcggatgaagaaatgaccaaaataaaagttatagatattgatgatttatacaactttgttgttgatgattttttcagttgaaatcatttagtatttcaaaaatgttgtttgaagttgtcataatttgaaattcaaattcaaattattgaaacaaagccatatagcaaaatgaccaaaacaaaagttgtagatattgatgacttatacaactttgttgttgatgactttttcagttgaaattatttagtatttgaaaatgttgtttgaagttatcataatttgaaattcaaattcaaattattgaaccaaagtcatatagcaaaatgaccaaaacaaaagttgtagatcttaataagttatacaacttttttgttgacaattttttcaattgaaatcatttactaccgaaaaattatttgaattgagaggagggaggaaaatagacttccttgcaagggaggagcaaaaggactgggccggtggcctgaagagggaggaagagagagaggggctgcaggctgagggagggtgagagtaatacttgggccgaaaatggcccaagtacatagagaggaattttaatttgttttccatttattataataggttaaaatgaactttgtggtatgaaaattagttattgagctccgaaaattcacaaaaaaatttcagagaataatttagaccacgtagaatattacaaatatatttccagccatgatttttaaagcaaaatttttcgtcactaagcctccccatctcatactaattaatcgtcataaaatggaatgtgctaatgacgaatagctccgatgttacgagaaattcgtcatagaaggtcatatttcttgtagtaatgtaggttcaaaccaacttatagccattttaaagttttttcattcaatcataaaatgaaacgccataattctgatttttttattcataaaataagactagcgatgacttcaatcctaaaatactaaaatgagagacaagaagagtccacctaggacaaacgatttgtgatctagcagcaatgtagtataacaagattttttttgttttttaaaaatataatagttctatattttatgacgatccactattgtcatcgtgctatcttcacagagcccatgcaaagtatactatgatgatgattatgacaaatacacagtttggtcataaacagttatcatcctatgaacagtcgtcataaacagcctctctgtttatgacatatatgtgttctgtcattaggtaatcgtcacagaagcccagatttgttgtagtgtaggataataggtgaacaacatggatctagaacatgcacgatatatgtataagatatgctcccccaaatatatgcatataatggaatatataatggagacaaatatatgcataattagagaaaaaccaatggggtttgttccctacacatggagaacgcatgtagcaataataaagacacataaatacaaaccttcattatgttgatgttctcaatgtaaagaagactaaataagataaagttcaagtaaacattggtctcactcatatatactccctccttccaaaagtctcagtcgtattacgttttgctccaagaccaaggaactctccgacgcatttaaccatcgctacatctgcatggatttagaggaagcgacgcttcggttgatgcacgatacgcgtgtgtgcaacaccgcaaccgtccgcgcccaccgctcgcgaataggcaacggatggatttgcatgcatgcaaaagaatactgttcggttgctgagaggaattaaatccatgcatgtttaacgaagagaccagctacacatttaaagcctgcatgcatgcatgcagagtggaatgcgcccatctcatctggaaaaacaagaaaaccaaatacgactgagacttttggaaggagggagtattgactaggtgattccccgtgctttgctgtgggatttacgaaggaattctcaaaaaaaatggcaatcaagttagaagtaaaaagaaaaaaaataataaaacatcaggtttatcagtcaaatcatacccatgctttggtcaagcattgactaaaaacacacgatattatggattacaaagattgtatggataatcaatatcaaaggtatggcatataacaaagtaggacattcacatataaatagcatgcaaactttatttaaatcaaaataagttcgcaataggtccaatatgctcaaagattagtgatgacttgccttgctcactgtcttgctgtccttgttttgcagtcaactcaaccactccctcggaatctatatgtacgtgcgaaagattcgatttgaattcaattagaattcaaattaaatcaccaaaattcaacagtacaaaaataaatagcaaaagtgattccatcagctatatcttgattttagatgaatttaggttcaagtttcatttaaatccgagctaaaatgagtgagctatgcttgtttaaagattcaaatttgaattaattcaaacagttgtgaaatggcactgtgcagccgagaggggcatgattacagtggctgacatgtagggtcaccccatttctttttcctttgtttttattttcccatagaaaatgcagagagtcattgacaagtgggaccggccctatttgacctgggtccaaaccagccctttaatcccggtgggtcccgcatgccattgacagtaacttcataatcaatttttctttgatttttctaatcatccaatcccacgtgtaatagattaatttgcattggattaataggtgattactgtgcactaatctctatgtggggcccacagcttctctctctctcttcctttctttctctccctcggtcgtcttcctcctcccgacgcgcagggcagcggcgcgggcgcacggctaatgcgaccagcccgagccgggacggctcggccgtggtgagggaagcggcggcgcaccaccggagacccaccgccggcagcaacgaggcgcggcggctacaaggggcatgacgcgacggacgggtggcacggagctcacggcgagctcggccatggcgcgggagaggacgaattaaacctaaccgagcctaaattcaccatctagggtctctagtgaactaattcatgcaataatatggcctaggttagtttggaactagtgccgtccacggtgagctcaacggtggcgcaatggcggcccgtcggcaggctagcagcggcacacacacctcaaatcgagggggccaaatgtttctaggtcagtagagggtgctaagagcgcaagtatttaccgtgcggtggagcaacggcataggtcggtgatgcgcggcacggtgcgggtgaagcaggggcgaatcgacgtcggcagcgcacgcaggtgttcgacgcactctccccgacgtccagcggctcccggcgttgatgcaaggcagcagaagaagtagaggcggcccgagccacagctcccgcggtcagctacgccggcttcggctccaaccagtgatgatgaagcatgctcacaaggtgttcgatgaaatgtattcgaggaaaaggcagatagggatggagtttttatgggggggattggcttggggataagccaggatggcgtggaggataggatcggcagctggtgcactcaatggctgtctatacggcctagattagggaggttgacgcggctatgtttcctcctccttttccattaaagttctgtagcagatcattgcatctatgacccctatactgtgtgttctagccctagctagagaggaaggctccgttttacccgctggttacaatggaggagggacccggcatccgcattcggataaggtggcggacgtggcgacggcgatgcgcgcacatgccgatggcagagcggcggcttggtgagggcgggttttcgggtgtagggcggttggatagggtttaggggtggtgtggggg

SEQ ID NO: 35165 - DNA, 5336 bp, Oryza sativa
ctcggtcggcggcgggcccactcggtgtggcgcacgggcacgcccaatgcggcgcacgatcagagaaggcgcgtgcgcgtgcacggggaggcggatgctgagctgggtgtttggccgggttagaaccgagtcgaacacctggcgcacaatgaacagagccaggctgtaaatttagggtttttgattgattttataaattgaggaaaaaggtctatttcaatttatattttcaccaatgcattttaacgacaatatgaagtattcaaatgtgaattttgttcaaaattaatattgtccaaatttttaaattgtactataccttttatgatttcctatacttttgggattttggtatttattcgttttcaccatgtgttggtttaacataattatcctatataacttgtaggcttggacaattattaattataatatactaatatcaccatattaatacaatggcacattggtcgagtttatttgtattaacaatgtatttacacacggataggtttaatctatttatttcacaaaagaaattgagacttggcacaatattgatctaaatatttaattatatactcccatcattcaatctctatatataaagatcaatttattttatgtgatcaattattttatatgagtggatgccatgacacagtcacaatattaatatttgacctataaattaaattagtaattaaccttctctttatatggctttgttgtgttgtgcgtaaatatctatagggttcataataaatatcttatttttataattgttacgtagttgtatagctttagcttaatcttcaatcgtgacaatttatagtttggcaagcaatagcaaccataacatccaacatgatgcaaaagttttaaaaagttcaaaattttagtgatttttattgtcaggaattttcaggatgttacaatgcattgccagcaatgttaggttcgacaacactaccattgttctggtcataatttgtaattcacaacatagattttgggaggcaaaatgtttgcatgatgggcttttctgcagtttcgtggatcattaatattgatccctacagtgttcaattctggtattgtttggcaatccaggacgaaatatgtagtgatgtcagatgttccttttttccagttaataatttcagatgttcttttcacagcacctaaagctttgcggtgatagtagagtcgccaaccacctcaatctagtcaaagctaaatcaagatgggttttgataactaaaccggcttgcggagccaattctagatagaacgatagacaactacccatctcgtgggaaaaacggaaggttttcaggacaaacttaaaaagaggtgtcgcactttcgcagcggctgcggacgatttacagcgcaaatcgacaaagatggacaaactaagcaaaaaactaaaagcaatatgaaaaacgattcgattgattgtttgtagattgattagttacattgatgcaaaagtttggcaagcaatagcaaccataacatccaacatgatgcaaaagttttaaaaaattcaaaattttagtgacttttattgtcaggatttttcaggatgttacaatgcattgccggcaatgtcaggttcgacaacactaccattgttctggtcataatttgtaattcacaacatagattttgggaggcaaaatgtttgcatgatgggcttttctgcagtttcgtggatcattaatattgatccctacagtgttcaattctggtattgtttggcaatccaggacgaaatatgtagtgatgtcagatgttccttttttccagttaataatttcagtatgttccttctttttcagatttcagatgaagaatcatcgccactaaaatgaattttctggagaaatggacaacaagattttcgctatagtgtactccctcggaactggtaaaggaactcgtaaagaaaatcgttttggacagcgacacggtctccaaaatacaaccttgacttcttgtttctctaaaaatatttattgaaaagtgatatatgtatacttttatgaaagagtgaactgcatgttggactatattttcttacccttgtttcacaatgatctaggtgttatcaaacatttttattttcaaccagctatagttacttgagcatgcaatttggactagacgctcacatgtcaaccagaccaggtgtgtctctccctcttccccttctctcttcctcctccagaaaagtcatccccatccccactatcgctccctccacttacctttccagtctgcctatagtagtctcgctgcccatctgttgtttccgtcgagcttgagcatctagattaggagcttgatgactagatcaagcactaaaccagatcctgctgccgctaccgttgcaagagcaatcagcagaacacatgggagaaaaaagagtagcttcagggcagggcagttgaggcgccacagcggtgcaagtggagctcgagcacgtggcatgttaggcggaggtcgagctcaagcacgcagctggcaaaggtggccacagatggagctcgagctcgagatcaggggcaatgtagacaaagctcctctcttcaaggccattaattccccgcagctctcaatacctcaggctggtggtgttgtgctcacctgccggcttgacccaatgtcactgccaaagttacaaacgattggcagccagcagcatcttgatgtaggagcaagcagtggctgagtggaaacaggggatgtggaaatggatagggtggtctaatgtgcaacccaaggtaaaagactctggtctaaactaaaaatgttggatgtgccatggtccaaagtgaaactttggtcataataactagcccaatatgcaattcactctttatgaaattatttttcaagacaaatttattcatataatttttacaattacaaactcaacaacttaagagttattcatgatttatattccaaaggtttgacttaaacagttgtcctaaacgagtacggagggagtactaaatttttggatcacttttattttttttttggccctactcatacacttgaaattttatggttagccctactcatacacttgaaagtaacaacatgtatgtatatacaggcatacaacacatgtaagcatggcctatagcggaggagaggaaaattaatcagcaaaaacatggctgcttaatatttgtagagacgtgtggtgcacgtgcatacttactggtaagtactacctccaattataatcacataagtcgtttgactttttcctaatcaattttttaaaagtttgatcaagttaatagaaaaatataacaatactttctatacaatacaacatattatcaaatatatattcaatgttgtatttaatgagacttatttagtgttgtaaatattgctaaatttatctataaacttagacaaaaaacttagccaaagctaaagaaatttgagtaagaaaaaaactaaaaccggcttatgatatgaaatagaggaaatataatatattaaaacaattattgaagccaaatctagccgtaatatttctaaaagttgaatctaaatattcaaagagatattagtggtcaaagtttaacatcttgactgcatgcatcataaaaacatcacttatttgtgacggttggtaagaaacacattccaggagtttaatctagtaaagttgaccaggtcaccttcatcgagatagatgcaagctcacccaatatttgttgactggaacatccatggttgattgctttgaaagaacaatagcgttcaacataatggttagagcctttttggcctaccttcaacttcaaatgcatccaagtgtccaaggatacagcaaccacatatcttcttaagccacatgactcaccaatagggccattgaagagttgaatttctttccatacatcactaacaaaacacaaggaactgagatataaattgaaaccactttgcacatctgatatgataacttgtatggtggcctctacggcccagtaaacacgtgctaaagtgatatcaactgcaccacaatcaccattaatgcgttttgtgaatggaaacgttgctgtaattagcccgatataatctattgctccatcaattaactgtaggtcatctttttcttgctctcctttttttatcctcatgtcaaactccaatagaacagagcaacacattgatatgcctcgcttggggccagtcatttcaatcagatctccctaaaacatcattaaaattatttaatagcatctcatagtaaactgaatgcaaagcttgatttcttttctagcaaagcataggcagatctcaaataacagtaacataaattataggcaaatttggccatgtgacaagatagtttgtactttgtagcatgtgctgtaggacactaaaatcattggcgcagctatggctatgccgcataattttgcaactatctgtggccactattatacatcttaccaaaacaggatagagaatctaaacaagaggtaaatttacccttgatttgagtgtttttctctacgttacctagaacagaccatgtgcgcctcatctttcctaactaaactactgtatggcctaaccagtgttcataacagtccgagacaattcaacagttcagttgacaatgaaagaagtcatacttttgatccgcaaatggatggatccagaactggtcaggcttaagtcatccatttggtctagcaaacaaattaaggtcaaaagtttctttcggtttatctctggtttaagtcacacatgcatattacgataattgccagcgtgtgttatccaaatagccacaaaactagagcgccccttggttgagccacaatttttttcttgaaagcacacgagagcattgcaccacattttattgtctcacaacaaaagatgcaaaatataggcacttttgcctaattcgaaactaatatataatttctccaataaacataagttgtccacaaagtaaattttaaagggttatgaaacccaacaaaatttatcatgcaaacaaaaaaccatcaatatgcggatcgcatataaaatcatggcatgagtgaatattttttttccagagtacaaataaaaatgaaagcataatttgcagatcctctaaggctcatgtattcacgaaacaatccaggtaagattttgaaggtggagaagatttgcgaacttaaatatttattggaaacaagaagtcgaaagggtatttatgtagtttaatgtctaagaaaattataattgtcattcaccatagcagtagacttgtctaatatcataatgacttcaaat

SEQ ID NO: 35166 - DNA, 7162 bp, Oryza sativa
tgcagcataggtcaagcataggttttttctgggactattctaataaaataacatgagttcttaagtaagtacgcagaattaagagaataataagtccggcaccaccaaatacactctctaggtctaatagccacattggttaggacaagaatatgtaggcttttcttattacactttatggctacttatacatatgtgggaatgctgggaacatttcatggccataaatatttaggcatgtgtgttatttgtgaaattttagaaaaacaatgcatgtttgcatatgagtacgtaggtagagctttctaacataatcatgtatatgtgttttatgattgagaacaactaattagctattacattttaattttatatttgtaaggtgttttgtcggatcagtataatttttggagagatatgaatgatgctttagtgctttatgctgcagtacagctaaggttttgaaaactggtattcacaaaaatattggtctcctaacctccaaaaatttaaacttttgattggtaaatttaagaattgaaattttaatttacattaatatcctgccgaccagtaactggtacctaaatgacccgtcttaggcagttacataatagatggtatgtttgaaccatagatatatacataatgagcagcaggatcggctagaattacaacaatatttggatttcacctaagtggattgattgcacatacgaatgaaaacaatagtaggaaagaagaaaatataaagaaatcatattgtagttagagtaacaaatttacttggcattttggttaccagaatccatattatatttattagtactaaaacaaatcatatcaaattagaaaaagaaggagaaggttttgatcacttactctcatcgcggttagtgatacagaaatgtccttcaaaggccttatttctatatatagaaccatcacggtgtcttgaattctcaatgattgtcatcgagaacatgtcaacagcggaatggctaacaacgagcccattaattccccctctcttctctgctcgatacatctcttcagtgacagctcagtggtcgccttgggcagtgttgtacaaagatgcattggcatgaggggggaagcatctgctccgaaatggcttgccccatttgttctcccctttccctccaatgctggttgttgttgatccatacgaaaacctagtaccaaggagcacaaatgactagtgtatgggtcaaataagatactaccatatatcatcatctgctatgtggggaattcccttggaacgtcgcaggaatgcgagagaccagtaagtgcgcatggtgcgccacagcggtgttctcgccatcatgtgttgctcgcattagataagaattatccttaatgtttgaggtttgtttcagttagttcctattcattagcagattgtaatcacctatagaaggccagttcgtgatggaataaatcaagaaaaaattaatctacaaacttccttcctttcttacaccacggctccggggagggcgaggcctccccgtcgagcaccgctacaaccttcgcagcagtaatctctttctactctacaaatgaagcctgctaaataaataattgtaaacctaaataagctgatgtatcagattgagaacttaatttcttcgaatatatatcaatttcaatttttcttccggttagatttaatgtggaattaagaaaactttgtccgaatttgattttaaacactctagattcatagttcgcccaatccagattcaaaagaaaaaaaatcagcagaacgagctacagaagtagggaaacggaagaactcaccgggaagcccgttgtagatgccgccatgagtggagcatctcgctgatagggatatatagagggggaagagaagccacagcacaaggcgaaggaagatcggagaggcccggcgtcggattagggtgagagcgtccacagagacagggactccgaggagctacggctctggatccgccgcgctggtcgacctggattggatggggcttctggttaggctgcgggaatcgctccagaatcaagagctagcgcgttcctgtaggccttttgggaagaaaattttgtgagacatagggtttgttcatttacgagtaaattgcattgatagtactgtttagagcatcatcaacagattatctataattttctcctaaaaatttatttttggtttcctaaactgaaaataagaagtgaaaaaactcctctcttcaagagatagcctaaattcaatcttcaaaacttaaaagtgggcccttacgttaaactaccaagagaaaattccgttttttttctttcacgcgcagaaagatcgctatctcccacgcgtgggaacgaaggagagaggcgggattgcgtgattgggagcgactttcgcgcccgcatataaacggagcgaggaaccgggggaagggaactccaaaactcgggtagaagcgtaggagatctgttggagctgacttttggactaaaatctctcaaaattagttttgggaatcatataggtagactgttggtgatgctcggtgtaacttactgtataaacttgtgaaatgatagttttgatacatgaatttatctagttcgtgcgaacaaggaccaaaatagcttgacaatgttaattttatgaactgatattgattaggatgtgacgtgcatacgtgtagcgagtatactaagatatgtaatatttataaatttggtctctactttaattatcctttatcatggaagtgatgaattttatatatttctaacccttatatcattgctcggtttttttatctttttctacgaacactatatccattctatttttattcctagtttgcgtgcgtgcgttcatacaggtgagtgtacgtgcgttgtaagtgtttgtgtcgtactagtaattttaaaaaaatatatattttatctaaataaaaatgattcatacaattaatattatcagcaaaaccagatcaatagatttgtcaagctataaataaatgaatagtaaattgcatcgctggtacacgaggtgcaatctagttgacgaatttgtaaaatgctcgttttggtgcatgaacttatctggtgcgtgtggaggaaggaaaaaggacaccacatggctaatcttattaatgtaggggcttattaggatactatataaacatatatctaagaaggtttgctattagacatacacgggtccagatatccttagatacccggcctgatgggcacgggcatgggtgtaatttttttcccgtgagcatgcccgtccgagactcgagaacatagcgggagtagccgggtattgttttttgccagcagataatccatgcccgacccgatacatatgtatttgctaattttggtccatctcttattcctcatactataacatcccgggttttagctgtagtcctggtcacgctaatgacttggtcacactagttgagagcggtgtcgatggagccacgatgctggctaggacctataaatatgttgattgttgttctattatggatcaaataattttttgatcgtttccttgtcatttatttatcaagtcgtccatatccatatggatcattgatttatttatagttagagtaaacctggtgaggagtgggataatttagttttgtagcgtagattagttgtcacgaggtacacatgtgcacagtagaaatcacaattctttatttacaatttaccacgacaggtctgcatacatatatgcatataattgtacaatagaaatcttatacagcatgcatcacatatattgtgcatatacatggtgcttatagattatcataaactgaatcatctcagtcaaagattcaataattatttatttttcagaaaaactcttaagctctagggcaattgcatatcagtccctaaatttgtagtaatttacaattttaccatacttgagggattcaagtgcaaaagatcaaacacatcagactaccaattctccaataattagggaaattaacaaataggtctggttattccaccgaacaagctgtttacacctaaatttgatacctaggattaaaatagaaaatattaccaaaatttgaaagtctaccggtttcctccgaagtgggccggtctaaccgctgtgtgttgggcggtcagaccgccggttgagggccggtcagaccggcggtgtgtggccggtctgaccggcaggtccgagtccgactctgtttcgtcgggtctcgaagtttccttgctcgggaaggcatgtttcgggtttcctttggtttctaccccgagttgaacgtggaggagggcctgtagagggcaagaccaacccctatataagggacatggccggttcattgtaaaaatcaatctactatcaatcaatcgaatcgtttttcatattgcttttagtttttctcttagtttgtccatctttacaaaacccatctaggtttagctctttgctagatcgaggtggttggcgactctaggatcaccgcaaggcttaaagtgctgcgatcgtgcttgtcaacttgtcaaaaaagttgccaacacaagccatgttgaggtgtcacaggtacagaatgggaatagccatgcaagcaggtgaatcaccagtacaagatccaccagggataaaataatttgtgtgaatcatttccaacccaagtctcgttttggtcgtgcaaaacaacacaagcagcagctgcggcagtagtagttacaaccatagaaccaagctataggaaaatcagctagagtgttagctccacccagagagaaatagctcaactgaagtccagctcaaaccaatacatgaaccaacagtagtagtaaccatggccaagcaatcagagagcggtgaaccaaatctaaaggaaaagtagaggtgttcagttcttggatgaactccaactataggaggagatgaaacttaggtcaagaagcaagatggagcgaaaaatcaagcaagaggatcagtctcaagaggaggaagagaatcaccagtagcagatcaagaaagatgtcaggaagtagtcaagcattaccagtagggtaagagccaaggaggagaattacctgagttccaagtagagtagggggttcagttcaagaaggggaacaatcaaccaagctcaaggtggagaagctcagttctagcaaaatcaccttagatctaaaagagcagcagtagaagagaagacttggatttctgaaggaggagctgaaccacacatttttcaatcactgtagaatcatcagaggtaaccaaaaactaaaataggggaggagagtagatcctgcatttatagtaacagcatttgttagagctagagtttcatgcagatatataccatccatcctgacctaaaaccttagcaattctaaatgaataaaagtaacaaaagttgatgataaagttaaagataagttcatgtctttaaatcctgacatatataaattatcatagaagaaatctgaatagtaacaataagcgtctgtagctataattttttaataaaatcaactagtgttcatgacataaattatttaggaatagagcatatatagaagaaccaaatcatgcatgtaacttataagctttcagattctagtcatctaaacagggcataacattgacatgtgcatatttaattagaattagttataacctaaacaaatcagactctagttccaataatactttagagaaataagtagtttatattagtatccagtagaacatgtagcagcatgttcagtacaagaattattctgaatatatggtataataacagagtaggtatatttacttataacagggtagttagagtaaatgatatttagactagggcatgcatctattagctttcatcagtgtagttttgtacaaattttatcccacagtgaactgaaactgtttcaaaaatcaaccaatgtatttagttcttcatataagtaataccgaatctgcagaattaatatggatagcaagtgtaaacgtacatatttagtttaggtgcagatacatatgcaggaatctacgagtctttatcacaagtcctagaagaacatatatcagttttagaacgatggtaggtgatcaacataaccttgctaagaccaataccatagaacacaattaattacaagttacttaagtaatcagtacattttgatatcaaaatcaagattcataatttttttttgtcatttgatcactttagttatattactatgatgcatttggtatacaggaattcatattaattatctgaattactactcagcacaaggacataaggatctgattctctagtgcagtagcatgtaaaaaaaattcaatatcttgataaccattgcataagtatataaaaggatcaatcctgttattatgatattaatatctgtactaaaaaaaataaatacacatccttgattcatttgagcatgcatccatgtattcatccatggcatatagtcatcatccaactatagtaaatcaattgatttagaaccctagagccagcagtataatcctgagtataacactatctagttggtcattaggactagttcaagaataaaaattcacagcatgttaccacacagaagaacaccattcaaatcacattacagaagtaggtagagaaggggatcagagaggaggagcttggggagacacagctggtgcgagccatgcttcactcaagggcgctggggttggggaattcccaacctgggattttcggttggcgtcgtcgtcgttgggagcagcagccgacgacggcatcgatgggagaggagctaggactgcaaacattggggcttcgctgttttgacactccgagtggatgataaatgggtccatctgtgtctataaaaatgtgggtccagtgtcattatagcaaaagttaatgtttgcagtgtcataattgtaaatcccccccgatgaataaggttgggcatggatgaccaaggagagaagctgtatagagagatttggacggggaatcacgggaagagaggaaagaaagtgtttacccccaaatttggcaccaagggataaaatagggaaaattaccagtttggaagtctgccggtttttttctggttgggccggtttgaccgc

SEQ ID NO: 35167 - DNA, 18611 bp, Oryza sativa
ttccttactcgggaaggcatgtttcgggtttcctttggattctatccctagttggacgtggaggagggcctgtagagggcaagaccaacccctatataagggacatggccggttcattctacaaacaatcaatcgaatcgtttttcatattgcttttagttttttgcttagtttgtccatctttgtcgatttgcgctgtaaatcgtccgccgccgctgcgaaagtgcgacacctctttttaagtttgtcctgaaaaccttccgtttttcccacgagatgggtagttatctatcgttctatttagaattggctctgcaagccggtttagttatcaaaacccatcttgatttagctttgactagattgaggtggttggcgactctactatcaccgcaaagctttaggtgctgtgatcatgtttgtcaacttgtcacaaaaagttgccaacacgattttttgtgactccactggggaaatctgctcaacgtcatctcagctttgacgtcgccataacaaagcctccatcaactaaggcggaggtggaaccatccaatgtcataccaatcacattgaaggagcttgatgagggagcactcaaggccatggaggaacatctcaaggcgtatacccaggaaatgttgatgaagacgtgcactaggacccgtcaaggtgtggttctcaagccgggatggttgcctaaacctaatttcgatgtggtaagtactgaagaggtatcaacttctatccaacaacaaatagcgagtacaatagattcatccattgctactttaaatactaaattagatgcatctattgaatctcgttttgatgattatataaggaacaaactcggttctgtcatagccgattttgtattcaaagataaagcctctaccagtactagcaagcctcctgtagatcaaatatatagtaaaaccgatggagcgaatatgcaaacaacctgcgaagggtgggctacgcacacagccgattcaaccgggccaacggctggtcagaccgggttttatcctggcggtcagaccagtctgaccgcgcctctggacgccggtcagactgggtcctagaccggtcagaccggcgcaattattcctatacagggggtagatccaatgacaaacaatgggtttttataccatattccagcacctaatccccccgtatctactgttagtccccaaattcccccacatatccctaatgcttacaacgatcctactaggggatgtcctcccgatactagatatagctaatataattatattgcgccgcaaacacaacctattagaccaccaaacccaccaccaaaccagcataggcttgagaatatagaggaattaattagtggtatcattagggataaattcgggattgaagctgggaatcctgctaaggtttaccaaaagcctcctcctgattactatgacaatatcctatatcctcatgggtatagagttcccaaatttaccaaatttagtggtgaggatagtaggaccacgtgggagcatgtaggtcaattcttagcgcaatgtggagaggctagtagttccgatactttttaattgcgcttgttttctttttctttgtccggtactgcttttacatggtttagttctttaccggtaaattctattcatacttggcctcaattagagcaaagattttatgattatttctataagggtgaaactgaacttaggctaagtgatttgacatcggttaggcaaaaatacaatgaatctgtcattgattatggtaagggatttagggatgttagaaaccgatgttatagcttgaatataactgatagagatttggctgatcttgcttttaatggtttaattgctcctattaaggaaagattagttggccaacaatttcttgatgttagtcaactcatggaaaaagctccggctcaggaaagccgaattaaagatagtaagaaatttgttagatcatatgttaatttgattgattaccctgaagctagtgattctaataatgagggtgatcatgatatgtatgttgccgagtggtcatgaactaataaaaataagccttttgtttgttctaatttaatgccgactccttgtaaagatcgacaaagtgagattaagtatagctttgatgtggccaaatgtgataagatttttgattatcttttacaagaaaaacaaattgattctcgttctcattctacaatgattgctatgtgtttcgacgataggttcaatcggccatagatgaagaacgattgaaattttccgatggttccaagatgaagcttgatcatgatgcttttccggcgaatacaattaatttcaatgataagaaggtgttgatttggccgaagcaagccgaatctactaaggggaaaggaatggtcagtgaagagcctaggccaaagatgattgtgccaaagaatccagaagttggtgtttggaaggagaataggagtgaggcttcaagttccaaagctcctaagaagactaagatgaccttcattatgcttttgaacaagtatgagaagcaaggtggtgagaaaactcgcaataaaggaaagagaccaagatcatctcctagggagcgatttggtcattcaccaagacgttcggaatcacctacatatcatcgttctcaagacatgtcatgggggccttatccaatgccgccgccgggttatccttttccttactacgtgccatggggggcaataccgccaatgttcaatcatatgcctccaatgtaatacaaccaaggatggggaggaccaaggaggccagctcgtgagcgtttatcttcaccaaataatggttagttttatgctaaaaatcaggtcaatgaaggaaagagggaaggaaagcgcatcaaggtggagacaaggacttcagaagtgattactatcaaagtggggtctcatgatgtgctaataccttctggacatgaggttggagagtcttcaagcaacaaattcgaagccagaaccaactcatcgcagtcagccggtctgaccaacctcttaggccggtctgactgggccttcaggccggtctgaccgcctgtcgcaggccggtctgaccgggccttctggccggtctgaccgggcttcagcgccggtttgatgggagaatttcaaagggtagttcgggggtttcatcgtcttcgagtaaaatcaaaagtgggcattatttaccttctggaacagagccgaaactaaggtggatgcctaaggatttgacagctgctcaaaagaggaggttgcaacgtcttcaggcccaagaattaagagagagagagagaggccgaagagcaaagagatagaaggttcaatgagttgcgaccaccgcctacaaagatgtggaggcgtaagtccatagatattgaagaattggttgttgtgcaaaaggaggaggaagaacaatcggttgatgaatcatatccaaaggaagacatggatgtcaacatgatgtgtatgttgcctatggatttttgtgctatggatgaagccgaagttgctcaattttcactaggtcctaaagatgcggtttttgagaagcccgatgagtcaaactgtcatatgaagcctatttatctcaaaggtcatattgatgggaagccggtctctaggatgttggtggatggaggtgccgccgtgaatttgatgccgtactcgttgttcaagaagttggggcgtggagatgatgagctaaagaagaccaacggaggcgaaaaggtatcttttcggtggagcttatcgtgggaaacaagacgtccaaccgctttcttcatcgtctatgtgcaaggtaactacaatgttattttgggtcgttgttggatccatgccaattattgtgcgccttctaccttggatcaatgtttaattcaatgggacgacgatgatgttgagattgttcaagcggatacatcggccgaggttgcaatggccgatgcaacatttgagtggcgtcacggtaatattcaatgcttatcggggatggatctttctagctatgatttcattagtgtttctgatggcaaatttgtacctatttctgtaaagccggctaacatagcacgacaaggccatatcactttatgtaatgagtaaagaagctaatttagagtggttgcaaaaaagggtgcaagaatatcgatctacaaagaacgatattggtgaaactattgaagattttgacgaagtagaaaaggttggtcaagggtttacatcggccgatccattggaggaaatagacataggtgatggaactaagccaaggccgacttttgtaaacaaaaacatgacagccgattataaggttaaaataatcgagctacttaaggagtatgttgattgcttcgaatgagagtatcatgagatgccaggtcttagccgtggtcttgtcgaacatcagcttccaattaaaccgggttttaggccttataaacaagcaccttatcgtttcaatcctttgttatatgaccgggtcaaggaggagatttatcggttattgaaagcggggtttattaggccatgtcgttatgcggagtgggtatctagtatagtcccggtggagaagaaagggagtggtaagattagagtttgcatagactttagagatttaaataaagctactccaaaagatgaatatcctatgcctatagctgacataatgattaatgatacctcgggtcatcaggtgattagctttttggatggtaatgccggctacaatcaaatctttatggcgtaggaggatatgtacaagacggcttttaggtgcccgggatttgttggtttatttcagtgggtggttatgacttttggattaaagaacgcctgtgcaacatatcaaagggtaatgaatttgattttccatgattttctaggtatcatcttagaagtctatattgatgatattgttgtcaaatcggatggtatggagggacatatagccgatttgaagttagcttttgaaaggatgcgccggtatggtttgaacgtgaacctactcatgtgtgcttttggtatgtcggcagggaggatcttaaggtttatggtgcatgagagaggagttgagattgatcctaagaagatagaaaagattcgtgatttcaaagcgccgacatgcaagaaagaggtgcaaaagttactaggtaaggtgaattatttgaggagatttatatctaacctagctggtaaaatcgatgcttttgtccctatacttcgcttgaaaaaagaagccaattttacttgggggcaaaacaacaagaggcgtttgaggaattgaaaaggtatttgtctactccacccgtggtgcgggcgcctaaagccggaataccgtttcggttatatattgcctccgaagacaaagtcattggtgctgttttgacacaagaggaagatggtaaggaatatatcattacatatccgtcttttgggactcggattcggtgacatcgctatggcatggcacagtgtgacattggagcaatctggagcgttgaaatctgatcgaacggtccgctgcgccggcccacctgcagccttcattttcacccccaagcgctccgtttcctgccgcccaatgcccaatcccggggctcgcccaaatcccacacgcgcgctccagtcctgacgtcccgcacgcgcccggtcctgcggaggtcccaatcccgcaccggagcagggctgccggcagagttccaatcccgcgaaggtcccaatcccgcttggagcagggttgccggcgccggggaagtgcagcacgccaaccagccgaggccggggccagagcgcctgccccgccgtcgccaccggataggtgggaggcaggcgtgcccctcgccgtgattggggaggtaggccggccgccgtgaggccgggggccgaggcccctgccctgccgcaagatttcggggaggagggctgccagagtgagccaagcatctgcagaggaggattgctagtgagtgttgtcacatgtgacacaacttttggcacgaacaaggaatataggccattcggtgtctttcttgggctcaatcagttgagagaaaacactatttttggtgctgcacttctatttgatgaaacagaagcatcatttacatggttgtatgagacttttctacctgcacataatggaaagcaacctaaaacaatttacacggatcaagatgcagcaataggaaaagccataaagatagtattcacagaatcatatcatggtctctgcacctttcacataatgcagaatgctgtgaagcatttatctccagtgaagggtaaagaggaagatgaaggtgaagaggaagacgaaggtgaagaggaatcgcatgttctctctgattttagtgcttgtatgtttggccatgaagatgaggcatcatttgaagaggcatttcagattatgagatccaaagttcataagcaaacatggttagatagcatttacaaggtgaaagagaaatgggctgaatgttatatgagagatgtcttaatgctatctgtgatgtctgaatgctccaagtttctatatggctgtttatcaacttctatatggctgtttatctctttctgtgttgtctcaatccatccaccaattatggggacatgctgtcaaatttttcagaaaataacatcacacaagttactgatttattcatccattgattcattcaaattacagcataggtcatacaaccaaaccaatctctcaattttcccaggtgttgctgctcacaaaaaaattacagaatcattctcccagcagcaatgacaacttccttatcaaccacaatggttaacacagtgcaacctcaacaaattattgtttcaggacaatgcacagcctaaggtaatcaggttcaggtacaccatgaagcagaaggacaaacagctaaactactgctgctgcaatcttggagatagagaacaaacacctaaacaacaattttggaaaacaaatagctaaacagcatgaaatcccatcgcctccatcggcaccccgacggccggctgcctccatcgccaaggatgacggtggcagggcagggccccggccctggcctcgcacggttgccgcctggtcccctccccacttgcggcggagcggcgccttgccggctcccatctagttcgcggcggcggccaaacgcgggcgagggaggcgaagcgacgacacggtcacccggtcccctccccactcgcggcggcacgacagcctggcgtctctccggcctggcgcggtggcgggctgacgtgggcacgggagacgaagtgacaaggcggctgccttgctctccgctggtcgccgtctgggacctctacgccggcagccctgctcccagctcgcgcggcggtggccgcctccctattcgcggcgacggcccggcgtccggtgcgggcgcgtgcgggcggcagggagtggagcgtgtggattgaggcgagccgcgggattggggcgtcgggcggcaggaacggagatcttgggttgaaaacggaggctgcaggtgggctggcgcagcggaccgttcgatcagatttcaacgctccagatttctccaatgtcacaccgtgccatgccatagcgatgttactgaatccgagtcccgtcttttggatgctgaaatgtggtatgtctttatagagagactttgtttatgtctatactatgcttgtaccaaattgcggcactatttgttatctagtatatgcatagttgcttgtcaagccgatgttattagacatatgttgcaaaggccaattctaagtgggtgaattggcaagtgggcatatgttttgattgaatatgatttggcttatgaaccgttgaaatctatgaaaggccaaattgtagtacattttatagtagaccatcatgtcgatattgcttatgatgaagagatttgcttagttgaagttataccttggaagatttattttgatggttcttcttgcaaatagggtcaagttataggtgtagttttattttcacctaatggcatgtgttatgaggcatcggttcgtttgaaatattattatacaaataatcaagctgagtatgatgctttattattcggcttacaagtgatggagatgattggagccaaacacatagaagcatttggtgattcggaattggtggtgcaacaagttgccggggcttacaaatgcttgtacggatcattaaataggtatcttgatcaatgcttggatattattgccaatttatataattttgctattagacatgttgctaggcgtgataattctagagcaaatgatttagtgatgaactctgagctccactcgagacactcaaggctgttgttggcccgatctttcggtgagttgtagataactacgatttgagagaaacgttgacgacctgactacaaccgtacacaacgttgttgtgttgtgccttagcgatcgatacacctctccgtgggttgttgatcttgccggtgcagatcaaccttattcctgcaaggaaatcgaataaacaagcaagaacaagataaaagcaatctgaattgcagataggaattgaatacaaatgataagttgggattccgtaacaggcaaaccagcgatctaaccgatcacgggattacacggcaaagtatcaaagctaaactttaatctaaacaaaacccaagaaatcttgaaggggtacctagctatttatggaggtgggaggatgaccaaggggaccctagggtcgtgctccaactgattggggcgcaccccacatgggccccacttaggccgggtcccaaacgaagttacaagcaatttggcccattataggtgacgtagcaccttatttctgcaatagcagcccactgagaaggaatttggcaatgaggttggatccgttggaaagatgactacgtgagctttccatcaagtactcatggacccaaaacggagctcgtatgcacatttggcggccatttgaattcaatacagtagcaggtggctgaattggattccaataattggaggacttgatcttgttatcatcttgttcatccatgatgtgagcaatggttgtatcaatggtagccatggtcacatcatcctccccttctccttcaaatcatcgagctcacaaaaatcatcaaactgaacatagcccgaattatttaaagaagatgtcaattctcgttcctctatttcattagcaatgtgaacgacatgcttaaaatcggcacacaaagaaacactagaaacaacatgtaagtgaagcattatcacacgactcttctttatcacaaggaacaacaagtaaatcaacttgtgacaaaggcatctcagcaattggttccactaatggctgctctactatagcatgaaaaatagacatgtgtagcttagcttgagaatactcacatttatttatctcagtaccatttaatttaccttgcaaactttcttcagacaccacaggtgcttcatcctctttcttctcaagtacaccattctccctcttttgttgaatgtgatgaattacctgcaaaatgttagtaacaggagagacaaaagattgctcctccaatgtttgcacatcatcattgcatcaggatataggagattcagaaataggagataaatcacattgttcatactttctcgcatttgatatgatctgactctcaatgctacgagcaaacatgaataggtgtccaatatgattatatttcacattagcaagcataacctgaacttcagaactaagccctttgaaaaatctacgcattgtgttttcattgcattcttttagaccactgtagataatgcaaactttgaattcatgaatgtactctcaccttgtgtttcagatgttctaatttctcatgaagaagacatttgtaataagaacttacaaaatgttttcttatcaaggttttgcattcatcccaagtttcaggtttgttactcacataactccaccaaaagagagcaggagaggtaaacttattactagcagccttaatcatttgagcatcagaaaaatcatatttatcaaattcattgtctactgctagctcccaatcaatataagcaacataatcgtatttaccattgtagaatggtaacttagattcaactcatgcaaaattatagtcaggtacctcatatgcatcttgtcgagaagttggcatctctcgtcgatggtgaagaagccgatgttgagcatgaccatctcgtatccccttgcgcaatcctggcatggttaatagcaaacaagaaacatacacaagaatatgcacgctcctatcaactactaggtagtggaagctccgatatcacacacactcaagctttttaccaagttcttaccaaagcaagcggaatggtgacgtacaccaactcggccaagcatcccaatggagtttggatgtatcgataccttggcaaacacttgctatacggctgcaatcaaatatgtggagctctgggtaggcttaaaatgtagcaaaggaatagcaaatgctcaaatcagataatacaaaattgaataatcattcaaagtcagtaccgtactggtcctaggctagaacgtactagagacgcgatcctagacacagacgataccacaagatagctccagaaacaactcaagcacactctgatatactaaagcaaactcaaatataagagctcatttttctcttttccatctttcttctttcttttttttcttttatttttcttttcttttatggtgcggcttttcatttctttttttatgcaccttcctgccttttttttctttctttttttgattttttttaccaaaaacagactcaaggacctcaatgtgatgttacagggactcaaacgtaaatataaaaatttacaaggactcaaatgcaaaagtccgaacccaaaattaaaattatacaaaaatggaatgctgaatttatactggttccatttttttcaaacggatctccaatccgacaatcgaaaacttgtcaccaagctctctagcaactcacggtgtagattgaaatcgagaggagagtggggagtcactcggcttgtagaggtggtgtgaagccgcacgcgagggggtgggaatcggctataaatttggaaatcacgcatggaaggaaacaaagtccagaaaccgatctgctatcctttctttctccttaaccgcacgcaacagcgatatgctatccttcctttctccttaaccgcgcgcaacagatcctcttccttgtgtgaacagaacaagcacaggcgaatgcagacggcaaaccccagatgcaactcagcaactctaagaccgactgataaaaacttctgaaaactagaaaaatagaaccctgcagcatggcggttccattttcgtaggtcccaacgataacaagtacacgacgacgacgacgacagtggtacaaaacgtgaccagaacctgaaactctaaacgaactaaacgctaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctgatgaaccctgagctccactcgagagactcaaggctgttgttggcccgatctttcggtgagttgtagataactacgatttgagagaaacgttgacgacccaactacaaccgtactagacgttgttgtgttgcgccttagcgatcgatacacctatctgtgggttgttgatcttgccagtgcagatcaaccttattcctacaagcaaatcaaagaaacaagcaagaataagataaaagcaatctgaattgcatataggaattgaatacaaatgataagttgggattccgtaacgggcaaactggcgatctaaccgatcacgggattacacggcaaagtagcgaagctaaactttaatctaaacaaaacctaagaaacccagaatgggtacctagctatttatggaggtaggaggacaaccaaggggaccctagggtcatgctccacctggttggggcacaccccacatgggccccacttggcccattataggtgacgcaacaccttgtttctgcaattgcagcccactaagaaggaatttggcaatgagggtagatccgttggaaagacgactccgtgagctttctatcaagtactcatggacccaaaacggagctcgtatgcacatttggcggccatttgaattcagcacagtagcaggtggccgaattggattccaataattggaggacttgatcttgttatcatcttgtttatccatgatgtgagcaatggttttatcaatgatagccatggtcacatcatttagcatggcaagcatatggttataatgtgaagaagggagtattttttatattagaagaaccggtgcttgatttcaaacctttgggtgaaattggcaaaaatgcagaccggggcggcgggggggggttgtttccccatataaaaaaaaaacccctctttttggcgccggttttttgggccaaccgggggtttgggtttcttggacccgcggtgactaggggtggtctgacggaccgtatcccgccggtctgaccggccaacccgggcggtctgaccgccggtatgccgccggtctgaccgattctagacagaaggttggggggcacgtcccgattgattcaaaggccgaactaattgtaatttcggacatttgtgcccaggatacagaagaggattggagaattcctttgattaaatatttgaaagaccctacacttaaggttgatcgaaagatttggcggcaaatgtttaaatatacattgcttgatgaggatttatatcgccgaaatatagatggggtgcagttgaagtgcttagataatgatcaatctaaagtggctatgggagaggtgcatgaaggaatttatggaactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccgagtcgagtaacaagacgttgtcgaagatagtcaaaaagaagattgaggaacacccaaagaagtggcatgaagtgctttctgaagcattgtgggcgcataggatatctaaacatggtgccactaaagtcactccttttgaattggtttatagtcaagaagctgttttgccggttaaggtaaatcttggctctcttcggtatatcaagcaagatgatttatcaagtgaagattacaagaatttgatgggagacaatcttgatgaagtcatcgacaagcgtttgaaggctttggaagagatagagaaagagaagaagaggatggccaaggcatacaacaaaagggtgaaagcaaagttgtttcaagttggagaattggtttggaagacaattttgcctttgggtactcgatccagggagtttggtaagtggtctcctagttgggagggtccttttcgagtatgcgacattgttcgagggaacacatatttttagagacacttcaagcagagcgttttcagcgagcaatcaacagaaaatacttgaagaaatacttcccgagtgtttggcaagacacttaggaggttctatggccagtaattggattatcaccctaagaccaaaacatgttctatggttttagattcacgccattcaccaaaacatgttctatggttttagattcacacccaaattcggcacccagggataaaatatggaaaattgccaaagtttggatgtctgacggttttcctctagttggaccggtctgactgcggtgtataggccggtctgaccgccgaaagtgggccggtcagaccggcggtgtgtggccagtctgacctgtagagtccgagtccgggactgtttcatcgggtctcaaggtttgtgggcccccggctttacacaccagaaaccccatgtgtcttacaataccatttcctagatcagtagatggtacacatatggcacagttgtatatcacaagctgacatcgttatatagtttgaactatacattaatagtacaagggtagcccaaatgggatccaaatagaccgagcatggtcatgtactttgcaaaataccaaaagaagtagatgagatagcggaagcgaagcagcggcggtccaacgtactccacaagcatcgactggtgaacctaggtcccgactccaccggcttcgatatctcttcatcaacattgttcccgtatggtcgactccaactcctttctaaaagatttagttaagcaagggtgagtaccacccgtactcagcaagccaccactacagaatgcatttagtgcacacagaggttcaaggatggcttggtttatttgcataaagcaagatttcataaatcatttcacaaacctatgactgagcagttttaactgaaaacaacgataagttgaagttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttaggtccattttagatttctgatgtcataaaccaatccacatcccttcaccttatctcacatcacacttcagaaccaccatgacaggggtgccgtgctatagctgccttcatagctaagtcttcaccagttattatgtttgtgggctctacaccttccatagcctctagaaatgcttgaaacaaccatacaaaggtttctgcttttcattccttagaaatccacaacccagctaaatatccaaaaaaaaaatacacataaggaagtcatcatagtttggaagtaagttactacaatttgcatagtctgtacagtttgtttttgctggaagtaaatcagtacaattttgaactatagaacagacactaaagatgtaacttgtaaacttagttacttttttttcttttttttagaaaaaaatgtaacttcacatgctactggaagtaacttttatcaggacttgatgtaactcaatgaatccaacaactaacttaaggtgtactataatgtacaaagttattacagattttttagatttactttttttgcaaaacaaggagtacctgaattgattgcccatgtctgtttatcccaatgaatggtgcacaaggcatgttatacatgttcgtcatgtatgtgcagtcaaacgagatgcaatctttgtagtctttgtaggcatttcttgctgctccatcaacccaaaatatgttctgcaccctgtcttccttattaagttgaatcttgtagaagaaatttgggtcatcctttttgatttcctcgaagtgagcaattgtttgaggcatatctctacacctatacttgctccccatctttgacttgaaattgcttatgtcttttctagtgtagggtacattcctagcccctccatacaattctgacatcaattgcataattctaccagttgagagattaactccgtgcaacattgtgatgaaatctttttcctttttcggtattgctctatgtgaccttagaaatttcttaagtgaaaactttctaaccagaggatgtgtgtgttcttcaacaaactgaattacttcccacctagttcctttcctcttcactgtcatccttactttgcaggcagcctgtcttgttttacttcttttccttttctttggagggcacgcttgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggattctttttctttaactgaggttgattgattagtgcaagaatgagcatatgacatactcaacaagccacacagcaaatatgcaagtgcacgaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaagtaccaccacggcactgcaaagggggaaatcgtgacaataccctttgcacaacacaactcaaaacagtgcaccgttcctggatcataatcaccccctcaaaaaccagaggcatggactccccagcgacccccgtgggcttatctccgccacttctcagtctggtgctccgcaatgaatcatgctatacaaaagataaagccgttgcccacgctggcttgtggttggcacggttaaagtttcacaacagtagctcgcgaaccggtccttaattttcatgagcacgactctcaaaaccatgtgctcacaacccaccattatcaagttttagttggcaagtaattaattaaccaatcacgattaaccatcgtgaactatcattaagccatcattaaataataatgcgtcataagttatcccaatagtgtgctaatgtttctaagcatggctaagcaatcacatctaatatctagctgaaccaatatgtaaagctcaactagtcaagttataaaaacccaaggtatcaaggaataaagtaatcaatgcaaacagcccataacaaaggaatagattcactccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagtcttgaacggcctcattctgacttcaaatgaatttattatgaattttacaagattaaatctatttaaagcccatttaaaaagaattaaataaatttaattcaatttatggacaattttaaaatgtagatctttattttatataacttttgcaacttgaaccacattaaactgagttacaatgaattagttatgtatttttaaagattaaaccggattaaagcatttatatggattttaattgaattatgacgcaataatgaattatttttgaaaagaaaaagaggattattgcgtcagcggctagggtttgcggtggaccgggtgcacggcggcggttcacgagaacggacggccgagatcgatccatccaaaacggacggccgagatcgatcggtccacgaccgggccaccgggaacggcaacgatgacgtcagcaccggcggcggctcggcaacgcatgctcgccggcgaacgacggcgcggcgacgcga

SEQ ID NO: 35168 - DNA, 3278 bp, Oryza sativa
acggcgacgacttggcgaccacgatggcgacctccccgagcgacgacgacgaccggaacggcggcggcgcacggctggagcgacggcgacgacggcggcacaagatctcacggcgctagggcgcttccgacggcgagagacgaaggcgagggtggcgacgggtagaggagacacaggggatccttttataggggcaaggaggcggcggcgaaggcccacggctgccggcgacgagaaggaaaggtcggggtttggaggaaagagaccgatccgaatcgacctcgaatccacgaatttccaaacgattttagccggtgattccaaaagagaaaaggtggaggagatcgagaagatcatttcccctctatcaatttcaccggagaaggaaaggatcgagcggattggaaagcggcagcagcgcgactcggctagggttccgggcagcggcggcggcgcgaggaagacgaacctgacaggtgggacccacctgtcagcgacagagagagagaggagagcggcagctcggcggactgggccgacttgggccgaaggagagagagaagagaggttttgggcgacctttcggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacaaaaatcaggatgtgataacgcttcacccgttttttcttctggaccacatttgttgcaaacaaacattactttgtcacgttctccatctttggctgacttccttgaagtgttgattttgattgaaaatccaacgcactttgcatacctgttatagtgagcccttgcttcctcctctgagttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaactcttataactggactcgatgtaattaaataacctatacaaacatttctgtcttttttagatgctttctaggaagcaattttgtcaaattgagaccagtggctatactaattgaaagtgcatctaggcccctaatgattttgatgattgattacaatgcgattagagaggactaacatttttattcaagcaaatgtgaaggttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgcatagacatataaggagtgatgcgtgtgctcaaaatcaatttttcttcgaagcatttctcttttggagtgttctggaaatttttggaaggtccgaaaatagttttcggaagttccgaaaatagttttcggaagttccgaaaatacacagaattgtgtttgagtgttctagaaattttcagaagtttcgaaaatagttttcggaagttccgaaaatacacagaaccgtgtttgagcgttctggaaattttcggaagttccaaaaatcattttcggaagttccgaaaatacacagaaccgtttgagagctttctggaaattttcagaagttccgaaaatgatttttggaagtttcgaaaatacacagaagcgttctggaaattttcggaagtactttcggaagtattttcggaagttccgaaaatgggcgttgacttcgatttttctcagatctggaattttccgaagttccgaaaattgtttcggaagttccgaaaatcccttttattgcactccaacgggcagatcttgtgagggctgctggttccattccaattatttgtgccctgggcttgctctctctctctctctctcattcatttgagccttgcttcctcgattcatctctccacccgtgtttgatttggatttggtgtgtgtgtgagagtgtggattcgagcttgtgtgggtgcttcttgtggtctttgtgaagatttgtgagcacttgcatcatctccgggagttctttgcatcatctttactcttggaggttgaggactcctagacggctaggtgtcactcccgagccatcgatctacttgtggttggccgggagaagtttgtgaaggccg

SEQ ID NO: 35169 - DNA, 3913 bp, Oryza sativa
  unsure (1)..(3913): unsure at all n locations
tttcattttttgtgtgcgctgctctgtgcattttcggaagttccgaaaatcatttcggaatttccaaaaattcctagcctagctccgaaaattactgcttccgcatttcttaagttttaaattagcctattcacccccctctaggcctaattgaccctttcaattggtatcagagcctaatctcctaattaggcttaactgcttggagagatcttgtcaggccaagcgggggatgggaacgatggtgataagggagctaagatcccttatgactatccctctacatctacatcttttgtgagtacctatagcggcaaagctccgtacttcaatggtacggactatgccgcttggaaacataagatgaagatgcatttgaagtctattaacccatctatttggagaatagtcgaaaaaggctatgttttgcagaatcccgaagatcccaccaaggaggacgacgagaacgagcacaagaacgttcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggtaatttgagagatttgtgatgttggatggtgagagcccaagcgacatgtacgaccggttgagcaagatcgtcaatgagatcaagggacttggctccaaggacatgaccgatgaggttgtggtcaagaagatggttcgagcaatcactccaaggaactctaacttggtgaccatcattcgtgagcgtccggactacaagactctcacacctcacgatttgctcggacgcatctttgcccatgacatgctcgtacaagagtccaaggatgtcatccaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaaattcggcaagttcatgaggcgaagcggcttcttcaagggaggattttccaagcactactccaacaagtcaagtggaagacactctgcaagagtgtgctacgtgtgcaaagagcccgggcacttcatcgcggattgcccccacctcaaggatggttcccacatcaaggaagataagaagaagagtgagaagaaggatgagaagaaggagaagcacaagcatagcaagagggaacattatggccaatctcaccttgggatgatctttggctccgactccgagtcaagctcaagtgatgaagaaggagtcgccacgttcgccgtcaagccttcatcaccaccgagactctttgactactcaagtgatgaggatgctccggtttgcctcatggcaaaggagcctaaggtaccttctcctcttaagtcatttaatgttgatcttgttagtgatgaggaggatgaggttgaggatgagattatggatgacgaattgttcaagtccataactaaggaatccctaccacacttgagtgagttgcttgggagaattgaggaccaatatgcaattcttgagaggcaagagactttgctcattcgtgagaaagagcggtctcatgaactcaagagtgagcttgttaaggagagagagaaaaatgaggcattggtacggctttacaagcaaaccaaagagtctcatgctaatcttgatgtggcgaacgctcaacttcaagagagagtggatggcttggacaaagcatacctcactcttgaagaaaagttcgaaaccttaaagaatagtgtctctctccctagcgagccatcttgttccaaaattgtcccaagcaatgaaccatgtgtgagatgcaaagatattgatattaacgcttgtgctactaactctattgccttgagtggtttgcaaaagcaaaatgagaagcttacgggactccttcacaatggcctacttaagtgctatatgggtagtaaggccctaaatgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaaagattgagcaagagtgagtacaaccacagtactcagcaagccacaccggagatgcataattaatgcaagggggtacaaggggataataatataggggttaagttttgcagtaaacagcatttaaaagtcacttacttgcccaaagctattttataaacacgatcctagagctacacagtattattaatcaaggccatgaacccacacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggaccgaagacgtgacatagtttccaacccatcctagccatagacaagagtaccgacccaatcccacctgcggccggaacctccgggacagacaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagctacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtacccactagttggggttttgtttattctagggtgaacaaggtaataataacaatagcaataataatgtcataacaaaggtaaataggcatggctaaacaaaacagtgataacgcgggaatttaaataaagcggtaatgcattaatttaaatcaaaataattttataaactgagattcaatatgctcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35170 - DNA, 1258 bp, Oryza sativa
  unsure (1)..(1258): unsure at all n locations
ttgcgctccttcttgtcgccgtcgccgccagacttgcgctcaccgggggtgccaccctgcttgcccatgcctccgggagtgccctgccccatgctcctcgctggatctggccggcgggaggccagatctggtggccctgaggccggcctgccgccgcctacgggatgtaggtgagtggcttcccgcccgtggtgcgggacgaggcgacgagcaccccgtacccataggccgccgacctccgggggacgctgaggtaggggaatagggaggagagaccgccgcggcggatgagccgttggaggaggagtcgcggcggcagtggtagtcgccgtcggaaaagaagggaaaaaaagaggaaagaaaaaaatgacgcgcatggcgtcggcagcgcggcgttggcctcggcgncgncgnaanacgcgcgcggcggcggagnagnaggcanatgcgcgggaggcagacgcgcgtggcggctgagtcgacctcggcggcccggcggcggcggggaggcaaacgcgaccggtggcggagtcgaacgcgcgggagtcgacctcggctgtgtcggagtcggcctcggcggcgagccggcgacggattcggcctcaacggcgacggcagagtcctcggcggcggcggcggcgaaggggagtagacacgggcggcggcggagtctgccgcggcgtcgtcggagacttcggcggcggcggcggaggcctcgggcggcggcggggaggcagatcgcacggcggcggaggagtcctcggcggcggcggtggaggggaggtagacgcgggcggcggagtcggccgcggcgtcgtcggagacatcggcggcggcggcggaggcctcgggcggcggcggggaggcagatcgcacggcggcggaggagtcctcggcggcggcggtggaggggaggtagacgcgggcggcggcggagtctgcggcggcggcggtatcggcctcgggcatcggcggagtcggcctcgatggtgaggaggagcgacgacggagtcggctgtggcgtcgtcggagtcctcggcggtggcggcgtcggcctctggcgaggaggagcggcagcgacagctgaatgaggaggagggagaaggatgggagagaaaagaagcgaaccggtttttttaatggtataggtgggtaaatttttttccccaaaagcacgtgaaagcaggggttgaggtgcttttgagttgtactacaccaaaagctggcttttggcaaaagtagctgtggcttttgagcc

SEQ ID NO: 35171 - DNA, 838 bp, Oryza sativa
cgatctattcgccagttcttccgaatctcggggtcgaggttccgtttaaggggggtaggtttgtcacgtcccaaaacgactctaaaatatatcccttaaatgttgcctagaataattaaaatccgtgtgaaagcctccaagaattaaaatgtgcaaagttaaaagccaaataaggcttagaggatttttgtaaatttcctaaaagcctaaaatgcgtaaataaattttagtggaattttcagagcacaaataataattattaaaaaataaacaaagttaaaaaggttttataaaaagaaaaaccctaaaagtcccccttccctcccttgggctggctcggcccatctccctatccaccccccctctctgtctcctcttccccgcggcctattcagcctccctccccgcgcgcgcgccgctgacgggcgggcccgcccgccaccctcgctgacgggtggggcccacccgtcatccccgtcctcccgccactcccgccgctcccgccgctccgcccgcgccaagcgccgccgctgccgccaaatccgccgcatcgcgccgtccctgcgtgcaataaagtggggggaaatactccctgtgatcccctctccctttcgccccatttttccctctctctctcgtgttcaaacgggcagatttgcccccgcaaatctcgccggcgccattgatggcggccggacctcccgcgccggttttcttccccttcgaccgctctctcccccttccaaccctatttaaaccctcaccgtgcatccttcgcccgtttccgccctttgcgcacccactccccgccggaatagagctcgtgcagtcgccctct

SEQ ID NO: 35172 - DNA, 11511 bp, Oryza sativa
  unsure (1)..(11511): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagtctgtgagtccggaaaagcaatttctgcaaatcgaagcagaactgtgtaatttccattttcaagtccaaggccgtaatacctcagagatgatggcgacacccttccagtttcaaacaactttgaatcaactacattgttaaaattttgggaactatatataatgttctttgcatctgtggcccggaagtagtgtcctacactgctgacaccccatcttgtttgaccagtaacataatatgttgcagctccaagatttgcaggatctgcttcataaatggtattatctgatcctctcgttgatgtattactaccacagtcaaccgcaaaagaataatctacgatcacaaaattgtaacaatcattaaaattccttagctcatattattgtctttggttcaatgaagattgagaaatgtacattttggagatccacggaaacaaggagtgtcttgttggaggcagtttagcccccaaggtagtctactgtgcaaatttggattgaaaatttaagttgtcagcaagcattcttatagtgcaatagcaaaattataagaattagaactaaattcgtatagtgcactagcaaaattagaactaaatgtcacaattagtatgtacctgttactggtgctaccgagtaaaaagttgtttgccaccaaattcctttcacaaaacagaatattagaatatctatttttttctcagcaacacagatatcataatattacacttacaactgtaaattgttttggctagcccaagaaggaatgctcccagtgagttgattgtacgaaaaatctctgtaaacattacagaattagattatacaggagttaatatattccattatgaaagtaaattgtgctataatgccatgtcgattgtatttgacatacatcgcttttaaggaagagcttataccatcaggcaaccttcctgcaaggttattgttcccaagaaacctgaattgggcacaattcaagatgatcgaacatgttcatctgcttaataggagcttctatcaacaaattaatgtaaaaagaatttcttacaagaactgtagatttcccaaattcaggatggattgagaaactttccctgtgatattgttaaaacttaggtccctgtaccacatgacaaccatattacttgaacatatggtacagaacttgagttaatgattaataatatcatcaattggcaccatggcctgtaattgaaaacttacagcaagcttaacttttcaaacatagaaaaatctactgctccgagatcaccatatatcttgcagttcctcaatattctgtaacaatgaaatccaaccgtggtaacttgcaactagacaatatactgtaagctttatagctgaaatcatcacatacagggtgttcagagaagtcagattactgataagagccaatggagagatcccatttacaatatctccaatccgcctgctcatttatatttttcataaattagttatcagccttgacattatcaaccttcaagagtatacaatgtcacctaaagagtatacttacaaggttgttaatttggtcagattagacaaactttctgggattggtccttcaaatgaatttccttggaaagcactacaatctcataattttagaaaaagggcattgcacattttaaaataagaaaaagatataaaagttctatatgtgaccagtcttaataaaatcactacgtatgtatatgccacctggacaagttactgtgatgcagctttattcatttctatctagcgaggactgaaatgtgaaaatgcaattgtttatagaaatttagttcggtctaacaaaaagtacatcgaggtaccggtacctcatggtaataagtcgtttatgatcgttagatttagctaggtaggatgagcattgttagatcaaaaaatcaaaaacgatttggtactgtgaggtaccggtatctcgagatactttttgttggagcggagcaaatctattgtttataagtctgaatggaaagaacatgatatacagaataatttatcttgcacaaattcatctctctcaaaaataggatagaacatatgagatatgttaataagttaatattaataatcttacatttcttccaaattagtcatgctacctaaataatcaggtattttccctgtgaatccattgtctgatgctagactgcaagcacaccaaaatgtcatttatcatgaaagcatgacgaatataacagctgaggctatgcttttgactatacaggatctgcaggttctgaagttttgagaacgttgaagggaacggaccactgaatccagaactatcaatgtacctgttattgaaagtttgttattgtcatgttcaacaatagatctggccattccaaattttaattcttatagaaatagaaatatgaagttagaaatcaatggagtatcttacaattgcttaagtttggtcaagttgcctagttcttcaggaaggccacctgtgaaattgtttaagctaatgcccctaaatgaaaataaaatatttcaagataagaaattattatcatcaactaatagcaggaaggggcatagtttttcccgatgtgccatttgacccgcaatattcatcatgacaatatgttcatgtttttgctgttcgatcaactttagttgatcatttgaaagttgaaacaacacatgaacagggaagttacattgacgtgcctattacataatatttagtactgagtagtagttatgatttttttattactttattgctcgaacttatgcgattgccatttgttgtactattatattagttcatggagtccaaatatcacttactacaaaaaaatgcacatcaggtcaacactataggtgccataccagctaaaaccggtagctatagtgtttttcccacctccttaggactaaaaacataaaaaactaacacctttaagggactataggtacttgttcttgagaaaaaccgacacgtataatataggtgtcagttaattaaaaaacgacacgtaaaatatattataggtgacgatcaacactataggtgccagactagctaaaaccggtaactatagtgtttttcccacctccccaggctgaaaacataaaaaactaacacctttaagggactatagttgcttgtttttgagaaaaaccgacacgtataatatagatgtcagttaattaaaaaccgacacctaaaatatattataggtgatggtttttcagtaaaacgagccgagaagaaccggtgtgcttgaacccaccacaccaccacccaccagtccactctcttcttcctcttctcttcttcctcctctcttcttcttccttctatcttcctctccacttcttccttctcctctcctccatccatcacggcggcagcacgggagcgggggggggggggggcatggcagtgggacggaggcggcctgtgctggatctggtggtgtggtggtgctggcccctcggctgtggggatctagcaggctggaggtgcggcgcggcaacgacagccggtgtggaggaggtgcgatggcgtcggcagccagtagatccgtctcttcccctccctccctctttgtgatttgttgatatagatgtgatctattgctaatgtagatgtgatctagatgtgtattatttgatctagttgtgttgtttttctagggattattgactatagttcatggatttgaggcaatttttagatatgggttttagttgggatcggcttgacggctcaatgtatcgagctgatattttttgctcgtgtgcgcctaaaaggagctggttttcgaaccggcacctttgaccccgggtaatcagtgctgtcttcctggtaccggttggaaaactgacacctatgatgttttatgtagtagtttatatactccattttctttcgtattacctactattcaagttttgttgcaagtcaaatatatgtactcttggctatcaagttttacaaatgagtatagtttaacatagttagatttatatatatatttttagattcatcatgagaaatattgtgacaatatataattcatactcaattggttaaaaaaacaacttcttgatattttacataggacaacggaaaaatgatgagtaatttggaacagaaggagcagctgaagattaatccgcatatgagaaaatatttcttacaatgaaataagattggtgaggtttccaagttcctttggaagtggtccagatagtggattgaaacccaatgccctttaaataattaagaatagttaagaaacaataacgatcaatggatgaaacatgatatagaacatgtaactcctacaagtatttcatcgaagtgaattttccgatgaatgatggaatgaaaccagtcaagtaattatagttcaagtccctgaaaacaacataaaaaagtagaacaattagccaacataaaaaggatgttgcatggctgactgaaatgtaccctgctgttcacaaagagaatttgtgtgattgaatttttagtctgtgaaaaacttgatctataacgtaactttagtagcaggactagttaagaagaaaaagacttagataccatacaagttctctagacgggtgagattctgtagctctgaaggtatttgaccaaccacgtccaacttatttaccctccttcataacaacagacaagtaatacctataaaaaaatgtgcttgagctattaggtgttgcccaaagagagtgtgcgtacagttttgtaatgcggcatagtgtgttgttgctgaaagtgcaatcgcatttgatgaatgggttgatgttgggatagtaatcccagtcgtttttgtcagcggcgaaaccgctgcagagatcaccgctaacattccactccgatgatgcctccttgccccatctcctcatgatcgtgttcagggccaccgctgcattcatggatgatgtttactaattaactcaccactaataatcatatggatgatagctaggtcattaatgaaatcaaattcctctaactctttctcaatagaaaccggcacctatacatgtatcattccctaatagcatccccagcttatccaaatttcatcctccatattcccatttggatggccattcaaaaatgtttcctactccattttccttttgattccaatagatcattcatattacattctccatgtaccaaaaacctatattttactaatatctttcaactacctttcaacactcccaaaaatcaaaaatagacaatgtatgagaagaactgttgagaaatttgataattcaacctctaaaaaaacttcctcacctttctctctcttctatatccaatgctgagagcctgagaggatgggaaggacatacgaggagggctgaccaccgacgggtagttcaatgggtgggagtaacagggcgcgcgatggggagagaagtggcttggcggcatgggcggaggagcggcgcgagcaggcgtgcggagggtcggcacgggtggcggggggagaagtcacaagcgcaggagcagtgaggacggcaggggagatgccacgggcgtctgcctacttagaggagtctatagaaggaggggggagggcagagtcggatatgtgggcgcgtggcgctttggccgacggtgggtgcagggcaggcgcatgtgaccgatgtcgggagtggccggctcatatgatcatggggcgacgctcaggaccggccgactaaggtggccactagcgcatcctctctctcttctctacattcattccttcacccctccatagctcgatctgatgagggtgggagcagcagttgtggaattgcgtgaggagagagaaagaccatatccggcgtttctctcttcgggatagcgcatgagctatctttggatgcccaaacggcgtatccgctacagaggtggattttctcccaccatacgctatttcatgtaaggaggacgggagagagtatctactggggatgctctaacaggtgctctaacaggtgttctgtagtagtgcgagggacatcatatatcgagcacaaccacaaattactactcctgcaatctaactatacgcatggaggaaaaccaagagacatttaactattcgtcacttttaggttattgatatatgagtgctcacatgtcatcgactatagatgataatttattaaatttcacatcttaaatatgtaaatgtcaaaaaacgaaagaagatagacatacgtggtgcgtcaatacacaccgtacatgattgctggcttgcttaccttcgactggatcagtttttggtgcttgttgatcctgagctgctgcaacccgccatgaccatacaaacaccagacaccacacggaatggcgaatgacacctctggaagaacgcatctctctctctctctctctctctctgctgaaacaacactgcgtggctttgttttttcttttttaacactgcgtggcttgttaaagacgtacacgacctcctatatattcgtataatatgtagagtatatgcacgtgcaaaataccggtcaactaattgcacgcgctggttaaccagacccgtcactattgataacgatatatagagcatgtgttttaccctccacaatcaatttaagggactatctaaaaactgccgcaagtattttatggaaaaagctttcaaatctacaattatacttccattatacctatactataactatataatatatattaaaataaaatatacaactttatatctaacttatattgatattacaatgcctttagagtgcacttatacattgtagttacactataaagatactatagttatacattatagttttttgcccaaaaaatttgtgacagtttttttagcaattcggtcagaaggccttgcaaatttaaatccatgctttgataaatccgacttatcaaagacaaaaataattggaaaacagctctaaaactatagtgacagctatcaataatctttaatttcaggattagcattgttttgttcagttttacatccttcattttttgtccaacgcgtcgtgtatagttaggtcttagtcatgcatatggtttcaagttttacaccgttcgtcgacccaccattgttttgactgcctgcagccgaaggaaaaccttgccgtggaaaggaaaaagtctacaagcaagcaatcaagcacaaaggtgatgggaacgaagtcattggagctcttatcaccacacatgagaaactgtgaaaccacgtgtggttttgattcattgtgatggaaaattggcaagtgctggaagtacaggaaatgtgtacgtggactaacgtgggtcaggttgcgttatctatacacaaacaacggtcgtttacatgtctataggtaatgcaagtcaaccttggccaatggcataactaggtctatgctcaaggaggagtattagtcttgtgtggttgggatactatgtgacagggttgtacggacgtcacgatcattggcggtcaaccttggtcaattaatggcatatcgagactaaactcagggaggagtcgaagtccaaaacggccaaggatgtcgggtaacaaagttgagtacaagacggtgcatgctggataaataatgtggtggaaggacttcacaacagactacacaatgtcaagtgtgccaagaaaattgatgaagaacaagaaaagggaaaacacagagaaagagggaggcgggccaagcactggagcccaagacaacctcctctcccaccaccggattggcctagcacggcccaacaccgtatgcacgcaggctcaagcggaagagcacgggacgcatggcaccaactagttgggatcttcctctagttggcaggtgagcccacccaggacggcacgtgaagagaacgtggcgcgggcatggggtccactcggagtggacgtggcctccaatcgtgaggcgtggggccgtaccggccacccggcggcttttgtctcgggagagcgcaggcgatgtggctccttccgactggcgcacgcggcatctcccactggctggagggcccacgcgcatgcaggagaaaggcggagccgtggcaatcggtaattggggcgcgcgatgtcgagattgatcccaaggcatgcgtgggtagtagcggcgcggatcatccgtggaaaaggtggacttgttgtggcggacatgttgtggctagctacatgtcagtgatatgaggcttttcctttgaagtggaggaacaacggatggcccagattttatctgagctagtgttttgccctaagagcatttgtgacattgtcttagttaggggatttcagccacattggacaataataaggggtggatgcttggtgagaggtctccctttgagtcgcctatacaccttggtgtgagagagccttcatagctttcgtgtgtgattttaaattcaaatccaatgtgaagatgtattttttagtgtgttagtctcacggcagcgactactcatacgtctactgtagacaatccgacaatagaggagaacctggtgaagcatcgagttcgacctaagcgtatcaagtgggccaatgtcagaatcgctaggccggaatggatcatgggctgatgtattcgcgcggctatataagcgcagtaggtggaagggaaaagaggtcgaatgaattgtattctgaactatctcctaaactgaatacttcttccccttccccaagtctgaatatctctctctctctctctctgtgtgtgtgttcttcgcctgttcgactctgttctatcttcttcctctgaaactttccagaaatcaacagagttcgtaacaataggtatcagagcaatcgatcctggattacttggagaaaccacgctatcattctcgtgcgtagctcaagcttcggtggggttgttggaggaaatcaagcccatggtggtggagctagcggggtggaagccaaccatagacaaggcggtggtggagttgcgagaggatattggggacttgcgtcatcaagtgaatcagctctcaaaacagcaagccagtgctatcaagccagcggagcggccgccgctgcttcccacatcgccaggatctcgtccgctgccgaaggaggaggagacttgtccaagtcatggtgacatgggtcacggcccgttaggccaccgcgcgggaatttcactccggggaaaggcgattgggaagaatacctctccattgtctctcccgggcaagggtacatttactcctcaatttgcttctcgaaatgagggacgtgattttggggattcagtggggcggaattttgggggatttccttatggtggtgtgaatccgtgagtggactgtcctcaatttgatagagagaatcctagagcatggaaattgaaatgtgagacttacttccaagtgagtggtattagatcagatgtgtgggtgggagtagccgccttgcagttcataggtggagatttgacttggttgcaatctactaatgctcacgtagatttgataagttggggtgaattctgtgagccagtttgtgctaagttcgggcgtgaggggtttcaaactctaattcgacagtttaataggctacgccaaactgggtatgtgcttagctatgctgaaaaatttagtgagttagtacacagcttccatgcacatcactgttgacggtcgttatcaattagttttgaccgtcaatattaccaaaatagaggagaactagtgatgcttgcaatgcatatatctgttagaataataatattccactagtattaggtatactaacctattgcagagaatgacaataaagtggaggagaatcgacatcaactcaaacgataaatcaatcaaacgatgtcgatgtcgcgcccagaaattcccgaatagaattctaagcagaatgtgcattaaattctccgtccaggaccggccggggtacacaaacgacaatattgacattcagatccacgtcttacaaacaccataaaagacttacataaatgcagcagaaaaacaaaagacaacaggagcaaagccttgactagatctgcagcgggaacaccactccataggcatcctcgacggcacggacgaagcctactcctcggagaaaccttcatctgacacgtactcgtgctctggggttgggaaaaatagagcaagactgagtactacccattgtacttagcaagtcataccggaataggggtatgatgcagggaattatcaaaggagagctagagtggttcatttgcataaaatgagcatttataaacagaagttgaaagatttaaacggttgtaataattaattaatattaactatccactgtccaacgctatcccacgttgcgacagggcccaaccatccacctaaactatccaaattcaaaagattacactagggtgagactaatcacggtgaatctggttgaccgcccataaccgcgggcacggcaattcgaatagttttactctgatcaaaggtgtacaactgtacccacaagacacagccccacgacacgttcccgtgcgccgacatgccaccacgacataccagaaagaggccgtgacaggacccttcgcataacccccctctaaccaagcacaccacacctcaggtttcacccccactcctcgcaaggcagcgggcagtcccctctcgtgcctaggtgaatccggaagccgcataggccgtcgcagggcccatccgaactccaccacgcccacccttgcctagatgcgtcggctagaggaaagctacactacaagcccagccgttgcccacgctggcttgtgataagtacgataagttcttccagggcatcccgcgaaccggtccttaactgccatggatgcgaccagcaaaaccatgcacccacaccaacacaaagcggtggcactaatccaacaataccattagaaccaacagtctaaacattaataaggttttccccattgtgcactagttgaactaagcatggctaagcaatccctagtccaatctctagtcatgttataaccccaagctgacaaagagacatggtagaacaatagcatggctatgacaataggtaaacatcccatagtaacattataaaacgatgcatatttgagggaaaacaatagagcatttgcaatataggatcaacatgttcaagtgacaagcatgactgtcttgctctgctgcaggaggaacctcggcgactatttcgaagtacatcggagcgtcggacga

SEQ ID NO: 35173 - DNA, 52835 bp, Oryza sativa
ggaaaaagaaaagaaaaagagaaagatttcttggaattaaaatatgctgctcaattttaactggttaaaattatttctagggctctgaaaaattccactaaaaatcctgttagcgaatttcgacatgtagaactcaagaaaaattccacatgccaattccgattattattcgcattgatttaaaagggtttactcttgctttgcactggtattttcttagggtcgcttataaattaaatttttggcttaggaggagaacttcggggtgtgacaaacctaccccccttatacggaatctcggccccgagattcggaggagctggcgaagaggtgcggatgggcggctttcaactcatcttccctttcccaggttgcttcctcttctgaatggtgactccactgaactcggcaaaacctggtgaccttgtttctggttcttctttcgctggtatcaagtatacgaaccggcttctccacatatgttagatcctcctggatatcaatgtgttccgaatcagcctgttcttcaagtacccttaagcacttctttaattgggacacgtggaacacgtcatggatgccgatcatattggatggaagttctaactgataagcaacttctccccttcgttccaagattttgtagggtcccacgaagcatggtgccaacttgcctttcgtctgaaaacggtgtactccccggagcggagtgacacgaagatacacgtaatctcctgcctcaaaagtgagctcccttcggcggttatccgcgtagctcttctgtcgagactgggcaatcctcaacctttccctgatgattctgactttctcttccgcttccgttaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcgagagcgcaagctctcaacatatcttccaggatttgattgactcgctcggtctgaccatcagtttgcgggtgataggccgtgctaaaatttaaatgggtccccaattcttcctgcagcttctgccagaattttgaggtgaactgactccctcgatcagatacaatctttttgggtactccatgtagacacatgattctcgaaaggtaaagctccaccaaccttttgcccgtatacgtggtatgtactggtatgaagtgagcaaccttagtaagtcgatccacgactacccagatggaatcatgacccgacgatgtccggggcagtcctgttataaagtccattccaatctcctcccatttccattccgggatttgaagaggttggagtagacctgctggtctttggtgccctgccttcactcgttggcaaacatcgtagagtgcgacgaattcagctatttctctcctcatgctgaccaaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcctcaaggaaattccgagcctttccgactctcatgttcttttttagctctgctatttcggcatcattcacttgagcggctctaacttgatccacgagcgtaggccgtgcctccaaagcggctacgaacctgtgttcaacaattcctacgttgagatgctcaaactcctgccgcaattcctcacacatgccctcgatgcatagggcagtgcagtaacttttcctgcttaatgcatctgccaccacgttggcttcacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccactctgccctcctgcattaggacacatccaagtccgtggcgggatgcatcgcaatagacttggaagtctttcatctggtcgggcagaatcaaaactggtgcggatactaacttctttttgagctcctcaaaactcttaccgcactcagctgtccatttaaacttctcatctttcttaagcaattgagtcatgggtcgggcgatcctggagaagttttcgatgaatcggcggtaataacctgcaagtccaagaaaacttcgaatctacgacacggtcttcggtggggtccatttggtaactgactctacgttcgatgggtcaactgccacaccctgagctgtaatgacatggcccaaaaatttgacttccgtcaaccagaagtcacacttgctgaacttggcatatagctggtgctccttcaacttctcgagtaccagacggagatgttgctcatgttcttcttcggactttgaatagataagtatgtcgtcgatgaataccacaacaaacttgtccagaaattccatgaacactttgttcatcagattcatgaagaatgcaggtgcgttggtaagtccgaaagacataaccgtgcactcatatagcccgtaccgggtggtgaaggccgtctttggaatatcctcttcccgaatcctcaactggtggtagcctgatcgcaggtctatcttagaaaacactttagctcctttcagttgatcaaacaaatcatcgattcgcggcaagggatatttgttcttgattgtgacctcgttaagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtacggtcttttgtaaattggagcggttcccggtgccaagtcaattcggaattcaatctctctcttgggtggcatggtagtaaggtcttcggggaacacttctggatactcgcagactatgggtatgtcttccaatttcctcaaattcttctccacggtgtccactgggatttccgcctcaatctgattcaaggagaccccttgctttggtgagactagtgatttgtacaccacggcttctcccttctcgttggtcaaggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactaaggttgaactatttcccggggtatgaaccctcattggtgtgctaagctcttctttccttaacccatgcatccccacaaatttctttgaaatgaaagaatgggttgcaccagaatcaaaaagtactgttgcagggattgagttaacaggaaacgtacccagtacgacctctggtgctgcttgtgcctcctccgcagatgcgtggttgacacgagcctggacaaaccttggcccggcacgcctaggcttcgggcatttgtcagcgaagtggccaagctcgccacagttgaagcaggaccctggttttgctccagtctccttcttggcttgcacggacgggcctgactgtgccggtgccattggtgggcgtggaagatgtagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagctcgccactgagtggtggaacagtcgtgtactctggcgcgttggggtagcccaccaccagcgtcatacgtgccaactctgccacaaagtcaatcatgccttctccgcggtggttgggtaggtggccggccatctagagaagacaaaggagtaggatcaatgcatgctcaaatccaaatttaaataaagcaataaaagactcagataagagaatcgaaataagagcgaaattttatgcatagatcattttgcatgagagcgaataaataagacagactcacataccggtaaaatattggggaaattagatacatactaataataacaataagagcataaataccttgcaacccatgttcctaagctagggcctaatgcatttcacccatcaaaccctagactgacttgttttgacaaatctcacttaaacgagcgaccaagatttttccccttgaaccacaagaacagatcccaattttcccggaacaaatccaattgcaaagaacatatgcaatgaaaaggattcagagagctcttaggtttttccatttggcttgtcctacggtcaaggtcggctctgataccaacttatcgcgcccagaaattcccgaatagaattccaagcagaatgtgcattaaattccccgtccaggaccggccggggtacacaaacaagaatgttgacattcagatcctcgtcttacaaacaccataaaagacttacataaatgcagcggaaaaacgaaagacaacaggagctaagccttgactagatctgcagtgggaacaccactccacaggcatcctcgacggcacggacgaagcctactcctcggagaaaccttcatctgacacgtactcgtgctctggggttgggaaaaatagagcaagactgagtactacccactatactcagcaagtcataccggaataggggtatgatgcagggaattatcaaaggagagctagagtggttcatttgcataaaacgagcatttataaacagaagttgaaagatttaaacggttgtaataattaattaatattaactatccactgtccaacgctatcccacgttgcgacaggcccaaccatccacctaaactatccaaattcaaaagattacactagggtgagactaatcacggtgaatctggttgaccgcccataaccgcgggcacggctattcgaatagttttactctgatcagaggtgtagaactgtacccacaagacacagccccacgacacgttcccgtgcgccgacatgccaccacgacataccggaaagaggccgtgacaggacccttcgcataacccccctctaaccaagcacaccacacctcaggtttcatccccactcctcgcagttccctctcgtgcctaggtgaatccggaagccgcataggccgtcgcagggcccatctgaactccatcacgcccatccttgcctggatgcgtcggctagaggaaagctacactacaagcccagccattgcccacgctggcttgtgattagtatgataagttcttccagggcatcccgcgaaccggtccttaactgccatgggtgcgaccagcaaaaccatgcacccacagcccaccatgtgatttattttaatgaacaaacacaaagcggtggcactaatccaacaataccattagaaccaacagtctaaacattaataaggttttccccattgtgcactagttgaactaagcatgattaagcaatccctagtccaatctctagtcatgttataaccccaagctgacaaagagacatggtacaacaatagcatggctatgacaataggtaaacatcccatagtaacattataaaacgatgcaatatttgaaggaaaacaatagagcatttgcaatataggatcaacatgttcaagtgacaagcatgacttgtcttgctctgctgcaggaggaacctcggcgactatttcgaagtacatcggagcgtcggacgaaccggaatctagcgacatacaaggcaaacattgcaaacaggctataagactactgaaacagagaacaaaaccatttttaatggattctacacatttttcttaatttactgagacttgaatgggcttaaacggagctcggatgaattagttatgaattttagaagattcactgtgtttattactataaaagaaaaaccttaaatcatttattgcgcaataaatcccagggctgacgtcagcacggagggggggaaagacggcgccgacatgcggggcccaccggtcagcggctcgggagagggaggaaggggcgccggcacgcggggcccaccggtcagcgactcaagggggagggcggttcaccgtggaccgggaccacgcgggtggtccactgccggtccacggaaccgacggtccagatcgccctcagggtcgatcggacgggcggcggcgacccggctcggctcaaggccgaccgaccagccgcggcgacggcgacggcacgcgcacacgcgaacgcgttaccggcaacggcagccggcggtggagacggcggcgcaaaggcggcgccgacgggcggtggtgctaaagcgacggctaacgggcggcggcgctaaagcggcggctaggagggagagggaggggaatagaagggagagggcgcctcaccgagggtggccggcgcggaggaagacgacggcgaacggcgatggcgagccacgggaggacgacggccactggcggacgggattcggggtgccctaaagaaggagaagagagagattagagggagggagatgaaccacggcgacctgtattcatggccgaaagcgcggtagcggttgaactcaccggagcgcgaggggatgcgaattccggccactaaactcgaccgggaagcggcggccggggtggagcttagcctcgcgaacccgacggcggcgacggcgcggtgcggcggcgaccctagcggcagctagcggcggccggagtagcgaaaacggcggcggcgggtggttgcacggcgcgggagcgatggggagcacgagggagtttggcgagaaggggaaaaagcgagagggagcgatggggaagcttaaataggggaggggagggccggacgtggccgggagaggcgggttttcgccggccaacgtggggagtgggggaggagagagaggcggtattcgaaaaccgaatcccggccatctcgggcgcgggcgcgggcgggagagagaggggagtgggcgcgggagatgcggtgcacgcgcggacgtggctgacgtggcccggaaaaggcggaggcgtggacgcggcggtggttgcgggcgcggcggcgccggctggagtaaggggacgggtctgataggtggggcccacctatcggcgtcccggggagagagggaggggcggcttggctgggcctcggcctgcggccggcccagcagggaggagggagagaaaaggagagaatgggccagcggcccattcgaaaaagggagagaaaaagaaaaagaaaaaggagaaaaggatttcctggaattaaaatattgcttgctcaattttaactggttaaaattatttctagggctctgaaaattccactaaaaatcctgttagtgaatttcgacatgtagaactcaagaaaaattccacatgccagttccgattattattcgcattgatttaaaagggtttactcttgctttgcactggtattttcgtagggtcgcttataaattaaatttttggcttgggaggagaacttcggggtgtgacagtcgagaaccagacttatgtatgaatgggccaagaactcaggattgacacgacacactgggccaaatttcacaagtctacgaagaggaacaccggaggaggccaccagccaacttgtgggctggttgggccagcccagggttcggctaaaccaggggttcggccgaaccaatgccagcgccgatggatgcagggttttgagggaacagtggagattcactccctatggcggttggagggtattaccgacctttccaaccaccataaccgtcattacctgcctatttaaggagttcactctcttcacttcaacacacacctcaagcaagagctctctcatttctctcaagtttagtttagtagtatctagttggtggaataggaatagagtagaaatcaggagtccagaagccttcggaagagttcgggtatgactctagtagctttcctttcctcttttgaaagctttgtacttttattagaatactcttctatatacatttatggtattgaaatactttccgagtatataagtacgtactttacattatgttcatgttatactgaatatacggctagggtatctgcgagatgctttggtgcgggtataatgtttgcatatgcaattactctctgtcatgacgatgatattagagtagtatctgatattttagacgtggtgcctagattacgggatatcattatttggggttatatactgcggataagaggtgggccgctgacggtgacagcttagtacgggtattcctccgcgccggtatataattcaaagttaattccctggggaggttattcctccgtattgagccccggttgtatggttatgacgggctgttgtaaggaactcggcagtcaggggtggcttctcgaagtacaaggagggcatcggatagagggtattagctgtatatcggttaactagaatgtatgtatactatgtatattagaagtacaggaatagattttctttctcttttctttccacttagcttagataatatattatgagaatgagtagctaatgcttgtgtgtcactctacccttagattatcttaacccctacttagaatatgattatcacaagtaatatataaattattagtcaagttctctctacatgatcttcccacaggataaaataaatacgatacccttggaatactctcgggtgaaatgctacaatggtatattcatgcgcttgcggatgaactctgtaaccataatataccagaagtatttctgcgctattgctgggaattatatttctagtaatgacgttaagaaatacgaacaatcacccatcctggaatacaatgttctttgtcacccagtttgtggaaggattgagagctgaaattagagcggctgttataatgcatcgacccgaagatttgggtactgctgtggatcttgcccgtttacaggaggaggtgttggaggcgatcaggagggaatctcgtcgtcctgagacaagttccagcagtcggactaccaatttttgttcggccacagtgtttccagtgggacaacctcgtaccattttggcagctggaactcgttctgataagcgcatgtctcgggtggaggacaaagtagctgctcttcatgctattctcaaggctaaggggctctgttacacttgcggtgagcgttggagcagagatcataaatatggtccaactgtgcaacttcatgtggtggaagagctattggaattccgggattcttcttctaaagagaggggtgatgaggagaaggattctgctgttattcctaactctgaatatgaaggtgaagtgtgtcagatttccaaagaagctatgcaaggcactgagacaagtggtactctcagacttcaagggttgattcaacacaatgaaattctaatgttagtcaactctggcagttcacacagctttatttcagagggattggccgataaatggactcagcagcgacatgttttgtcacctatcaaggtcaaagttgctgatgggggtattttggagtgtgttactgagttggaggattgtctttggtgtgtacaagggatatcctttcaatctaacttcaaggttttaccactcggcagctatgatgtaattttgggcatggattggttagagcaacatagcccaatgcaaatcaattggcgagcgaaaaccttgcagtttcagtataagcagcgtgcagtttgtcttaaaggtgtttcagctaatattgctcttttccctagtatcactggtaatcaagttaagggactagtccatcgtaatgcggtgttgcatgctgtggaattttgttcgttggtggaagaatcgtcatcttcttctctgcctacagaaattgctcagttacttgaggaattttctgctgtctttgacgaacttcagggtttaccaccagctggatatttgatcactctattcctctactgccaggagctcatccagttaaccttcgaccttaccgatataatcctgctcagaagaatgagattgagcatcaagtgtctgatatgttacagcagggagttatacagccgagttctagccctttttcttctccagtgttgctggttcttaagaaggatctcacttggcgtttttgcattgactatagacacttaaatgccattacagtaaagaatcgttaccctcttccaataatcgatgaactattggatgaattggctgcttcttgtttattcacaagtttggacttgcaagctggatatcaccagattaggatgcggcttgaagatgtgcacaagactgcactgaaaacccacaatggtcactatgagtttcgggtgatgtcatttgggcttactgctgcgccggccacttttcaagagctgatgaacacaattctatctcctctactgcggaaaggagtgttggtcttcattgatgatattctagtttacagtacatctttggatcagcatgtgtctttacttcggtaggtgtttcagctattggctcaacatcaactaaaagttaaacgttccaaatattcatttgcacagactagtcttacgtatttgggacatgtgatcagtttggctggtgtggctactgatacaaagaatattcaagcagtttaatcttggtctattccacagaatgttaaggaagttcgtggttttcttggtttggctgggtactaccgcaaatttgtgcgtcattttggaattatcagtcgacctctcaaagatttactgaagaaaaatgtggtgtttgtttggagttcagaacatcaggcggctttcgatgctctgaagttagcgcttactactgctcctgtattggcgttgccggatttcactaagcaatttgagattgaaacggatgcttctgataaaggggtgggagcagtattaatgcagtcaggatatcctttggctttcctcagtcgttctttggggccccagaacagaggtttgtcgacctatgaaaaagagtgccttgctattttactcgctgttgatcattggagatcatatttgcaatttggtgaatttgtcattcgtactgaccagcgcagtttgacacatctggatgatcaatgttggttactccctggcaacaacgtgctctcactaaatttttgggtcttcagtatcgcttggtctattaaaagggattagaaaaccgagctgctgatgctttatctcgttgctctcatggagaagtgttacagttgagtgctttgtcatcttgcattccgacttggttggaagaagtagagaatgggtatgctgctgacctggctacttctcaactcatttctcagatagtattatctccagagcagtttctagattatactctgacagatgggattcttcgcttcaaaggctgtatttggttgggttcgaattccactttgcagaccagagtgttgatagctttccactgctcagctattggaggtcattcagggattcaggtcacatacagtcgagtgcatcgtttgtttgcttggcccggcctcaaacgtgttgtccggatgtttgttaacacttgtgaggtatgcaaacaagctaagtctgaaagagtgaaatatcctggtttgttgcaaccgctaccggtccctgatcatgcttggtagacgatctccttggattttattgaggggttacctatatcagccggctttgattgtatttttgtggttgtggacaaattcagtcgttatgtgtcacatcctgattttcgttttaggatttataaattatttaataaattattattagaatttatattaaatgttcattaatttacaagtgaagttaaatgtgggaaataaaattcttaaatataaagcatggatggatttaatttttatgaaattctccatggttaattatactctctgaaatttctcggatttttcggagctcaattcctaattttaatcatacaaagaacattttagtaattacccacatattaaattaatcattaaattgcctgattataatcttgttaagtactttgagtgtccaagtattttcaggatttttcttgaaattatttgagcattggaagtatttttaacaattcaaagatcatttcagtgattattttaattagaaaaagttttaaatcttcccctaagccgtgggctgattccagcccatctccgtcctttgtgtgcacggctgtgcagcccatgtcggcccagccgagctcccccttctctttctttctttgctttgttttcagccagcccaagagggaaagtatactttccgtccctgtcactacagtatcgtcttcaacctctggcagcttacctgagaccgaattggctcggtttttcccctccaaatccgaccttttctcttgtgttttcctaaaattagttgaggggaaattatctcctccttatcatatttctttccctaaagtttcggagatcaattttgctcggataaaccgaatcgaattcgttttcgagtttatctctccacctaaccctcggatttttctggctcaaatcctttcgttttgagttcgatctctctcacccatgactatataaagcatcccctagtcgtcctcttccgtttgccccaagtcccgagctctaccgttgcccgtagcgcggccaccgcgtagccctagccgttgccgtcgttgtcatcgttccagccgcgccgcgctgtggttgtggtcgccgtcgccgcttagcgtcatcaccgtcgggttcacgcggaggaggagcacctcggccgcccctttgcagccgccgaagaccgtcggagagccgtcgtcgccgtcaagtcaagccgagccggcgttggagttcgtcgccggccttcgttcgtcgttgttctttacaccggtgagttcgcgtcgtcgtcgtcttcgcatgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagtttcggacgttccggaggagagcgtttacgttgaggaaggttcagaagcgtttgaggaagctcaaggcaagtcacacagatcccaaataaccctttaagcaggttgaaccagtttaaagctaatgttttatttcaacttatgcattattttcgaatgtcatcgagttgtgagcctttcccatttaattatggccaacaatgactttattttcctatgagtaataaattaattagcttgaaccttatatattggtttggtttagctaaatgctatatatataattgcttagccatgcttagaaacattagctcattaatgggctgaatcaccttacattattacttatggttatatttaatgttagctcacgatggttaatcgtgttatgataattaattgataattagagtctgattaaaggtgggttgtgagcacatggttttgatggtcgtgctcatgacaattaaggaccggttcacgagctactgttgtgaaacattaaccgtgccaatcacaagccagcgtgggcaacggctttatcttttgtatagcatgattcattgcggggtgccagactgagaagcggcgagaagtccgtgggggtcgctggggagtccatgcctctggttatagttatagagggggtgattatgatccaggaatggtgcactgtggtgagttgtgttgtgcagagagtattgtcacaacctctattcgggtactttctagtatcgcgacgcatggtagacatgatgttgaggctgtgtcttgtgggtacagtggtacacctctggccagagtaaaagtattcgaatagccgtgcccgctgttatgggcgggttgagcaatgtttttcgtgattactctcacacctctcacaaaaattattgatgctataactggtaataatttgcttagctcctggtttggagttagatctgtgcagccgggtttggttgtttagaagtgtgctgttcagtgttgattaaaattgatgattactctactgttttactattcttaaatatttgttaaatgctgcttttgcaaatgagtctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccctagttgagctgcctgtgggagtggagctgaaaccatcgctagatcgtttttccgctgctgtttttttttcttttgtaagaatataacgatattattatgatggatttgtatattaaattgcctcggttgattcctggacgaggattttatgcacaaataagttcggaagttactagtgaattctgggcgtgacattatgctcattttgtggcgttaacacatccatttactgcttttgatgtgggtttggcatatttgaacaacatgtacaagttacatggattgcctcagcatatcatttctggttggaacgtatctttacaagtgccttgtggacagaactttttcgcttggcagatacacaattgaaaatgagttccgcatatcatccgcaggctgacgggcagaccgaaagggtgaatcagtgtctggaaacttttttgtgatgttttattcatgcttgcccgaagaaatgatttcaatggcttgccctggcagaattttcgtataatacggcttatcactcagcacttgacacctctccgtttgaagttctttatggacatccacccagacattttggtggtttggatatttctgagtgtgtagtatctctaaagaacgatcactagtttacttcgtcagcatttgctgcgagctcaacaaggaatgaagtcacaagctgacaagaagcgttctgaccgtacctttcaagtcggtggttggatttttcacaaggctcaaccttatgcacaatcatctttggctgttcgttctaatcacaaattggcgttttgctactttgggccttttcaagtgctagctaaagtaggagtcgtggcctaccgtttgcagcttccattggattgcgctattcatccggtgttatgtctctcagcttcgtcaagcatcttaccccgctcaacctactgatgttcgtcttcctcctgctgttccacctgaagatattgttcctgtggaaattcttgaacgacgcgtggtcaaaagaggagatcatgcgacagaacaggtgaagattcgctgcaaggtcactcgtcggctgagtctacttgggaggatgctgcagctctccacctgcattttcctgaagcaccgccttgggggcaggctagttccgaaggagggaggaatgtcacggcagcgactactcatacgtctactgtggacaatccgacaacagagaacccggtgaagcattgagttcgacctgagcgtatcaagcgggccaatgtcagaatcgctgggccagaatggatcatgggctgatgtattcgcgcggctatataagcgcactaggtggaagggaaaagaggtcgaattaattgtattctgaactatctcctaaactgaatacttcttccccttccccaagtctgaatatctctctctctctctgtgttcttcccctgttcgactctgttctatcttcttcctctcaaactttccagaaatcaacagagttcgtaacagttagctccactcttttgtaatgatatgatttgaatttattttatgtaatttaaattcctgtatttacttcatgcaatttaaattccgcatgagttttgcctctcctattaatttctgtggagtgtgtttctactctctctctccaattcttcgatctcgtattcctagcgaggaacgtagaggcaaccttatatagccctcgagctatttgagagggagttcaatttgagaggttgaactcctcatctgagtagggttctttgtagctttttttaacctcctcctagatctagctttccacataactatgatcttaaggaaatgtttgatagaaattttaaacgagtattatgggggaagaattttgggacaattttgttcttgccccaactttgattgccaatattgattttgcccctgttttttagggttttcgtttttaccctaattttttaaatgaatcaaccgtttgcccctgttccgttaattcttgctaacggtgttaaatgtggagggtaaaaagacaagtaaaccattagatattttcccgtacttttgatataatcaaaatacaaatctattgatgccatactatagcagtaatttaatttgtcaaaaaattgtgaaagtttgccaaaatttgggtcaaatttgaaagtggtgtacaaaagtaccggaaaatatctaagggtatacttatcctttctaccccgcaatgaacaccgttagcaagaattaacagaatagaggtaaacggctgtttcgtttaaaaaaaaagtagggataaaaacgaaaacctaaaatataggggcaaaatcaatattgaaaatcgaagtagagacaagaacgaaattgccccaacaatttttgtacgctttattcatgcccacactagagcgggtagaggtcctaaaaaacagccgactttttctggacttacatagttacatatggatggatgtgcggtagccttctgagcggtggaagatatctcagagaattaacccaagcctttcgagagtaataggtttttttatctacaagccaaggtgcatctaagagatcagctctacctaaatctgaaataacaagtatgtgtacctttggttgaggatttatattgctcctccttattactgtctctatttctaaatcactactataaaaaaacatttttgcaaacgggccaaagcgatttttccaggtggccatccactccgcatgaacttcaaagcatgcgaaaatacacgatttttgtaggcggacatttgtccctcctgcaaaaatgattttagcaggcggcatctccatattcgtaggcactatagccacctgcttgcgaaaatgttttcggagaaaaaaaaagccaccacccacccgctgctgccctctccccctctggccatgccaccgccttcgccccctccgccagatctgtgagggagacaaagagggagtgggggagggagggtaggggaatcgcaccaccgtcgacttccatgacgacgaaaaagacgaccatgacgacgaggaagatgaccacacccgtcacctgatccgccgcacccgcacgtcgccatccaggaactgccaccccgcccgtcaccatctccagctgccgaggtagagtagagctgaggagaggagagggacgggagctacaccgcccctcccctccggccacgctgatcccctcccctcggttcgcgccaccaccgacgcccctccccttcggccgagccgccgctgacgccgctccttgtcaccaataccaccacccacacctccccttcggccatgttgccgccattgcccctcctctccgcccgcgccgctgcaaacgcccctcccctctgcctgcgacaccgttgacgcccctcccgtccacccgagctgccaccgacgccgctcctcgttgccgataccccgactacccacaccgctcctcctcggagccaccgctgacgatgccgcccctgccctctgagccgtgcgtgagagagaagaaaggtcgagaggataaggataaggatggtggagagaaaagagtagtggatggtggaggaaaggataagatgggacgcaatattatttttggtgagctgcaggcacgattttcatagacggaggacaatctcagccccattgtcaatttcgtaggtggccatttacttccaagatgcctatccgcctagaaaaaatatatattatcgtctgaaaattggtttttctagtagtgaatatttgatattggttagttcaaaattgaaaatgtagggctgccacgataccctttgcaggaggactatgttcccgattatttcatttttcgtgatctacttttttgtttggagaaaaggtaatggaaacaaatctgatgtttatatacacagaagtgcttgtacaaaatcgaaagatacatcattaatacttaaactacagatctcataacaaagagaagaaaaacaaaaccaaaactacttgactaagcatcaaaactacattcgttctgtcctgctttcacaaaacaacactgaagtgatcttgatagattttccgaatggatccacatgtcctgacacatattaccttcgcccaccgacgctctctagcagaggcagagaagaagaggccctgccaataccatttgcgttccacgaatggatcctgcacaaacacctcatatcccgtggcacttaagcctccgatctaacatagttccttaaccattgtcaacacctccaaaaagcctttcgtccactcctcgccgtcctcacatgaacgctagctgtatctagccattagaccgaatccagtctccacggttgccgctagcaccgtcactgagcttattgttatcctaccaaagcccctccttgttgtcctaccagatctagcaatgatctggcagccagcacacctagggccctcgccgctgaccatcgtcaccgtcgtccacaccacaacgttgaaatgtacaggctgccacgttgaggaagccgcccctccaaccggagttgatgccgtcttccgccttcaattatctcgtgccacccctccagtcagaaccggtgccatagcccctgccaatgccgtctaaccaccgcctccatcgcagcctcaccaccctgccaaccaaagccgaacgcccgcctccaacgtcgttgtgcccccaccacttggagccaaggtaaagaatcaccactagcggctagcaaaggtgaatggcgagacaaaggggagagatgaccatccgtccaaccgcctgccaccataataaacaggtgctgccggccagcctatgtcggcgtgccaccaccaaactcaagcgtgtgtcatagtgaatgtggatctagaagagagagtgataaggacacggctatggtgcccggatttgtcccaatctttcacagtaaccaaaagatagcaaataatacagaccattgactagataaattgagcagcaattaattttcaaataaactagcagaaccaaatagccactccataaaatatagtgacaaaatagttgtgcaaatctcgcaaatatactccacccatgcggcaagggagtcacacgatcagagaacgaatacttctgtagaaatcaaagatgtgcccaagaaattgattcccgagcacactcctgttggttgattttgtggacttgtggcgataaaaattaggagatgggctaaaccaccggtttccttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcacccgatcgatcaaggcactggaaggggttcatgaggtatctcacaacagaagaaacaatgaagaagaaagaagaagagcaatggcttcatctcaggtcagttagatcaattaattttcgcataagcagaaggtgaccatgtttaggctaagactcaattatttaattggaataaattccaacattgtggtatcagagcctaatcttagccttcttgttaacagtgaaatttggtaagcccggagtagtcatcgacttagagtcagcatcggcttcgaagtcttgagattagccgatgagagttgtcaagtcatcagttgtcggattcttgctatattcggttaaggaaattgatctactagatgaagcttatctagaagagaccgagttcaaagagaatgtggcatggcaagttatctattaattaggaatagtttgttagtttccttttatctttaggaaagtgtgtttagtgtcctataaggattttatcttttccttttatctttaggaaagtttctttcttgtccgatgaggacttgtatcaacccatgggtataaatatgtacacctaggatctgtgtaatttatcgctacgatcaatacaatttgacgcatcgccaccctttttacttctacttttgtttttacgttccggcggaacttggcacccgatgcagggctgcatcgtcttcgatctctggcgaagggataagtccaatgttccgccggcccaggcaattgtatcgtctacatcggcgtagttcaaggctgcatcagtacattcgacctcttggattgctttggtttggatgatatacttgcctacctatttatcatatgtctatgttaatctagtcttagcatatcaatttagctctatcggctgcttctcgttttagggtttctgccggtatcggctaaatctcatatgtctctgttaatcttgtcaggtgcaggatcaaactgactggcacgcccgcatctcatcaatctttgaacctgcacaggagctaagcagatctcccaggccggtgtgttcgattttttcatcaacacttctttatcccatcatccctaagtgaagccattatgccaattaaaccctaatttctattcggcatgcatgatgcgattttgagttaattagattagattaatccctttgccttggttgcataagcgaagccctgttatactgctgatctcggccaactgctgatctcggccaacagtagaagaagcaaaattattgaagagtttaattttgttgatttttatgagaagaagaggattgggataaacaagattgaaattcccaattcaaacactaagaattcctagaccgatgctaaggtttcggctagcactcagcaaacaagaaaggggataaactagattgaaattccccattatcaagcaaaagggaataaacaagattgaaatttcccgaaatccccaataagccggatccaattggcctaaaatccccaaatgaggaagcctaatttttgggggaagaaccctaagtcacaaatatccgaattaaatgcaaattcaagtcaaaattaggtttgagtttgggttacttatcggatttagaccccctaagattgccggcgcacaccggcctcctcggggcagtgccggttgaccgccgtgcgcgcaccaccttggagctcgtctctccaccgtccctcgccggggacgggaaacgtcggcttggcagctgccttcgtgctcttgccccaccccgatgaggtccggccgcatcgccgccgcctcgccggactgccgacgccttggcacaacggcttggcgccgccctcgggggcgccccccagccggctgagatggagccgctgcggcacttgtcgccacacgcgtgcgccgcctcgtcggaccgccgtcgcaacatcgccgccgattcgctcgctcgctcgccggacgccgaatcgggaatagaaggggataagaatgagctagggttaggtctcacacccattcccccctggcgagcgatttcttcagtgcgggcgaaatcttggccgtccgtttgatcagatggccgccctcgctcccgcatcgggccgtcgccgtcatgggccaagctgatctgggccacgtccgccaaagcgccgagcgcgcacataaatgggccggtccattttgggccagcttttcgataagagtgggcctttattttttatttattaagcccatgattttaattcctcagaatgtgttatatctttattagctaaattttagcccgattttagccttttttttatgggccggcttaggaagtgatgagccgtattattattttaagcccgccatttatgttttatgtatttccagaaatttatttatgacctttcttagccattaaaaattgctggaaaattatggtcaattatttgatcactcagaaaattatttctagttaaatggaaccaacaggaagtttagctagaaagaaattaatgatatgatattatatttgaccaatgttaatatgatttcatgtcaatatttattaagattattatttccttaagccacttaatttattcctagttgaatagaaatttaactagaaagtatttatgatttcatgtcaacatcattatgatggtcagtgccttagtaacttaattatttatagtcgaatggaaccaacgagaaattcgagtagaaagcattaagatctgaagttatatttaacccacgtttttataattgcatgtcaattataatttttttattccttagttattttctaccaaatggtgatataattaaggaataaattttaagattattcataattatttatgaccaatggtgttttgactatgaaattctaagtttattttgcatatgattgactaagccaaggtgaattaattatatgcaattggcaatgtttattatttaagatcagttgcaatacttggtaaatatttctagattaatggaaccaacagaatgtttatctagaaagaaaaaatatttcattaagatagtaatttccttaattattttttgcccaacggtgatgtaattaagggaagaaatctaagtattgtcaatcgttattttaattttctctgtcattttggccttaacggtgattagacttagaattttatttatgccattagtgcattaattcctttgtcacttctaccttatggtgatgtgatcaaggatctaatctatcagtaagcttaattcctttaccatttctgcccaacggtgatatggctaaggattttaattttaattctatggcatcactaatggcgtcatttcctatatcatttctaccgtatggtgatttgatttgggattttaaattatttacattatcacttctaacctttggtgatgtgacttaagacattaatgtttattccctaatcagttctgcccaacggtgatttgatttttggattataagtaatttcatttaatgattctttcgccttgtctcttcccaacggtgagacaaagcgaaataaagattaagctatcgttattgtgtaagtgattgtaataatgtacatcatttgcacaagcaaccacaataatagtgccacttaatattttagcaataaataatgttgtttatcagttaaagtctatggaattattattatttttcctcattgacttaactgagcctaaggcctacttgagtatgacttggcattgacaaaggattccttatggctcccgtagctaatgtcactaatttttttttctaaactcaagaggcatctttagcctgggagtaggccaatataatgttatgtttcgcatatcactcataaacattaagattatcatccctgttggtgttaggggagaattttgagcatgactttgcaaaactgtatctagcaaacgttgagatgaacttttagaagtttgtgaaaactaatgcttagtacaattttagtgcctatgcacatttgccgccataatttaaaaggtagcacaagaaataaatcataaggcgtgcaaacttagtgggatggacatcgaacatttcatatgcgccacttgtccatttcatattatttttctcccattagactacggtcattttcagttatgtaatactaagacaaagtggaccataattgacttggttcatcattccacaaatcaataaaaaatatagaagattaagaggcaaaataagtaagatcctattaatcttgtcatttgatggcaaagatgaagctttactaaggggttgtagcaactctaaatttaataataataaagctcactttcctcgcaaggggaaataaaattgcctctatgtcctatgtatgctactcttgaaattttcttgtgtaagttctttgcaagtaatagggacatgcttaatgtcctgattcaacaaactagttaaataagaagattaaaggcattattttgggttgaatcattatgagacgttgtcgaaattatggccttatttttcggccacatttctaggggagaatatacgtctcattaaggtcgagacacttcacccttagaaatttttgacatctatcattacttagatgataattcgctaagtaaagctaaagtaaaatcaagtgattcaagttcataaggtattatgcttccattacataaataataagagaagattattctacctcatttatgactcatagctccattatgtggatgctagaattttgtatctcttaatttgtgacttgcacaattaaatatacataacatagcttgagggttttgttatggaaagaaaagtcacatatagggtgcagacttaagaaatccatttgtggacttaatcaagcattgatgatgatttaaattccgctgcatcattagtgaactaagcttaaataagaatcaggagaataactattctataatgatggaagtaagacgccattgggagtgtgtcattgtcgcttatgtcacataactaggggagtttggaacgtctcatgagatagagatattcttttccttagattttaatggcgttgtttagctttaagttaaaatttcactaagtcaagaaattagccaacaaatgatcatttaaggctaggtttacccataagcgacctccgatttcctttaagaaatttaagacactaatgctaaaatcaaatgaagttatgagatcggattatggtggtaaatactaaataaagtttgttcaccttataagacattaaaaataagcgttcatccaaatggttttcgaaccatgtaagaataaattgagatggatgaacaaaataagacattaaagtgttcatctaaatggttttcgaaccatataagaataattgagattgatgaacaaaataaagaatttagtagaagtttctgaatgagtcaaaatattcggccatttaagtgggttaataagattaagcctgactctaatggaaatttcgaacaattcaagtgaggtggacaggtgcatgaaaattaaaggtggaaaatttcattcaccggtactccatactaatgatattttattgttaagcaatgcatattgctgttagaaactaaggaaatttttccatgaattattttggtctgaaggagcactgggcttatatcagtaagtcatacattgacataaagaaataatttgagagaattcagttaaagttagtcaagttgaaattaaattataaagataatcatttatgattcagctgacagaagcttgagattagctcaaatctggatgcctacagatttggcaaacatttttactgggaatcttggcagtatttaattaaatccagagtagaccactggtattaagaatgttcacaaggcaatcttatgtaacatgctcatgtttctaaagtccaatgatctcagaagtttagagacatttggacacttattttgtgagatgtgtggatatttataaagattattcagattaagctatgtccacacataggggagcaatgaccatgtaaaagctccaaaaatagtctcttactgcatagtcgatgatgcagttagattttaaagcatgttatgattaatcatatatataagaatatttcccagaactaagagtggtaaatagcgctcataaaccactcaaaaggtgtaaaccactcaattatactgtgttatatgttgtgcactaattgaacacagttttctattttagtagcaacatgttgtgtgttttctgctaatacattgatatagttgtgaaacatatgtcctaggatcgaattattattaatctaagcttttgcttatggatgcatactctaaaggctcataaagttaagattaattaagatatgttctagccagtacatgtgtaaataagagcctcactaagatcctggatgagggggacttaatttttcaatcaacacccactaagttaagcttgagtttatttgagttctatagtgagatataggtcttgttgtctcggtgacgcataatgttgttgaagacacattgccttggggagctattttatttaatagactcataagtaagtctcgaaatcaaggggagaatgttggttgattttgtcgacttgtatcgataaagattaggagaggggctaaaccaccggtttccttatcctaacaagaaacaaactacgagataaatctgttttgtgtgatcaaaatagactcgaattttagattgagatagacccccgagccccaccagtgtcacctataaaaggaaagagaaggagggaggcaggtgacgacttatctctctctaacctcaaaccctaaattaatcgcccgatcgatcaaggcactggaaggggctcgtgaggtatctcacaatagaagaaacaatgaagaagaaagaagaagagcaatggcttcatctcagatcagttagattaattaattttcgcataagcagaaggtgatcatgtttaggctaagactcaattatttaattggaataaattccaacaactcctccaaaccagcacttggccggtggcttcaatagatcatggtcgatggattcaccattaaccagctcagcagggatgataaccctagatgcgaaaacttcgacaaaagatcaacctctccaaaaagttgtcttcggcttggtgaagtgtcacgcccggaatttctatccaaaattccaaactcttacatgtgtgtgaaccctcgtccaggaatcagccgaggcacacaataacaaattgataatagagtacaattattactctaattaataagcgaataaaatgtcattacagaggtagatagttcctatcaatcaataaaaatctaagcagcggaagaataagataaacggcgcagacgactccactccacaggcagcttgaccaaggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaatgaacatttcagaatttaataaaacagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacgggaaacgacgacgatgacgtcagcgggaccaccggcggcggctcgggcgcgcaaggttgccggcgaacgacggcgcgacgacgcgaacggaggacaccaacacgtagagggcgacgcggcgaactcaccggtgaccaaagcaacggcggaagatcaacggatggtgacagcgtcgaggaagaagcggcggcgaccttcggcttgacgacggcgacggtgttccagcggcccacagtgacgacggaggggcagacgaggtcggcgacggcttggcgatcacgacggtggctttcccgagcggcaacgacaaccggagcgacggcgacgcacggttggagctgcggcggcgacggcggcgcgaagctacacggggctagggcgctacgggcggcgacggacgaagacgagggtggcgacgggtagcggcgggcttgggggtccttttataggggttggaaggcggcggcgaaggcccacggcgaccggcgacgagaaggaaagtttagggttcagaggagagagacgaatccgattcgagatcgaatccacggatttccaaacgaaattagccgacgattccaaaagagaaaagatagaggggatcccggggatcatttcccctctattaatttcaccggaaacggaaaggggcggctggatttggaaggagacgacggcggcgcggcgctagggttcggccgggcgatggcgcgaggaagacaacggccctgacaggtgggccccacctgtcagcgggcagacgcgcgcgcgcgagctcggctgcgggccggattgggccaggagagagagaaggttccaaaagagaactttaaaaccttttccaatttaaattattcatgaaatgcaattccatttattaaaaatacttccttagctcaaataaatcccagaaaaatctaggaattatagaattaagcaaagtatttaatgaaattttatctggccccattttatattgaaatttattaattaaaactagatcttctcttctaggcttttaaaataaattctaataattccaatttagacaacaatttaaatatttgggatttttagtgtgtgacatgaagtgactggaatagatatactggattgggacaccaccatttttaatttctggcctttctggtatatcctccttcttcctctcgtgccctgtagaaccaattataagtcccttgcattcaaccctatggttccgattcacttgaataggatttgttccaactaactaggctctaaaaaaaatatcttatatattagaaggcatcttggtcccatcactctatccacctcgaagcaaagccgtcctcggctttcatgtaattttggaaacctcttgttgagattataaacacataatgatttaatttattccataaataaatcataatattgcagatgcaaactagcatgaacgtatcattggatctacacatgtacactaggcagtaaaacataaacagatcaaatatacgtaccatattgaacacgtaccgaggttgccgaaaaatcggttgctcagcaggaattactcgtggttgtgggcgttgacgaaggcgtgcaacacgcgagcgaagaggaagacgagccgtcgtggacgaacagggagcagtcgtgcgaagcgctttcaaaaacattattgccgcctctcccggtgcagaaagtcgaaggcagaggttctggagaactgctctcccgatcgccggtgcacgccggcgagcaggatggagtagtatacgagcgacggcgcagcacagagtaggaggcaaaccctggatgatttcgcgtgtgttgcgtggaagcggcggctcggtttatatagagaaaggttgctttatcagggcgcccgcatgatctctactccgcgtcgcttaatcagggtgcccgcacgatctccactccgcgtaactgaaccagatacactccgcgtaaccgaaccagataagtcgcgcataacttatccagatgccacgccgtttttcacgcaatggatttttcggtatgtttccaaaacaaacaaatctgaatttcccacagcaaaacaaaactgcaaaaggaggctgcatctgcgacaattcgacacgtacgtcgtgcacgcgcatcgccggcctagcccggcgagcaagcgcgcgtctgtccccctcttctctccacctcacatgcttcaagtggctaggagggcatcctcccttttaaggaggtctccctctcttagaataactccccatgcatgtcatcctatgaggtggtcttttgtgattttccaaagaattaatctttaagtgggctaagacccatctattaattccaacacctctttctttttcttcatagcaacaaacacatcagcctcaatagcactcctcgtcatcagtttcagcacatgttgcaccgccttgtgcacaaaagaataattattggactgaccaccatgtgtagcatcaagatcaaactgccatagtctacccaacaataaatgacatgcactcaatggcgcgacgtcagagtccactttatccacatactttccgatagaaaattttactctcaccttgtgagtaattttcagtataccactctgattcatccattgaatataacatggtgttggaagcctccggattggcaaagcaccaaatctaaactaacaacatttgtaaaacttccaccatcaattttaatttgcataccttctcacgaataatacattgcgactgaaaaatattggagcgttgtcccttcacaccattaacagtatagcttctacttcttgagccatcatggataaaccgtttttactcacctgtaactattggcttatagttaggatatgcgtaggttacgatagcataaatcaaaattttctaccgtgtaaaccaggaaccacatgcaagtataagatcatagatcgttaccactcgacgcgctgcatagcggaagaaagcgctaagaaggcaaagccaccctcgcgatgtagcgcgtgccgatatagaggaagtgctcgattgcaccggctcgaccttctcctcctcgtgcgttctcctcgtcgtgctcccacgccgatcagcaccgcaaagcagcagcgcctctaccggtattcacacgtacaaggacggaacaccatgcatagatgtgctagcacccgcgcgcggctagggttttgctcgggagggaagtgacggctagggtttctcgcatgatgcaataactccgccggtcacacccctcataaatatataggatccacgactcaggcctccaaggcctataggactcctattcagatccctatctgaactaaggtcatattggatctccatccaatccccttattctggcccattaagcgtgccaccttgtaggttcatgtacactcggctgtaacccgaaaactcattttcggtccacgtgtcaacagcggcccctagcagaacttattgaccaaccggacatacataaagatcatatcggctgaacctctagtatatacttgtataaacccctttgcctcacgatatcgattaagctcgaggctagatatgtgccatcctataatagctcaatcattcactcgaacttgtgatagattataaaacctgtgattgactcctcaatcacctttagcatggccatgcactttcataatctataatatcgaggggcccaaatatctctccataggaggggcaaatcccatattcttgattaattattcatatcccactacatgtttcattgcatacccgaaaactgttttataactacccaattacgaagtagtgtttagcagtccctaagcaagctactacacatcatagcaatccaaaattaagctaaggctaatctacaccgcacactttactctggagtcctggactcttttgtagttccccgactccctctccctaatggcagttgcagcttgcagtgccatatccatgtccccctcctatattccgtgctcacctcaacattctcctgggagttatctcctagctcagcaggtggccgccctgctctctctctcccttcctctccagtgggtatgtcctctctatttccttagatttgtggattgggcgtcagccgctggactggtgccgcaggacctcttattgcaaagataactcgtccaaattgcatgttgtagaggaccggaggatggagccactaaaatcgtgtgttgcagaggattaaaaggtgttgctgacgaggtgtacatatatatgtatgcaagccggtgcatatatatatatatatatatatatatatatatatatatatatatatatatatatatatatatatatatatatatatgtaatcttgccttaaattttgctttgagattaatttgaaatattgccttgtgtacacaatgatggaactaatcttcgtttattcatgacaaatacatgctctacacgtgcctaatcttgcatgccatatgtgattagattttgctttgacattaattttgaatcttgcctcccatacacaattatatggaactaatcttcgttagttcacgtttcagaattagttcacggttggaactaacccatacactgcacatgcgggccctagggaattctcaactctctcgttgcaccacgtggcgagcgttttgagggagacatgtggcagactgagagcgtttttagaaagtttaatggaattttagtatataatagatagatagataatagataatagataatagatagatagatagatagataatgtgttatctatttcaaggaacaatgttagataattatgtaaacatagtatgtgatacaatcatctatacgattgcctctaggacatatcacctatagtaacattagtggatgagtcaccaagaggatcatcagagaaagctgtagttaccaatcctggtgcagaagaaacttcagcactgctagcattcatgcattccctttgcactagaggttgatttgacatgccgattaggagaagaaaagtttttactatggaccactttaaacttcccataattattcatagcagcaattcttttgttgttcaagtctgaatactgatctctagctgcaaaaacacatacctctttatttttctttctactaacatctttgcaggacttaacgataatttgcttcgtggcaatagaaagattttcagcaaacataaacctcttcccatcaagttgggtcgcacaaccatgtgcattcagtaactcatctctgataatagatgcactccacgaagaacgtatagcctgcttcttggaagccttaaaatcttcacctacaatagccaacttctcaattggtgaatcatgttgttgacgcagcagcactttcatccccttccacgtcgctgtagatttgttcttcctgtagatttgaccaccactgcaaaacacgaaaagaaaatcgccgctctgcaaaatccaacatctgggagtctttgtagcatcttaattagcggcataaacatagatttcctgctagatcgaggaatagtagctagatcgaggagtctttgtgcatagcaccttcccaatcatagtagctagatcgaggaatagtagctagattgaaaagaaatcctccaacgcacatcttcacaatcatagtagctagatcgagcagtctttgtgcataatagcggcataaacatagatttcttcccgagccaatattcatccatcattgaaaaacagtagaaaaatttctaaatgaagaatgatcaacccaaagctttgatatcaatgtttttttgagcacgatcaggatgctattcacttcttgttcactcaggtctccgccgagtgatatgattttggcggggtcagagtcatctatctgcaaccagacaaccttgccgtggggacgggtttcagcgtcggcctggttctttcttgccgttcgacttctaaggtatgaactcccctgtcgaaggaggccacctatagatggccataaggcccgaggcccgaaggcccggcccatggcacggctttttggcccggcccaagcaccgcacggcttgacttgggtcgggcccgtgccagcctggcccgaccgccgggccgtgtctgggcctcccctccggcacgctgggctggcccggcacggtcaggccggcctggcatgatgggccggcaggccaggcatgccacacaaagtatagggactaaaaataaacatataaatgtcactgtccaaagaatagggaccttaaatagacttattttagctattgatatcacaacccaaagaaaagggaggtaaaatagactttttttagctatatatatgtcacagcccaataggagggaggaaaattagacttattctgaggaaaagcactatgggccatcgtgccttcgggccggcccggcacggccccaggcgtgttgggccgtgcctaggccgtgagtgcggcacgtgggctggcacggcatggcccggtgcgtcggtcgggccgtgtcggctcgacaagccttggcccaggcacgaccgggcctgggccgtgccgtgccgggtggcccacatggcgatctataaggccaccatggtagccgaaggatgggaacccttgacaactaccacaccggctgggctaggcatcttgagcttgaggtagttgtgataagagactgcttcaaacttggtcaaagtgcctcagccgaagatggcgttgtaattgtatgggatgtcaacaatgtcgaagagtatctcttcttctctcttgttttcttgtgtgccgaaggtgactttgaggtgggcttgacccaaaacttgcactacttcgcctccaaaccccctgagcgaggttggtgcttgggacaatgccagtgtcggcaaacccatcttggcatatgttccggcgaagatgacatcagccgaactgcctccataaatcaagatatgccgaacttcaataccaaccatctctgcaccaaccgatcctggtgtgggaaaaggactccttcagcatccttcggtctgaaggatatctgttgcgtcaagtatcttgggaccccttcgcctgccgaaacaatactatgcactgctcgaagttgcatctttttttgtcgtttcgacacttgcgagggggggataagatcttgtgatgacctagatcactcttcactgtgcatcttggcgctgttcagcctgaggtgcttggttgaggaccgcttcgcgcgttgcctcttcagccctggcttgctgctgcctgagctcttgagtgttgccttgctgccgaatgttccggcattgctcggttgtgtgcgaagagtgtccatgaacggcgtagtataggtctttcctgatctttttgcgaaaaggttgttgctggccgcccgcttgctgagcgtcgaactccttgcgaagggcttgcacttcttctcctgccatcactgctttgccagctcgatcagttctaaatttttccatgtcatcggggcatggttcggccttaaaggctgcccttgattcaccggaggggttgagtgaatcagaacgggtgccgaactagtaacttgggcttgaatttgagcttgtgcgtgagcttgcgcggtggccgtctcggctgcggctgttttgtcatattcggcttgtatctcttgccgccgcttggtatctttttcgcctcatgcataaccatcgattatgcgaaagaggtgttcgagcatccttggttccttgcgggcgatcttcctagtgagttcgcccttaagtaggccggtcgaagtagcgttgatgacagaggcttctgttatgtcttgcacttggcaccgtgcttgcgagaagcggcgcacgtattcccttgtcgattctcctggcctctggctaatgccgagaagaccttattgtgttttcggctcctcataagtgcctcgaaagttaagaacaaagacattgcgcaattgctcccatgagtaaatgctactagtaggcaaattaatataccaagatcgagcaatgccatcaagagcgaggtgaattaccttcgcctttgtattctcgtcaccatgggcagcttcgattgtggactcatagatggagaggaactccttcggatccgtttctcccgaataccttgggacatgagggaacttgaactggggtgggatgggatgattcttgatcccccaactcaacggcaaacccttttcgccatccgacttgatcatgacgccttgctgagaaggccagcttagctgcgggtacgggggcgcaaatgaggttgagcagcagctgttgattgatgccccgtgccaaacaccattggctggttttgttggtcagtcggagcagcttgcatcaccatagctgggtcgaacacgacttggttccaaacttgatttggtagtgggaccgctccgtagccagagggcacggcttgtgcgaaggtcatgggtgcttggaccgcggtgcttgggtcgaattgcggcagttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctacaatatgacaaagaatacattgtcgggttgagttaataagcttcatgatgattgccacgcatggatagaatcctgagaagacaattgtatctattaattaggatattttacgtaatttccttacagatatgtttgggcaaaagtctgccgcaaagacttatggtatcatagagtttgttagagataagagtcgtgtccgatgtgtacatattttgtaaatctcgggtataaatagaccccgagccccatgtaatcaaactaatacacattcaatacaatctcggcgcatcgccacccttttactttcgttttgtttcgacgagttcttgctttcaggttgagttgcatcgatttcgatcttcaacaagaggtaaaacttgttatggcgccttgcgttctcgggattagtgcttccatcttcatgatactctaatcttgtttatgtaattcgtcgagttatcatatatcttatataatctccggcaatatcgccatctaacctacaatcggctaacgtctgttaatagaaggcagccgactaggttaaataccaatgttgacttagattatataggatatctaccactctatgaaacatccaacggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaacctgatgtatgatatcgggttgaattaaggcgcttcaaggtgattgccgcacatggatagagtcctgagaaggcaattgtatctattaattaggatgttttatgtaatctccttggagatatgcttgggcaaaagtctgccgcaaagacttatggtatcttagagtttcttagagatagtagttgtgtccgttaggacatatcttgtgattttcgggtataaatatacccgagccctatgtaacttttaacacacacgttcaatacaatctcggcgcatcgctacctttttgctttagttttattttgacgagttcttgctttcgggttgagctgcatcggtttcgatcttcaccaagaggtaaaacttgttatggtggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctactcgctttaatatcttaatatagagtgatatcggagtattagccgatacatgctagatctatctgatcggctatgctataaacgtatatagtctcattattaatatatatttcgatctatgtgatttatactgtctcggcatagcgaccgatctatcccaatcacttgatttaagtatatatcgatataatgattatatattgttaatatctacagccaatcgagtagatttagtcccttcttatttcttaatgactgccgatcaatgtatatatgacatcggcacctagccgatcggctattatttatagatttaactgcggtttctttgcttctatttcttgttgattacaggatcaaatcaactggcatgctcatacattcgaaggtgagatttggacctgtactagagttaagtaaatctcccaggcctcgtgttttctgtcaacacgcttttggcacgcccggtgggacatttaagaagtcagccaacaattcgtcctcatggccgagaaacaaccaccaccaccatccccagctagcccaggctctgttaaggaaaaggtgctgaaattagggttgactgacgtcaatgaaggaaacgtcgtgccgatcgatccagaaaaattcacacctgagcagaagatagagtttgaagcaatgttgcagcaagcacgggatcagttcttgaactcattcatgcagacccgcaaggggacacttgtttagaagtacaaaatagaagtggttgctgatgatccagggaccagttcttctaaggatggagatggaaaacaagctccagacggctcggctcagctgagtaacaaaagtgctatcgacagctctctaggaaatcaaggtgacaattctcaaggagtccatggagtgcaaggtgacggggtgcatggagtgcaaggtgatggtgctcaggggttgcaaggaggaaatcataatcagaatagtgatgcggcacaagattttttcagtaatttccaagatcgggttgactacgctgtgcatcatgctttgatcaatcaatctggggtgttagtcaataccttatcaaacatgatgaagtccatagccgatggttcaatagctgagcatcaggctgcaggcccggtttatttgcaaggaggtgtctttccaaattatcggtctttgattaccgatgttcagccatcaactcaggcggtttcctccgctgcaccaacatctcagccgacggtgttggcaactttttgtgacaagttgacaagcacgatcgcagcaccttaagccttgcggtgatcctagagtcgccaaccacctcgatctagcaaagagctaaacctagatgggttttgataactaaaccggctagcggagccgatttctagataactacccgtctcgtgggcaaaacggaaggttttcaggacaaacctacaaagagctgtcgcactctcacagcgacggcggacggtttatggcgcaacccgacaaagatggacaaactaagagaaaactaaaagcaatataaaaaaacaattcgatcgattgatagtagattggcttttttacaatgaaccggccatgtcccttatataggggttggtcttgccctctacaggccctcctccacgtccaactcgggatagaagccaaaggaaacccgaaacatgccttcccgagcaaagaaacctcgagacccgatgaaacagaatcggactcggccctgccggtcagactggccacacaccgccggtctgaccagccctcaaccggcggtctgaccgcccaacacacggcggtcagaccggcccactcggaggaaaccggcagacttccaaattttggcaatctttcctattttaatcctaggtgccaaatttgggtataaacacatgcccccctgcctttttgatgaacaacgtgaatctaaaagcatagaacatgtttttggtcttaggacgataatctaattaccggccatagtacctcctaagcgtcttgccaaacgctcgggaagtattgcttcaagtatttcccgttgattgctcgctgaaaacgctccccttgaagtgtctccaaaaaatacgcgttccctcgaacaatgccgcatactcgataaggaccctcccaactaggagaccacttaccgaactccttggatcgagtacccaaaggaaaaattgtcttccaaaccaagtctccaacttgaaacaactttcctttcacccttttgttgtatgccttggccaccctcttcttctctttctctatctcctccaatgccctcaagcgcttgtcgatgacttcatcaagattatctcccatcaacgtcttgtaatcttcacttgacaaatcatcttgcttgatataacgaagagaaccaagatttacctcaaccgataaaacggcttctttaccataaactaactcaaaaggagtgactttagtggcaccatgtttagatatcctatgcgcccacaatgcttcggaaagcacctcatgccacctctttgggtgttcctcaatcttcttttttactagcttcaacaatgtcttattactcgactcggcttgtccattagcctaagcgtagtaaggagaagaactcaacaatttaatactataagattcggtaaaactcttcacttcctaagacataaaagaagcaccttggtccgtagttaatgtttgcggaataccgaatctatgaataatatgcttcaaaataaagtcaattacctccgtatgagtcatattcttcaaaggcacggcttcggcccacttagtgaagtaatccgtagcaactagcacgaacttatgcccctttgataatgaaggataaatttgaccaacgaaatctaaagcccaccctcggaatggccatggtttgattatgggattcaacacggcggcgggcgccaattgaacattgccgaaccgttgacaagcctcacatcctctataatatttgaagcaatcatcaatcatcctcggccaatagaatcccgctcttctaagcaaccaattcatcttgtgggccgattgatgagttccacaaattccttcatgtacctcccccatagccactttagattgatcttcatctaagcacttcaacaagacaccatcaagcaatgtgtatttgaacgattgccgccgaattttccgatcaaccttaagtgtgggatccttcaaatattgaatcaaaggaattctccaatcttcttctgtcacctgggcacaaatgtccgaattcacaattaattcggcttccaaattgattgaaacgtgccccccggcgctctgtccaaacccggtcagaccgaccacacagggccagtcagaccgctcggggtcgccggtcagaccggcggcatgcggccggtcagaccgcccctggtctccagttttgccaatttcgcataaagatttaaaatcaagcaccgactcttctaatataaaaaataatcccttcttcacattatagccagatgcttgttgtgccaagccatttgctctagaattatcacgccaagcaatatgtgtaatagcaaaattatcaaaattgacaataatatccaaacatgaatcgaggtacctatttagtgatccgtccaagcatttgtagactccggcgagttgttgcaccaccaattccgaatcaccaaaagcctccacgtatttagctccaaccatctccataacttgtaagccgaacaataaagcattgtattcggcctgattgtttgtacaataatacttcaaacgaaccgatgcttcataacacatgccattaggtgaaaacaaaactacccctatgccttgaccttctttgcaagaagaaccatcaaaataaatcttccaaggtataacttcaattaagcaaacctctccctcataagcaatatctatatgatggtctactataaaatcacatacaatttggcctttcatagatttcaatggttcataagccaaatcatattctatcaaagcatatgcccacttaccaattctcccacttagaattggcctttgcaatatgtgtttaataacatcggcttgacaagtaactatgcatgtgctagataacaaataatgcctcaatttggtacaagcatagtataagcatagacaaagtctctctataaagacataccttgtttcggcatctaaaaggcggcggctcaaatatgtaatgatatactccttgccatcctcctcttgcgtcaaaatggcaccaatgactttgtcttcggaagcaatatataaccgaaaaggctttccggctttaggcgctcgcacaacgggtggagtagacaaatatctcttaaactcttcaaacgcctcttggtgttttgccccccaagtaaaatcgcttcttttttcaagcgaagtataggaacaaaagcatcgattttacccgctaggttagaaataaaccttctcaaataattcactttacctagcaacttttggacctccttcttgcatgtcggcgctttgaaatcatgaatcttttctatcttcttaggatcaatctcaactcctctctcatgcaccatgaatcctaagaacttccccgccgacacaccaaaagcacatttaagtgggttcatcttcaaaccataccggcgcatcctctcaatagctaacctcaaattggctacatgtccttccataccatccgatttaacaacaatatcatcaatgtagatctccaggacaatacctaacaaatcatgaaagatcaaattcattgccctttgatatgttgcaccggcattctttaacccgaaagtcatgacaacccactcaaacaaaccaacaaatcccgggcacctaaaagccgtcttgtacatatcctcttccgccataaagatttgattgtagccggtattgccatctaaaaaactaatcaccttatgacccgaggcatcattaatcatcatgtcggctataggcataggatattcatctttgggagtagctttatttaaatctctaaaatctatgcaaactctaatcttatcactccccttcttttccaccgggactatgctagatacccactctgcataacgacatggcctaataaacctcgccttcaacaaccgatcaatctcctctttgactcagtcatatagcaaaggattaaaatgacgaggtggttgcttataaggcctaaaacctggtttaattggaagccgatgctcaacaagctcacggctaagacccggcatctcatggtactcccatgcaaagcaatcaacatattctttaagtagctcgattatcttaaccttataatcagctctcatatttttgtttacaaaagtcggccttggcttagttccatcacctatgtctacttcttccaaaggatcggccgatgtaaacccttttctaagcttctctacttcatcaaaatcctcaacggtttcgccaatatcgttctttgtagaccgatattcttacaccctcctttgtaaccactctaaattagcctctttactcattatacaaatttatatggcttagccgtgctacactagccggctttatagagataggtacaaatttgccatcggagatactaataaaatcctaactagaaagatccctccccgataagcattggatattcctatgatgccactcaaaagtagcatcagccattgcaacctcggccgatgtatccgcttgaacaatctcaacatcatcgccgtcccattgaattaaacattgatgcaaggtagaaggtacacaacaattggcatggatccaacaacgacccaaaataacattgtagttaccttgcacatcgacgatgaagaaagcggttggtagcgtcttatttcccacggtgagctccgccgaaaagataccccttgcctccgttggttcaccattcaagccattgagaatcatgttggtcttcttcaactcatcatcctcacgcctcaacttcttgaataatgagtatggcatcaaattcacggcagcacctccatctactagcatcctagagaccggcttcccatcaacatggcctttgagataaagaggcttcatgtgacggtttgactcatcgggcttctcaaaaaccgcatctttaggaccgaatgagaattaaaaaagccacctcagcttcatccatagcacaaaacttcataggcaacatacacaccatgttgatatccatgtcttcttttggagatgattcacctttgtcaaccgattgttcttccttctcatttatatcaaccggtttttccttctctatggacttaggcctccataccggtggtggtcgcaactcgttaaaccttttatctctttgctcttcggcctttttctctcttatttcttgggcccgaagacgttgcaaccttctcttttgtgtagccgtcaaatccttaggcatccacctaggattcggctctattccaggaggtaaataatgccctttattaactttgcttgaagacgatgaagccctcacatcgccctttgcagccctctcatcaaaccgaagctggagcccggctagaccggccgtagaccaccggtcagaccggccagacgcgctggtcagaccaacatgtggcgagcggtcaaaccggcctgaggcatcggccgaaccgctgtcgggtcggcggtcagaccggcctgatggcccggtcagaccagccgtatggctgcggtcagaccggccgactgcgaagaactggtaccggcttcggatttcttgtttggggacactccaactccatctccagaaggtattggcacatcatgagaccccactttgatagtaatcacctccgaagtcctctcctccaccttgacgcgctttccttcccacttttcttcattagcccgattcttaccataaaatcggctattgtttggtgaagacaaacgctcatgaattggcctccgtggtcctcccctcccttggttgaattgcataggaggcatatgattgaacattggcggcgtcggcccccatggcatgaagcaaggataaggataacccgacggcggcattggataggaaccccatgacatatcttgtggataatgatacgaaggtgaacgcgaccgtcttggtgaatgaccaaatcgctccttaggaggtgatcttggtcttttccctttgttgcgaattttctcaccaccttgcttttcatatttctccaaaagcatattaaaagtcaccttggtcttcctaggggctttagaagttgaagctccactcctattctctttccaaacgccaacctccggcttctttagcactatcatcttggaccttggttcaccaatgaccacttccttccccttagtagattcggcttgctccggccgaatcaacaccttcttatcattgaaattaattgtattcaccggaaaatgatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataataaaaaatcttatcacacttggccacatcaaaactatatttaacctcactttgccgatctttgcgaggagtcgggattaggttagaacaaacaaaagttttatttttgttagtccatgaccattcggcaacataaatatcatgatcaccctcttcctcactatcattagcttaagggtaatcaaccacattaacattaggctttttatcaaatggtctagcaagttttctattatccttaacccggctttcttgagccagagccctttgcatgagttgactaacatcaagaaattgttggccatctagtctttctctaagaggagcaactaaaccattaaaagcaagaccagccaaatctctatcagttatattcaaagtataacatcggtttctaacatctctaaatctcttaatataatcaatgacagattcattatacttttgcataaccgatgtcaaatcacataacctaagctcagtttctctagtatagaaataatcatgaaattgttcttctaattgagcccaagtatgaatagaatttgctggtaaagaagtaaaccatgtgaaagcattaccggataaagataaagaaaacaagcgcaatttaaaagtatcactattagcctcaccacattgcgccaaaaattgacctacatgctcccatgtggtcttaccatcctcaccactatacttggcaaatttgggaactctataatttcgaggaaacagcacattatcataataatcaggatatgactttttgtaagttctagcacgatttctagtttcaatcccgaatctattcctcataatatcactaatcatatcctccatgttattaggcccttgttgatttggcggtgggtttggtggcctaataggttgtgtttgtggcgcaatatgattatattggccttgtcttgtatcgggaggatatcccctagaaacatcattataagcattaggaatatgtgtcacgtcccaaaacgaccctaaaatatatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttaaaatgattttataaaaagaaaaaccctaatgggccgaattcggcccatctccctccccctctctctcctctccccgcggcccactcggcctctcccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctacggccactctctccctcttccaaccctatttaaaccctccccgcacctccttcgtccgtttctgcctctcggcgcccttcctcctcgccggatttgagctcgcgacgttgctctctctctccgccgtcgccgccgagctccggtccgtctcccacctcggcgccgccctccttcggggttcaccgcatcctcgccaacctcgtccacctctccgtttcggtcgccaaccaccggagcgccgccgtagccgtcgacccgagccgcgccaccgcctccctccgctccggctgcctcctccgtcgccgccgtcgacctggggtgagccgtggaccgtcgcctcctttcccccttccctcccctctctcggccgccgctccaccgcgccggtggtcagcggcggcgaccatcggggcgcgggcgcgccgcctcccgctgaccgcgccagcgtggtcgccctcgggcgcgccgagtggttgccgcgtggggcccggccgtcagccgctcgtgccctcgggtgtggctgacgtgtggggcccacggcgccggccggtgtgagcccgggtgcaaccggtccaccgtggaccgtgaggctgccgcgtgggccccacccccgtggacccggtccgcgcgccccctccccctcggctgacgcaataaaccccttttttaaattaaaatttaaatgaagaaattcgcaaatattcatttaaagagcatataaacttcaaatggccataacttggccatttgaactcggaattggaccgttcaagtctcttttttttcgttaagaagtcaagaacccattttggtgctttgttcctgcttgttatatggagtttattagagtaaaagcccttttattttctgttggtcgtgtagacgttgcagcttcggaagatccgctcttcgtggaggttgaagccgacatttgggaaagtgagcaaggcaagtcacatcatccttgaacatattgaatcccagtttataaaattattttgatttaaattattgcattatcgctttatttaaattcccgcgttatcactgttttaaattattgcactttgcggataaatgcccaaagccgaggcgccagcaaggccaagcgcctccccgccccaacaacagtggtaaggatgtcattcggggtcatgtgaaccacgtgactgccgaggatgtgctgacaactccagacgtcatcgtgggtacgttcctcattcattccatccctggtaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaattccttttccttcggatctgattcttctagacaccaagaacttgcatgtgatccttgggatgaattggttggctcaattccaaggagtagtggattgcgcaagacgcactgtcactctgtaccgagggccggaacaaccggttgttttctttgcacccccaacctctgtcggtagtttagaacttcatcagataggactgtcagaaatccccatagtcagtgagttcggagatgtgtttccggaagaactacccggtatgctgcccaagcgagagattgagttccggatagatcttgctgtaggaaccactcctctgtacaaccgaccctaccgtatggtagcaaatgaactggccgaagtcaagaaactgttggaagagttaaaagaaaaggggtacatacggccgagcacttccccctggggtgctcctgtgatttttgtggagaagaaagacaagacaaagaggatgtgcgttgattacagagctctcaatgaagttactatcaaaaacaagtaccctcttccccggattgatgatctgttcgatcagcttaaaggtgccacggtattctccaagattgatcttctctccggatatcaccaattgcgtatccgtgaagaagatatcccgaagaccgcattcaccacgtgttatggactgtatgaattcacggtgatgtcgttcgggctgaccaatgctcctgccttcttcatgaacttaatgaacaaagtgttcgtggaatacttggataagtttgttgttgtcttcatcgacgacatcctggtatactcacaatcagaggaagaccatcaacagcatctctgtctggtgttgggaaagttgcgggaacatcaattgtatgccaagctcagcaagtgtgagttctggttatccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttcaagaaagaagaaaaatttgtgtggagcccgcaatgcgagaaggcgttccaaactctcaaggaaaatctggtttcctcgccagttttaatcttaccggatactcgcaaggacttcatggtgtactgtgacgcttcgcgccaaggattggggtgcgtgctcatgcaggaaggtcatgtggtagcctatgcctcacgccagctacggcctcatgaaggcaactaccctacccatgatttggagttggccgctgtggttcatgctctaaaaatctggcggcattatctcattgggaatcgctacgaaatatataccgatcataagagtttgaaatacatcttcacccagtcggatctgaatctttggcagagaagatggttagagctcatcaaggattatgatgtggggatccactatcaccctggtaaggccaacgtggtcgcagacgcgctgagtcgaaaaagccgttgcaacactcttagcgtccgtggcattccaccggaacttcatcaacagatggaagccctgaacctaagcatagttggtcgtggattcttggctacgctggaagccaagcccaccttgctcgatcaaatctgcgaggctcaaaagaatgatccagatatgcatgggatcctcaagaatatgaaacaaggtaaagccgctggtttcacagaagatgaacatggaaccctatggaacggaaatggtgtatgcgttccggacgacaaggaacttaaacagctgatacttcaggaagctcacgaaagtccttattccatccaccctggcagtacgaagatgtacttagacttaaaagggaaatactggtgggttagtatgaagcgggaaattgcagagttcgtggccctttgtgatgtgtgccagcgtgtcaaggcagagcatcaacggccggccggacttctccaacctctacaagtaccagaatggaaatgggatgaaattgggatggatttcatcatcggacttccaaaaacccaaggcggttatgactctatatgggtagtcgtggaccgactaaccaaggtagctcggttcattcccgtgaagaccacctatggagggaacaaactagctgaactctacttcgctaggatcgtaagtctccatggcgttcctaagaaaagtatatctgatcggggacgccagttcacctctcatttctggaagaagctccaagaagagttgggtacccgcttaaatttcagcaccgcgtatcacccgcagacaaatggacagaccgagcgtctaaattagatcctagaagatatgcttcacacatgtgtcctagattttgggaagacatgggataagagtctcccttacgccgagttctcctgcaataacagcgaccaagccgacatacagatggcaccgtacgaagcattgtatggccgcaaatgccg

SEQ ID NO: 35174 - DNA, 15368 bp, Oryza sativa
gcgtggggcccgtccgtcatccgccagtgccctcgggtgcggctgacgcgtggggcccatggcgcgggccggtgcgagcccgggtgcgcccgatccaccgtggaccgtgaggctgccgcgtgggccccacgcccgtggacccggtccgcgcgtcccctcccctcggctgacgaaataaaccctttttaaattaaaatttaaatgaagaaattcgcaaatattcatttaaagagcatataaacttcaaatggccataacttggccatttgaactcggaattggaccgttcaagtctcttttttttccttaagaagtcaagaacccatttttgtgcttttttcctgcttgttatatggagtttattagagtaaaagcccttttattttccgttggtcgtgtagacgttgcagctttggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctattcacttttgttatgaccttattattgttattgttattatttccttgttcaccctagaataaacaaaaccccaactagtggacactctacttatggtaacactagtatgattttaggtagatgcttcactggttaattcggcaacattaggtggttttacaactctagactttgggaatactcttatcacctggacactatggaatggttggattattgtggaattggatttacacctccctctctattcaaaaccctcaaaatggttttaggctgggcttggggtgcatggttttgatagtagcacctcggccatataaggaccggtcttcaggcctctgttgcaaagcactatcgtagttccacatgtctagtgggtaaggcttagtttgtggctcagtctggttataaacaaaagtacacggatggagatggacgaagtcgggggtcaatggacatctctagggcaaatgaaggctacacgagctgcggcccggtagtcgagatgtcatggcacagggccggtgtcctgctgctaggggctcagtcctgcctaccctgtcccggggttcccgccgtaggtggggttgggtccgtactcttgtttatggctaggatgggttggaaactatgtcctgtcttccgtctgtataccgtggtggtatgtggcacgtggttacacgtgaagaagatgtgtcttgtgggtaaagatgtacacctcttatcagagtataacctatttgaatagccgcgccctcggttatgggcaagctgagcaatgtacccaagttagtgttttaattcttaaaacctgcctaacagctaaaatgtggaatggttagcctgggttggcttgggacgagctaggacccaaggtcgggttgccagttcggtctgaatcatcgtaggccttgggttaaggcaggttcgtgtgggtttacggccttggttaataatattgtatagctctaggaccgtgtttacaaagtgacttttaatgctgtttactgcaaaccctaaccccctatattatggctcccttgtactcccttgcatttattctgcacttgtgggtgtatcttgttaagtacggtggttgtactcagtcttgctcaatttttcccaaacccagaagaggagcccctggatgatgaaggctttggtgtctagctcgtgcctgccgtcaagcgcctgtggtcgtcgccctagtcttctgctgtttttcgtttgtcttcttgtgtgctgggtcttcgccgcccatgtaataaattaattaattacgcttcagcttgttaaactctgaattgtatcaacttttggtgtaccttgcctcctgggacaaggaataatgcacgcacataaggaacgcccgttgggttatttccggtcgtgacactgctggtcatacaaccccatcggctgaggaattaggcaaacagaggtattgcaaatggcataattctaggtcccattctactaacgattgcaaggtttttagacagcagattcaggtggtcattgagggaggcaagattaggtttgatgattccaaaaagccgatgaaggtcgatggtaacccttttcctgttaatatggtgcatacagctggccaagcagccgatagggcccatgcaaggggttttcaggtgaattcggctaagattttcaagaaatatcggaagaagtatgacaagcagcaggagaagcatcatgagaaatacgatgatggttttgatcctcattggggttgtgagttctttagattctgctggaatgaaggtatgaggttgtcatctattgaaaactgccctgggtgcagtgatatcatcgagaactccggccgatcatataataggagcaatcggctaaggcagatgagagtttctgttcatcaaagattgggtccaattaatcaagatcatggccactaagcatatcgacaaggacaatgtgattaggaagaatcaatggtgtccttctggtattttcacgaagaatcagaagagaagggttcaaagattgaggaacagggagcgcctttagggggttgaacaagaaattaatcatcggctaaagaaagcaaagccaaggcaggagtggcgtgttaagaatcaagttcctgtagctgatgatgttgcagccgatgaggcaaagaggttggcaaaagggaagagtgttgtgacggcaccggttaacatggtctttaccctgccagccaaattcgggatcgatcaagctgatgtcgatgaggtggaagaggaatcggctaagttggttctgtcaccagaacaggcagtgttcgagaaacccgaggggacagagaatcggcatcttaaaccattgtatataaatggctacgtcaatgggaagccgatgtctaaaatgatggttaatggtggggccacggtaaatttgatgccctatgctacattcaggaagttgggtagaaatgccgaggatctcatcaagacaaacatggtgctcaaagattttggtggcaatctatccaaaaccaaaggtgttctaaatgtggagctgacagtcggcagtaagactattcctgccatattttttgtcatcgatgggaaaggttcttacagcttgttgcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggatggccttgattgtatatctggaaaagtctgggatggggattttctaaaagtgtccgattctgatatacagccaattgaagatggagaacccaagctattattttgagggcatcgtggagggttcaaatctctacactaagaacacggtagatgatctcgataacaagcaagatcaaggtttcatgtcggccgatgatttggaagaagtagacataggtccaggcgatcggctaaggccgacatttattagtaagaacttatctccagtgtttagaaccaagctgatagagctcttaaaagagtttagagattgcttcgcttgggaatattatgagatgcctggattcagccgatcgattgttgaacatcggctacctatcaaaccaagggtcaggccacatcaacaacctccgaggagatgcaaggccgacatgcttgaaccggtcaaggctaagattaaaagattatatgatgctggttttattcgtccttgccgatatgctgagtgggtttctagtatagttcctgttatcaagaaaaacggcaaggtcagggtatgcattgatttccgaaatttgaataaggccaccccgaaagatgaatacccaatgccaatagccgatcaactagtggatgctgcttcgggacataagattttgagttttatgtacggaaacgcaggatacaatcaaatttttatagccgaagaagacattcataagacagcttttaggtgtcctggtgcaatcggcttatttgaatgggttgtcatgacttacggcttgaagagtgctggagctacatatcaaagagccatgaattacatatatcatgatctaatcggctggttggttgaagtctacattaatgatgtggttgttaagtctaaagaaatagaggaccatatagctaatttgaggaaggttttcgagagaaccagaaaatatggcctgaagatgaatttgacaaaatgtgcttttggtgtatcgactggccagtttctgggatttcttgttcatgagagggggatcgaggtaactcaaaggagtgttaatgcgattaagaagattcagcctccagagaataagacagaattacaagagatgatcggcaagataaattttgttagaaggtttatttctaatttgtctagaaggttagaaccttttacaccattgttgagattgaaagccgatcagcagtttacttggggggcagagcagcaaaaggctttggataatattaaggaatatcttagctctcctcctgttttgattcctccacagaaaggaataccgtttaggttgaatttatcggccggtgagaagtcaatcggctcagtctttgattcaggcgttggaagggaaggaacgcgttgtattctatctcagtcgtcggctcttagatgctgaaactagatattcccctgtggagaagttatgcgtgtgtttgtatttttcgtgtccaaggttgaggcattatctactgtccaacgagtgtagtgttatatgcaaggccgacgttgtcaagtacatgctatcggctcaaaaattaaaaggaagggttggaaagtggatattttccttaaccgagtttgatcttctgtatgagtcgccgaaggcgattaaggacaagcaatagctgattttattgtggaacatcgtgatgacttagtcggctcggttgaaatagtgccatggactttattgtttgatggatcggtgtgtactcatggttgtggtatgtcacgtcctaataaattcatccccaaataaaaatcattttctaaaaggaataatataattaattaaaattcgaaaagaaattggcaaacactaaaatacgtacaagaaaaattcgaatgtggcctagagaattttcgttaaattctccttggtctaaaatgagccctcaaattttacttgaattttcagagcaccgaaaatatttcttaagcaacaacaacaattaacaaagtttactaaaaagaaaaactaaaaataaatccccctcctccctttgggccaagtctggcccaaagcctccctccctctctcttgggccgcccttcccctccccccctcggcccagctccctcctcctccctctctctcccaggccgccactccctcctctcctcctgggccggccgcctggcccaagcaatgcccctgcccgagccgcagcgccctcctgccctagccgcgtgcgcacgagcgccgcacgcgcgctgaccgcgcgccttgccgcgtgggtcccacctcggtcgtctccttcctcccgcacggcctcttctctctcccgtgcaaacctagagacgttcctcctccaaatccgccccattcaagccggctcattccaaattaattagggggaattaatcccctttccttcctcttcaattccccccaatttcccccttgattcgagcccccaatcgtcgggaacgcccgcgccaaccccggccaccttccatggccgccggccatgaattccgccgccgttccccgcctctcccgtggccggctccctctcctcccctataaaacggaatctcctcgctccgttctatcgtcttagccccctcccgcgctctcccgtggcctctccacctttccccgccttctccttctctcgctccggcgccaaccggcctccagccgcctctccctcctcgcccgagcaccgtccggtcgcgccgtcgccgcgttcggcctcgcagccgcctcctctcccccggtcagacctccgtttcacggggaaaccaccggaggcgtgtccccgccggcaaccggtggcattgccgccacccactgcctctagccgcccctgccgtgccgctcaggtgtgggtcggccgcgccgtctcctccctcagcgtcgccgcgtcgacctccaccccggcctaccctctgattcgtccggagaccgccgtcgcccgcgccggcctctccttcctccttgtcgacgtcgccttcggcagcctcttccgctgtgcccgtgcgccggccgacgtcgccatctccacctccggcatcacagcgtcaaggttgccctcggcctcgcctcccctccatccgaaccccgccggtgttcgttatcgtcgtctccgttcgtcctcgtcgacgactcctccggtcggtcgttcgtcctcgccggctcgtcgtctcgctgcgccgccaccatcgtcgtcatcgcagcggcgtgttccgcgccatcctcgtctccatgaagctgccgccggctgccctcgttgcctcctcgccggtcccggtcgtcatcctcatcgtcgtggcgttcgtccctccgtcaagccgttcgcgttcatcgtccgcattctgtcaagtgagccgctgcagccccgtcgtcgtcttcgtcctcggctccgcgtcgtcaagcgttgggccggccgcgtctcgccttcgtccaaggatcgccgccgaagtcgtcccctcgcctttcgtctccgtcgttcccggccgtctccgccgcgcccgttcgttgttgtcgttccctcgcctcgtcgggtggtggtaagaatctcttctctcgctgccccgtcctcgtcctttcggtgtcgccccgtacccgttgtgtggttgtcgaccccggtacccgtgtaccggtgtcggtagtcgttcgcttgtgcgtgtggtgaccgtgtttgtgtgcgcgctcggtagccgcgtggtttgctcgtgtgcagccctcgtggtgtctagtggagtccgtttgtcggccactcgcctcagttgacacacggggtccgcttccgtcgacccgtggaccgtctctgtgtactcggtctaccgtggtcctttaggttgacatgtggggtccgcatgtcaacggcgcagccttcctgtcttttccaggctagcgcttgctcatgttttatagttgtaaaacataattacaataatccgcaaatcaccatataacagcattaaatttcggataaccatgtcttggtcatacaagctccgaatcgacccgttcaagtctcttaacgtttgttataacctaaagaaccctgtgctttctttttatgtattgttattgcttctttataggtttgtagctttgcttgtgtgcttcgcgtagcttctgtcgttcctgaggttcccgaagcgtggttcgcggtcgtcgccgaaggttcggaaggccgttgtctctgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattattaccttgttcaccctagattaaaccaaaccccaactagtggacactctactcatggtaccactagtatgattttaggtagatgcttcgctggttaattaggcaacattaggtggttttacaactctagactttgggaatattctcatcacctggacactatggaattgttggatcattgtggaattggattcacaccttctctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactattgtctatggctaggataggttggaaactatgtcacgtcttccgtccatataccgtggtggtatgtggcatgtggttacacgtgaggaagatgtgtcttgtgggtaaagttgtacacctctgatcagagtataatctatccgaatagccgtgccctcggttatgggcaagctgagcaatgtacccaagttattgtttttaattcttaaaacctgcttaacaactaaaatgtggaatggttagcctgggttggattgggatgagctgggacccagggtcgggttgccagttcggtctgaatcctcataggccttgggttaaggcaggttcgtgtgggtttacggtcttgattaataatattgtatagctctaggaccgtgtttacaaaatagctttgagcaactaagtgtcttttagtgctatttactgcaaaccctaaccccctatattatggctcccttgtactctcttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttttcgttcgtcttcttgtgtgctgggccttcgccgcccatgtaataaattaactatttacgcttccgcttgttaaactctgaattgtatcaacttttggtgtaccttgcctcctgggacaaggaataatgcacgcacgtaaggaacgcccgttgggttatttctggtcgtgacaagttggtatcagagcccccttgaccctagaacgagccttagatcccaagccttagcaatattttcgaaataaaaatccttttttatttgtgaaaatcctctagtctctctctgtcctgctacttcatttatcaccataatctaatctttaaaatgttgcttttctcttttgttttttgtttgtagatggccggcagcatcaaccgtcgtggtctggacctgactggcttcgttttggagctgcggggcatgtgcgttgtcttggggtatctgcatggagtggactaccagggcaagcagctcccggaataggagggtgacgatgcagagccccacgctgcttgggaggtcactgcagtgattctcactggctcacccgagaggacttcgttggcagtcaccgcgggtggagattctttctccgccgcttgccagaacgccgctctcctcaccatcggcactcttcaccagcgctacccggacgagttgcagcactcgccctaccactaccgccctcgtcgcggaggagcccgtgactacgccaccttcagggatgctagctcggaggatgacgctaccatcatgcacctggcgcgcatggtggaggcgtacgacgcggctcgtatcgacttccatcagatggtgcgtcgtgggttggtcgagaacaacatgaagatcctggagctacgacaggagaatctgcagctgaagaaggacctagacgcagtggaggcgcagctgtgtcagctcaagatcgcccagggagaggtctgtcgccccaagcgccgtcgcgtctgccgcagcctgaagatcactgcccgcaagagtacctctaggcccgagctggttcgtcagtccctggcgtggacctgcttcgtcgagacccctcgtgccgggcccgcgcccttggttcctcaggaggagggagcctctagcgttggtagcacggaggatgtgttgttgctcaccttccgccctggcccgtcacagaagtagacgagcagttagtaggcttgcgcgtatgttcttctcgttggtttttctgcttgagtcgtgtggggcatggttataccggtgtgtggtataactgtgtcggagcctgtctttattttatttgcttaagcaacctgaaccttagtgaaccaacttaatagcagtaataaattcaagaattatggtagtcgtgggtgattagttttaatagtcagctctctctgtttgccgggtctgtgtgggattttcagatggtgacaaccaggagaagtgctactaccggtgatggcaaccaacccgaaggtagcaaccacaacaaccatggcagcccacctccacctcctcccccgcctccaccaccaccaccagacaccaactccattctcacccaaatcttcgcccagcaggccaacatgatggctgccttcctccatcacatccaaaatccgtcacaacataatgctccacctccaccaccacccccgcaacattctaaactcgcagagttcctccgcatccgtccacctaccttctctagctccaataaccccgtggatgctttggattggttgcatgccgtggggaaaaagttagacaccgtgcagtgcaacgatgaggagaaagtcatctttgccgctcaccaactgcaggggcccgcatctctatggtgggaccactttcaggctacgcagctagaggggcagcctattacttgggcccgcttcaccgccgctttccagaggacccatgtgcccgccgaagtcatggcccttcagaaaagggaattccgagagttgaagcaaggcaactgctctgtgatagagtatttgcatgagtttaacaacctggcccggtacgccccggaggatgttcgtgaagatgaggaaaagcaggagaagttcttagcaggaatggaccctgagctgtccgtgcgtctagtctccggggactatccgaatttccagcgtttggtggacaagagcatccgcttggaagccaaacacaaggaactggagtcgcagaagcgtcgcctggcgaatttccgcaaccaacagggggctaaccaaaggatccgctacaccaatccctatccagggggatcctcctcgcagcagcagcaacagcagcagcaacctcgctccgcgccccaacctcaattcgtggtgcgcgtcccacagccgcagcagcagcagagtcagcaagggacccatgcaccccgttctcctacgtcagccgtgcagcctggacaaggccgcagaaacgttcaaggtcagcagcgtctgtgcttcaactgcttcgagcccgggcactttgcggataaatacccaaagccgaggcgccagcaaggccaagcgcctccccgccccaacaacggtggtaaggatgtcattcggggtcgggtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaattccttttccctcggatctgattcttctagacaccaagaacttggatgtgatccttgggatgaattgattggctcaattccaaggagtaatggattgtgcaagacgcactgtcactctgtaccgagggccggaacaaccggttgttttctttgcacccccaacctctgtcggcagttccgaacttcatcagataggactgtcaaaaatcccgatcgtcagtgagttcggagatgtgtttccggaagaactacccggtatgccgcccaagcgagagattaagttccggatagatcttgctccaggaaccactcctctgtacaagcgaccctaccgtatggcagcaaatgaactggccgaagtcaagaaactgttggaagagttaaaagaaaaggggtacatacggccgagcacttccccctagggtgctcccgtgatttttgtggaaaagaaggacaagacaaagaggatgtgtgttgactacagagctctcaatgaagttactatcaaaaacaagtaccctcttccccggatcgatgatctgttcgatcagcttaaaggtgccactgtcttttcaaaaatcgatcttcgctccggatatcaccaattgcttattcgtgaagaagatatcccgaaggccgcgttcaccacgcgatatgggctgtatgaattcacggtgatgtcgttcggtctgactaatgctcctgccttcttcatgaatttagtgaacaaagtgttcatggaatacttggataagtttgttgtggtcttcatcgacgacatcctggtgtactcgcaatcagagatctccgtttggtgttgggaaagttgcgggaacatcaattgtatgccaagcttagcaagtgtgagttctggttgtccgaagtcaaattcttagggcacgtgatatctgctaaaggagttgctgtggaccccaaaacagtgaccgccgtcactgattggaagcgacccaagacagtcactcaagtccgcagctttttgggtttggccgggtactaccgaagattcatcgagaacttctccaaaatcgctcgacccatgacatagttgctgaagaaagaagaaaaatttgtgtggagcccacaatgcgagaaagcgttccaaactctcaaagaaaagctggtttcctcgccagtgttgatcttaccggatactcgtaaggacttcctggtgtactgtgacgcttcgcgccaaggattggggtgcgtattaatgcaggaaggtcatgtggtagcctatgccacacgccagcttcggcctcatgaaggcaactaccctacccatgatttggagttagccgctgtggttcatgctctaaagatctggcggcactatctcattgggaattgctgtgaaatatgtactgatcataagagtttgaaatacatcttcactcagtcggatctgaatcttcggcagagaagatggttagaactcatcaaggattatgatgtgggaatccactatcatcctggtaaggccaacgtggtcgccgacgctctaagtcgaaaaagccattgcaacactcttggcgtccgtggcattccaccggaacttaatcaacagatggatgccctgaacctaagcatagttggtcgtggattcttggctacgctggaagccaagcctaccttgctcgatcgaatccgtgaggctcagaagaatgatccagatatgcatgggatcctcaaaaatatgaaacaatgtaaagccgctggtttcatagaagatgaacatggaaccctatggaacggaaatcgtgtatgcgttccggacgacaaggaacttaaacacctgatacttcaggaagctcacgaaagtccttattccatccaccctagcagtacgaagatgtacttagacttgaaagggaaatactggtgggttagtatgaagcgggaaattgcagagttcatggccctttgtgatgtgtgccagtgtgtcaaggcagagcaccagcgaccggccggacttctccaacctctccaagtaccagaatggaaatgggatgaaattgggatggatttcatcaccggacttccaaaaacccaaggaggatatgattctatatgggttgttgtggaccgactaaccaaggtagctcggtttattcctgtgaagaccacctatggagggaacaaactagccgaactctacttcgctaggatcgtgagtctccatggcgttcctaagaaaattgtatctgatcggggaaaccagttcacctctcacttttggaagaaactccaagaagagttgggtacccgattaaatttcagcaccgcgtatcacccgcagacagatggacagaccgagcgtctaaataagatcctagaagatatgctccgtgcttgtgttctagatttcgggaagacctgggataagagtctcccctatgccgagttctcctacaataacagctaccaagccagcatacaaatggcaccctatgaagcgttgtatggacgcaaatgctggacaccactattgtgggaccaagttggggaaagccaagtgttcgggactgataacttgagagaagctgaagcgaaagtcagaaccattcgggagaatctaaagttggcccagtctcggtagaagagttatgcagacaaccgacgccgtgacctggaattcgcagtggatgactttgtctatcttcgggtcacgccgttgcgaggcgtacgtcggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgtcttcgagtgccatccgagcaggccgactcagagcaaattgaagttcgcgaagacttgacctacgtggagagaccagtgaaaatcttggacaccatggagcgcaggaccaagaaccgggtaatccgtttttgcaaggtccaatggagcaaccacgccaaggaagaagctacttgggaacgtgaagacgagctaaagtcagcccatcccgatctcttcgccagttcttccgaatctcggggtcgagattccgtttaacgggggtaggtttgtcacgtcccaaaacgtgtaaataaatttcctaaaagtcaattaaggcttagaggatttttgtatatttcctaaaagcctaaaatgtgtaaataaattttagtggaattctcagagcacaaataataattattaagaaataaacaaagttaaaatgattttataaaaagaaaaaccctaatgggccgaattcggcccatctccctccccctctctctcctctccccgcggcccactcggcctctccctgcgcgcgcgccgctgacgggcaggcccgcccgccaccctcgctgacgggtggggcccacccgtcatcccctttcttccaccgattccgccggcttccccgcaccctagcgccgccggcgccgagaattccggccgcttccgccgttcccgcgtgcaataaagtggggggaatcactccccgtgatcccctttccattccacccaattttgcatccctctctcccttggattcggttggaaaccctcccctaatcccgccgcgccattgatggagcccgagagcgccacgccgg

SEQ ID NO: 35175 - DNA, 20052 bp, Oryza sativa
  unsure (1)..(20052): unsure at all n locations
agctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacataaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcgaaatatatattaataatgagactatatacgttcatagcataaccgatcagatagatctagcatgtatcggctaatactccgataccactctatattaagatattaaagcgagtagaatatactaaacaaaagcctaatatacttaaatgcagcaagatcttaacgtaaagggcagatttaacatgtcaatcaaacatataggataaaaagtagttaaatcaggtaagatcagctgaaactccgatactaccctaatcagcaaccaagaagcgggctagagattgagattctaatcacgactcataagatcatacttaactgatgcagctataagtatgaaaagaagaacaatgtctagacaatcaagccattggatgtgtcatagagtggtagatatcctatataatctaagtcaacatcggtatttaacctaatcggctgccttctattgacggatgttagccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcaggttgcattgtcaaaatcggctgcatcggcttacctagcccgactcagacccagccgatcctaatcgtagccgatctggactccagccgattcctgctctatttctgaactcgatctccgcctccaactatgcttcgatctaatcttctttcccaatgccgatattacaaaatttcgttgttaacacatgccccccaagtccggaatatttgataatgtttcggatttgctgtaaatcgactctgagcaagtttcgcactttgatgttttccgaccgttactgccgtgctttaaatactaaccattaccctcgagaaatctcacaccgtcctcctccattttcaccgctgaaaccaactttgccctctttctctccagcgatctcaccgacgcacaaggcgatccctaggcaatttcgttcccgaccagatctccgcccgcggcgatgtcgtcttccaccagcccttctactgcaccatcggccgagtacgctgaggtaagtcctcaccagctagatcccttttcctcgcatgaaatcgatttctccttttctcctcatgttttccgcttcccgattcctttggatttgcagcacctttccaacctagtcgcgattcccagcctttcacacaaaaaccactattttcttggcccaatcggcaatctcaaccccactgatttcatcatcggtgaaaccaatcggatcccctttagactagccaaccctaacctgggttactggaagaatacattcaagtcttggccatctctcgaaaaacctactcctgataagagctagaccacctggtaccaacgcgtatcggctagtaagaaagttcactgggatgaaattggaatcggccaagcactcgctttcaccatagccaattctgctaaggatgaacctctgatggctgccgccacctacttctggtccaacgccatcaatgctttcttattcaaccaagggccgatgactccaactttaatcgacatcaccatgattactggattagatgtaacttcatcggctaaacctatgagtatgaacaccaagaaccaatttgacttgaagaccaaaagcataggtggctggtctggctatgtggcggcatatatgggccaagggtctgttacccctcgagagcatgtagctttcttgctgatgtggctggaaaagttcctcttttgtggatccagttgtggccctacaaccaactagcactctgtagctgaagccttagaatcaaagaaagaatttcctttgggcaaaaatccttctgggctatgtgtaccagatgttgaacaatgcatctgctaaaatagccgtcggctcaatagttggagcaggtggaccatggtggctgctgcaaacttggttaaacctgatagtcatgaacattgtcaatcgaccctctgtgacagaagctgaattcccattgccagagccgattgtggaagatgacggagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaattctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccaaaattgcctctgcaggctctagctgatctcttctcttttgacatcagagattaccttgatgaggcagaagaagacacttcaagcaaagcccaagctcccctatccgatgatgtgagaaaaacacttgaagacatcgctcatcggctagaagcctcttctttagacagtttggtagttgactgtgggtcaattaggacgcggctgcatgaagttcaagctctgattcccgaagatctggctgatgtcctaactccagccgcttatctcgagcaacatcagttcaagctggaaaaagccaagctaagactagccgaacgccgtgagcacaaagagattgaggccacaatccaagctaatcggcagcttgtgcatgaaaaaaaaaccaaacttgattagctatctgaaggtccaatcaaatccaatattgatcggctcgaagctcgcaagattgagctcttggcgcaacttgaagaatgcaatgccgagctagatatggaacacaaaaagctagccgatcttccaaaatcaattgaagaacaaaaagcaaggctcaaatcggctatcaaaaatgttgctgacctaaccaagtccctgaaagtcatctctggaactgatgctcaagatgcccatgctattgtagaagtagaacaaattaggcaaagggctattttggctatcctatgatacttgtctcaataacttttgtgtaataggacttagaaattttttgtaatcagctaagatgctctagtactttactgtcttgacaatcctttgtgccgattaatatgactttgaaattcgctcaaaaaatttgcctcaaaaaatttgcattgcattttgataatatcggctcagaaattcccctagggggcatgtttcgagtttgcttataccattaaaccgtatgcgactaataatcaagctgagtatgaggcagtgctcaaagggttgcaattactcaaggaagttgaagccgataccattgaaatcatgggggattctttgctagtaatcagtcaattggcaggagagtatgaatgcaagaatgatacattgatggtttataatgagaagtgccaacaactaatgaaggagtttcggctggttactttaaagcatgtctctcgagaacaaaatattgaagctaatgatttggcccaaggggcatcagggtataagctcatgatcaaagatgttaaggttgaaattgcagcaatgacagccgatgattggaggtatgatgtgcatcagtatttgcataatccgtctcaatcggcttctaggaaattgagatataaggcattaaagtatactctgttggatgatgagctttattatcggacgattgatggagtgttacttaagtgtttgactgccgatcaggctaaagttgcagtcagcgaagttcatgaagaaattttggtactcatcaatcggctcataagatgaagtggttacttcggcgtgcagggtatttttggccaagaatgctggaggattgttacagatattatagggggtgtcaagattgtcagaagtttggggcaattcagcgagctccggcatcgactatgaatcctattcttaagccatggccattcagaggttggggaattgatatgatcggtatgataaacccaccatcgagtaaaggacataagtttatattggtggcgactgattgtttcaccaagtgggtggaggcgattcctttgaagaaagttgattctgtggatgcaattcaattcgttcatgaacatataatctactgatttggtattctacaaactattacaactgatcaggggtcaatcttcgtgtctgacgagtttgttcagtttaccgatagcatgggtatcaaattattgaatttttcaccatattatgcacaagctaatgggcaagccgaggtgtctaataaaagtttgatcaaattgattaagcggacaatttctaattatcctcggcaatggcatactcggttggccgaagcgttgtggtcttataggatggcttgtcatggatcgatccaagtccctccttacaaacttctttatgcgcatgaggctgttttgccatgggaggttagaatcggctctcgaagaacggaattacaaaatgatttaacagcttatgagtattacaaccttatggccgatgagagggaggatctggttcagtgacgattgcgagcccttgcaaaggttaccaaggataaggaacgtattgctcggcattttaataagaaagtggtacctaaagatttttcggaaggagaacttatatggaaattgattttgccgattggtactcgtgatagtaaattcggcaagtggtcgccgaattgggaaggactgttccaaatttataaggttgtgtctaagggagcatatatgttgcatgggtttgatggtgaagtttatgggcgagcgctcaatggcaagtatttgaagaaatattacccaagtgtttgggttaacgcatgatcggctagtattgccgatgcatgacagccgatgtgtttgcatcaccttgagatggccgatatggttatatcgcccttagttgtttttcatagtgtaatcggttgtggtttgccgatgtataatttccgatattgttatatcgcccttagttgttttataattttatccatgcttttgtcattgtaaaattaggggggcacatatatatcaaaatgcaatgcaaattttttgaggcaaaattttttagcgaatttcaaagtcatattaatcggcacaaaggaatttcaggacagtaaagtactagagcatcttagctgattacaaaaaatttctgagtcctattacacaaaagttattgagacaagtatcgctggatagccaaaataggcctttgcctaatttgttctacttctacaatagcttgggcatcttgagcatcagttccagagatgactttcagggacttggttaggtcagcaacatttttgatagccgatttgagccttgctttttgttcttcaattgattttgggagatcggctagatttctgtgttccatatctagctcggcattgcattcttcaagttgcgccaagagctcaatcttgcgagcttcgagccgatcaatattggatttgattggacctccagatagctgatcaagtttggttttttcttcatgcacaagctgccaattcgcttggattatggccttaatctctttgcgctcatggcgttcggctagtcttagcttggctttttccagcttgaactgatgttgctcgagataaacggctggagttaggacatcggccagatcttcgggaatcagagcttgaacttcatgcagccgcgtcctaattgacccacagtcaactaccaaactgtctaaagaagaggcttctagccgatgagcgatgtcttcaagtgtttttctcacatcatcggataggggagcttgggctttgcttgaagtgtcttcttctgcctcatcaaggtaatctctgatgtcaaaagagaagagatcggctagagcctgcagaggcaatttcggaaagaataagagctgggtaaattatagctgatctaattgttgagacaaagggaaacttactgggatagcagaagcagctggttgttcttcctcttcgacgtgatgactccccacagccgatggagtctgattacttgacgattgctgtacaggaggagaaggaggaggaggctgcgaaatagacaagtgttatatagaatcggttgagattgattaagtaaaggaattaaggacatcttactggtggagccgatttaacaattgttgctgctggttttttcttcacagtagttttcttcttctgcaaccacaaagtctatgggtaattagccaaagagagaggtacttacttatgtaaaataaacgggggcagaaggagttggaggcgtttgcttgggtaaagccgatagtgttctttctgtgtcactcattttggctacagcttggtcaacatcttcaccaatttcttcttcatctaaagcttgtttaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggaaagttgaagtcttgggggcatggtagccgataaaagggggagatagtccacctccattcagaattaaacctgaagcatattcaatgttcctgcaactattactttgatgaggaggggaggactctgttgtctgcaaaacaggagcaagagattagtcaagtaatgaatcggctaactagttatgcaatttggtaatgacaaagtttacctggggtatgacgtcagggaatagatctgtcatatacattgaagccgattgataaaatagatgcatcttccatttaccccaccatctgtcaaagtttttgcttctaaatcctgccaactcaatattatcaatactgcccagagggggtcctggtaggttaagtagccgatccatcattagagtggatgtgatttgtcctcggcactgaatcttgtcggcaaagaataagccgattgggagttggcccaatccaagtgggtgataaaactcgtaggagacttggatgtttctcccatggtgaatgccgacagagaagatgcatgggctgattgcagctataagaatttctctggatttttggaatttttcatgattaatgtcttcaaatctaaagtctgatggaagttcaaggtctgctgagtcttcataaggaaaccagattcgtgcatctttcttaaaaccttcgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttttgtcacagagggccgattgacaaccttcatgactatcaggtttaaccaagtttgcagcagccaccatggtccacctgctccaactattgagccgacggctattttagccgatgcattgttcatcatctggtacacatagcccagaaggatttttgcccaaaggaaattctttctttgattctaaggctacagctacagattgctagttggttgtagggccacaactggatccacagaagaggaacttttccagccacatgaacaagaaagctacatgctctcgaggggtaacagacccttggcccatatatgccgccacatagccagaccagccacctatgcttttggtcttgaagtccaattggttcttggtgttcatactcatagggttagccgatgaagttacatctaatccagtaatcatggtgatgtcgattaaagttggagtcaatggcctttggttgaataagaaagcattgatggtgttggaccagaagtaggtggcggcagccatcagaggttcatccttagcagaatttgctatggtgagagcgactgcttggccgattccaattttatcccagtgaactttcttactagccgatacgcgtcggtactaggtggtccagctcttatcaggagtaggtttttcgagagatggccaagacttgaatgtattcttccagtgacccaggttagggttggctagtcgaaaggggatccgattggtttcaccgatgatgaaatcagtggggtcgagattgccgaatgggccaagaaaatagtggtttttgtgtgaaaggctaggaatcgcgactaggttggaaaggtgctgcaaatccaaaggaatcgggatgcggaaaacatgagaagaaaaggagaaatcaatttcatgagaggaaaagggatctagctggtgaggacttacctcagcgtacttgcccgatggtgcattagaagggctggtggaagacgacatcgccccgagcggagatctagtcgggaacgaaatcgcctagggatcgccttgtgcattggggagatcgccggagcgaaagagggcaaagttggtttcagcggtgaaaacggagaaggacggtgtgagatttctcgagggtaatggttagtatttaaagcacggcagtaatggtcggaaaacggcaaagtgcgaaacttgctcagagtcgatttacagcaaatccgaaaaattatcaaatattccggacttggggggcatgtgttaacaaccaaatttggtaatatcggcattgggaaagaagattagatcgaaacaaagtcggaggcggagatcgagttcagaaacagaacaggaatcggctggagtccagatcggctgggtctgagtcgagctaggtaagccaatgcagccgattccgacaatgcatactgatgtatgatatcgggttgaattaaggcgctttaaggtgattgccgcacatggatagagcctgagaaggcaattgtatctattaattaggatgatttatgtaatctccttggagatatgcttgggcaaaagtctgccgcaaagacttatggtatcttagagtttgttagagatagtagttgtatccgttatggacatatcttgtgattttcgggtataaatagacccgaaccctatgtaacttttaacatacacgttcaatacaatctcggcgcatcgccacctttttgctttagttttatttcgacgagttcttgctttctggttgagctgcatcggtttcgatcttcaacaagaggtaaaacttgttatggcggcttgagttctcaggattagtgcttccatctttatgacactctaatcttgtttatgtaattcgtcgagttatcatatatcctacataatccttggcaatatcgatatctaacctacaatcggctaacatccgtcaatagaaggcagccgattaggttaaatactgatgttgacttagattatataggatatctaccactctatgacacatccaacggcttgattgtctagacattgttcttcttttcatacttatagctgcatcagttaagtttgatcttatgagtcgtgattagaatctcaatctctagcccgctccttggttgctgattagggtagtatcggagtttcagccgatcttacctgatttaactactttttatcctatatgcttgattgacatgttaaatctgccctttacgttaagatcttgctgcattttagtatattaggcttttgtttagtatattctacttgctttcatatcttaatatagagtggtatcggagtattagccgatacatgctagatctatctgatcggttatgctatgaacgtatatagactcattattaatatatatttcgatctaagtgatttatattgtctcggcatggcgatcgatctatcccaatcacttgatttaagtatatatcaaaataatgattatatattgttaatatctacagccaatcgagtagatttagtcccttcttatttattaatgactaccgatcgatgcatatatgacatcggctcaaagataaatgatatatcatcggcacctagccaatcggctacatttatagatttaactgcggtttctttgcttctatttcttgttgattacaggatcaaatcaactggcacgctcatacattcgaaggcgagatttggacctgcactagagttaagcagatctcccaggcctcgtgttttctgtcaacacgcttttgatatatatgtgcccccctaattttacaatgacaaaagcattgataaaattataaaacaacgaagggcgatataacaatatcggccattgtacatcggcaaaccacaaccgattacaccatgaaaaacaactatgggcaatataaccatatcggccattgtacatcggcaaaccacaaccgattacaccatgaaaaacaactaagggcgatataaccatatcggccatctcaaggcgatgcaaacacatcggctgtcatgcatcggcaatactagccgatcatgcgttaactcaaacacttgggtaatatttcttcaaatacttgccattgagcgcttgcccatagacttcaccatcaagcccttgcaacatatatgctcccttagacataaccttataactggagttaagcagatctcccaggcctcatgtttttatgtcaacacgcttttggcacgcccagtgggagagattagaagtcagaaccgcaatagcattctctcatcgctaagaaaccaccagcatcgccatcttcggctggcaaaagagggtcctcccaaatctaggatcccgaagcttggtgggtccgaagttcatgaaagcaacatcgtgcccgtcactatagacaaattgacacttgaacaaaagaataatctcgaggcgatgatgcagcaaacacagaaccaattcttgaactcattcatggagacccgccaaggaacaattgtttagaggtataagatgaaattagttgctgatgttcctaggacaagttcttccaaggatggggaggtagaacaggtttcagatgctacagctcaattaggtgataaaagtgctgcagatggctcaggtgataagggtgattgttctcagggagtgaaagatgaggatctcagcccagatggtaacactgcacatatacaatttaacaacttccaagaatcagtctggggtactagtcaataccttgtcaaacatggtgaagtcgatggttgatggctcaatagctgagtatcaggctacaggaccggtttatttgccaggaggtattttcccaaactatcggcccttgatcactaataatcaaccgactgctcaaccgattgctcccaatgtgccatcagctcagccaacagcaccagtatcggctcctgcacctgctggaccatcatcggcaccaggtcaactaatcaatcctcggttgttggtgagagagcagtctcagcatagtggacaaaatgtgaatcggctaactcaagagcaagttgcagctatgtttttaccaactcagcctactgctgacccagttcaacagcagccgattcagcagacgccaccgaggcagcaagttgctcagccgattcagcagcaaggtttcctaaatgcatcggctgggttcaggacgcccgacaatcagccgaggcagcacgctgcaaatcaagttgtcccagagcatttggttcataatgtgcaaccagatcaatcggtgatacctcaagttattcccgaacatttggtgcgcaatatacagccaaactttcagaattatcacgggggcaatttgaattaccagtatcagcctccatcgccgcaagttcagtatcaacaaggaggatcgactcagcctcaattcgcttatcagtacaactcgttcgagcctgtgccacagcaagtgcagggggtgcctcaataggaaccatgggccgatatgattgcagatgtgatgagagagcaatttgggatcaagccaaaagacactggaaacttgtatcggcatcgatatcctgagtggtttgagagggttccattgcctagccggttcaaggttccggatttttcaaaattctcagggcaagacagtgtctcaacctatgaacatgctagccgattcttagctcagtgtggtaaagcatcgactgtcgacgccttgagggttaggttgtctccctagtctttgtctggatcggcttttacttggttttcttctttgccatatggatcaatcaacagttgaccgatttggagaagaattttcatagctatttttatagtggggttcatgagatgaaattgtctgatttaacagcgattaggcaaaggcatgatgagcctgtgcaagactacattcagaggtttagagagatgaggaataagtgctacaacttaagcttgactgatgttagcagatttggctttttagggtatgatagctccaatcagggagaaattctcatcccaggactttgatagtttgtcacatcttgcacaaaaggttacctacatatatggatctgatgatgatgatgatgattccgaggtagcagcagccaagtgggttaggagcaagaaggttataccatgccaatgggtgaagagttctggaaaagaagagaggtatgactttgacatcaccaaggctgataagatctttgatttgttacttcgggaaaaacatattcaacttcctgctggtcatacaattccatcggctgaggagctaggcaagaggagatattgcaagtggcataattctggatctcattctaccaatgattgtaaagtctttagacagcagatccaggcggctattgagggaggcaaaatcaagtttgatgattccaataagccgatgaaggttgatggcaatccttttcctgtcaatatggtacatacagctggtcgaacagccgatggaggaaaagctcgaggttttcaaatgaactcggctatgattatcaataagtatcagaggaaatatgattagcatcaggaaaagtattatgaggaagatgatagcggtcttgatcctcattggggttgtgagttctttagattctgttggaatgaaggtatgaggctgccatccaatgaggattgtcctaggtacagcaatattgcaggaagttcaagccgatcatataataaaggcaattggctaaggcaagcaagggttcctgttcatcaaaggttgggcccagtaaatcaagatcgtgaccaagaggacaatgaaggtaggaagacttaatggtgtccttctggtatttttacaaagaatcagaagagaagggttcaaaggttgaggaacagggaagaggttgagcaagaaatcaaccatcggctgaagaaaacgaagccgcagcaggagtggcgcgttaagaatcaagttcctacagccgatgaagccacagccgatgaagcaaaaagattggctaaagggaatagtgttgtaactgcatcggttaacatggttttcacactgcctgcagaatttggagtcaaacaagccgatgttgatgaggttgaggaagcatcggctaagttggttttatcaccagaacaagcagtttttgagaagccaaaagggacagagaattggtatctcaagccattttatgtaaacggttatgtcaatgggaagccgatgtctaagatgatggtcgatggtggggccgtggtgaatttgatgccttatgccacgtttaggaagctgggcaggaatgctgaggatctcatcaagacaaacatggtgctcaaagactttggtggcaatccatccgaaaccaaaggagttttgaatgtagagctaacagtcggcagcaagactatccctacaacgttttttgtcatcgatgggaagggttcctacagcttgttgcttggaagagattggattcatgccaattgttgtattccttcaaccatgaatcaatgcttgattcaatggcaagtcgacaagatagaaattgtaccagccgacaggtcagttaacgttgccagtgctgatttagctctttgggagatggatggcctagattgcttgtctggaaaggtttgggaaggagattttctaaatgtgtccgattgtgatatacaaccaattgaagatggagagcccaagttattattttgagggcgttgtggagggttcaaacgtctacaccaaggacacagtagatgatctcgatgacaagcaaggacagggtttcatgtcagccgattatttggaagaaattgacataggtccaggtgatcgatcgaggccgacatttatcagtaagaacttatctctagaatttagaaccaagttgatagagctcttgaaggaattcagagattgtgttgattgggagtattatgagatgtcagggctcagccgatcgattgttgaacatcggctacctatcaaaccggggtttaggccgcaccaacaacctccgagaagatgcaaagccgacatgctcgaacctgtcaaggctaagattaaacgtttatatgatgctggtttcattcgtccttgtcgatatgccaagtgggtttctagtataattccagttatcaagaaaaacggcaaagtcagggtgtgtgttgatttcagggatttaaacaaagctaccccaaaggacgagtattcaatgcagtagccgatcagctgggtgatgctgcttcagggcacaagatattgagttttatggatggaaatgcaggatacaatcagatcttcatggctgaagaagatatacataagacagcttttaggtgtcctggtgcaatcgacttgtttgaatgggttacgatgactttcggcttgaaaagtgctggagctacatatcaatgggccatgaattacatataccatgatccgatcggctggttggttgaggtctacattgatgatgtggttgttaagtctaaagagatagaggaccacatagccgatttaaggaaggtttttgagaggactaggaaatatggcttgaagatgaacccaacaaagtgtgctttcggtgtatcggctggccagtttttggaatttcttgttcatgagagggggattgagatacctcaaaggagtgttaatgcgatcaagaaaattcagtctccagaaaatagacggaattgcaggagatgatcggcaagataaattttgttagaaggtttatttctaatttgtctggaaggttagagccttttacaccattgttaagattgaaagccgaccaaaagtttacttgggaggcagtgcaacagaaggctttggatagtattaaggaatatcttagctctcctccagttttgattcctccacaaaagggattaccttttagattatatctatcagctggtgagaagtcaatcggctcagtcttgattcaggagcttgaagggaaagaaagagttgtattttatttaagtcgtcggctcttggatgcagagacgagatattcccctgtggagaagttgtgtttgtgcttgtatttttcctgtacaatgttaaggcattatatattgtccaacgaatgcactgtcatatgcaaagccgatgtcgttaagtacatgttatcggctccgattttaaaaggaaaagttggaaagtggatattttccttaacagaatttgatcgttgatcatcgtgatgattcaatcggctcggttgaggttgtgccatggtctttgttctttgatggatcagtgtgcactcatggttgtggtataggcttggttataatttttcctcggggggcaagttttgagtttgcctatactattaagccttatgcaaccaataatcaagctgagtatgaggcagttctcaaagggttacaattactcaaggaagttgaagccgatactattgaaattatgggggattctttactggtgatcagtcagttggcaggagagtatgagtgcaaaaatgatacattgatagtttatattggtggcaaccgattattttaccaagtgggtagaggcgattcctctaaagaaagttgattctggatatgctatacaatttattcaagagtatataatttatcgatttggtattcctcaaactattacaaccgatcaagggtcaatcttcgtgtccgatgagtttgttcagtttgccggtagcatggggataaaattgttgaattctcaccttattatgcacaagctaatgggcaagccgaggcgtctaacaagagtttgatcaaattgattaagagagagatttccgattatcctcggcagtggcatactcgattggccgaagcattatggtcctattggatggcttgtcatggatcgattcaagtccctccttataaacttgtttatggacatgaggttgttttgccatgagaagttagaatcggctcaagaagaacggagttgcaaaatgatttgacagccgatgagtattataatcttatggccgatgagagggaagacttggttcaatctagattcagagcccttgcaaaagttgctaaggataaggaacgggttgctcgacattacaacaagaaagtggtagccaagtctttttcggaggtagaacttgtatggaaattgattttgccgattggcactcgggatagcaaattcggcaagtagtcgccgaattgggaaggaccgtttcaaatctataaagttgtgtctaaaggaggttatatgttgcaaggactcgatggagaagtttatggacgagcgctcaatggaaaatacttgaagaaatattacccaagtgtttgggttaatgcatgatcggctggtactactgatacataatagccgatgtgtttgcattgccttgggatggccgatatggttatatcgcccttagttattttcctattgtaatcggttgtggtttgccgatgtacaaatggccgatattgttatattgcccttagttcaagatataatttcatcaatgccttcgacattgtaaaattaggggggcacatatatatgcaaaagttgcaaaatttttgagcaaattcttgagcaaaaacatggagttatattaatcggcataaatcaagacaagttaactacaagtgccagagtatcttagccgattacaaaaatttactacatcctattatagaatatcactgagacaagtagcgctagatcgccgatatagctctttgcctaatgtgttctacttcttcaatagcttgggtatcttgagcatcggttccagagatgacttttagggacttggtcatatcagcattgcattcttggagttgtgccaagagctcaatcttacgagcttcaagctgatcaatattagacttgatcgggccctcagatagctgatcaagcttggacttctcttcatgcacgagttgccgattggcctggattgtggcttcaatatccctgcgctcccgacgttcggctaatctcagcttggccttctccagtttgaattgatattgttcaagataagcagctggagtgaggacgtcggcatgttcttccgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35176 - DNA, 446 bp, Oryza sativa
atataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcgccccccgtgtggcggcggcgggcaagttcgacgacgtggtggagccgagct

SEQ ID NO: 35177 - DNA, 959 bp, Oryza sativa
gtaggcaggattgagcttctacaagtagaccacgggccttgggccaatacatctcgactacggggccgcagctcatgtagccttcatttgtcctagagatgtccatcgaccccggacttcgtccatctccatcagtgtacttttgtttataaccagactgagccacaaactaagccttacccactagacatgtgaaagtacggtagtgctttgcaaagagaggcccgaagaccggtccttatatggccgaggtgctactatcaaaaccatgcaccccgagcccagcctaaaaccattttgagggttttgaatagaggggaggtgtgaatccaattccacaatgatccaacaattccatagtgtccaggtgatgagaatactcccaaagtctagagttgtaaaaccacctaatgttgcctaattaaccagcgaagcatctacctaaaagcatactagtggtaccatgagtagagtgtccactagttggggtttggtttaatctagggtgaacaaggtaataataacaataacaataataaggtcataacaaaggtaaataggcatggctagataaaacagtgataacgcgtgaatttaagtaaagcgataatgcaataatttaaatcaaaataattttataaactaggattcaatatgctcaaggatgatgtgacttgccttgctcgctttcccaaacgtcggcttcaacctccacgaagagcggatcttccgaagctgcagcatctacacgaccaacgaaaaagaaaaggcttttactctaataaactccatataacaagcaggaacaaagcacaaaaatgggttcttgacttcttaaggaaaaattagagacttgaacggtccaattccgagttcaaatccccaagttatggccatttgaagattatatgctctttaaatgaatatttgcgaatttcttcatttaaattttaatttaa

SEQ ID NO: 35178 - DNA, 1081 bp, Oryza sativa
aaatagggttggaaggaaaccggcgcggcgctctcgggctccatcaatggcgccggcgggattaggggagggtttccaaacgagtccaagggagagtgggatggaaaattggggggaaagggagaggggatcacggggagtgattccccccactttattgcacgcggggacggcggaaggcggcggtattctcggcgacgtcggcgctagggcgcggggtagacggcgggaacgacgggaggaagggaatgacgggtgggccctacccgtcagggagggtggcgggcgggcccgcccgtcagcggcgcgcactgggagggagaccgaatgggccgcgggggagaggagagagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacacatattcctaatgcttataatgatgtttctaggggatatcctcccgatacaagacaaggccaatataatcatattgcgccacaaacacaacctattaggccaccaaacccaccgccaaatcaacaagggcctaataacatggaggatatgattagtgatattatgaggaatagattcgggattgaaactagaaatcgtgctagaacttacaaaaagtcatatcctgattattatgataatgtgctgtttcctcgaaattatagagttcccaaatttgccaagtatagtggtgaggatggtaagaccacatgggagcatgtaggtcaatttttggcgcaatgtggtgaggctaatagtgatacttttaaattgcgcttgttttctttatctttatccggtaatgctttcacatggtttacttctttaccag

SEQ ID NO: 35179 - DNA, 812 bp, Oryza sativa
tgcattgttcaatatctgggacagatagcgagaaggattttgcccaaagaaattctttctttgattttaaggcttcagctacagagtgctagttggttgtagggaaagcccacactggatccacaaaagaggactttttccagccacatcagcaagaaagctacatgctctcgaggggtaacagacccttggcccatatatgccgccacatagccagaccagccacctatgcttttggtcttcaagtcaaattggttcttggtgttcatactcataggtttagccgatgaagttacatctaatccagtaatcatggtgatgtcgattaaagttggagtcatcggcccttggttgaataagaaagcattgatggcgttggaccagaagtaggtggcggcagccatcagaggttcatccttagcagaattggctatggtgaaagcgagtgcttggccgattccaatttcatcccagtgaactttcttactagccgatacgcgttggtaccaggtggtctagctcttatcaggagtaggtttttcgagagatggccaagacttgaatgtattcttccagtaacccaggttagggttggctagtctaaaggggatccgattggtttcaccgatgatgaaatcagtggggttgagattgccgattgggccaagaaaatagtggtttttgtgtgaaaggctaggaatcgcgactaggttggaaaggtgctgcaaatccaaaggaatcgggatgcggaaaacatgagaagaaaaggagaaatcaatttcatgagaggaaaagggatctagctggtgagg

SEQ ID NO: 35180 - DNA, 7108 bp, Oryza sativa
attttctttagacaaagcatgcatatgcaccctatttaaatccctcttcctatctttggcgtgaaaccaagcaaactcctatccctctccacgcaggcccaaaggccagccgggtaaagtttatctcttttccctcccctccctaaaacgaagccaacaagtctagtttacatcggtctacgaaagagccccagtccacccctgcctctgccgatgtcgttggtgctgatagatgcgatgcccacacctcagggattcgcttgccgtggtgtgcagccggtgaatcttccgccgcctcctgtccttccgtcgtctaacgaggaatggttttaattctcctccgatttcccccattgctacataagttagtgattcattggtagatctgcttgtggttgaatgtacaagaatgcttggtagatctgattgatgttgaatgtgcaagaatgcaagaatgaatggagtgaactaaagcatatgttctggtatgcatatttcaaagtactgcgcatatgtgtattataccatattgtattatgtacttatgctgtgaaattatatgtggaatcctccactacatattttctcttggttaattagtttaggaaaaattgcaaatatgatcttgtgagaatttgtaaagtacatagaaggccatttgttttgacaatgaagtatggtttgttgtttgttgatttagatctccgtaatactgcctaaatttaaatgtatgtttggtgaactgaaattagatatggttagtgctgtcataattttttaatgactatttgtccttgtgagtaaggttgccattcctcggctgtattgcctttagtgtggctatttgtctcccaagactaagtgtcgtaggctctccggaccttccattatatttgagatgaagtgaataattcaagtcatcaaacaagcataatgaaacatccgacgcctcgagagaggaatattggagacattgctgagcccttagcctgccagtcaacttcagcctgagatgtgcccgtcaaaccactcgaaggcggcgaccagatgtgttacacattcaggagacttgataaaaatagctaaagatctacaacctctcaaatattcctaactcatactcatgtgaatctagttcccaggatgtgcactagattcacactttcatcttaagcatgattacacatagcaaacacaactaagatgaaagaaacttaagacttacaacaacttaataattacataggccaaccggccaaatagacttattagagaacagcggaagcttgactacccaatcacaagcacaccgactaggggtttaccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaagacaatatgtagttcattttcagcataaagcaagttttgtttcgcaattcttttgtaaaagagttgatgcttcaattaacaaagacaagttttgagtttcattattaacttcttcataattccatcataaacaatctcttattgccatacttaacaataagtcataatgtatcaccacatacacaactcaacacatttatcaatttcaaaccagtgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacacgcttagtcacctaaactaccacgtcggggtaaataggaagctcctctgaattatacgaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactgtatgcacaccacttgctgcccaagtgtaaaatcacattttacacattttagttcgcaaatacccatcatattcattttattctagcgaaggttcaagtatcaaaaccacattttaattataaatggaatgagcatttgcatatttctaagcatggctaagcaaagtagttgcacatagagcatatataaacccatttgagcacaaagagtgtactctaaccatttctaggggttcaaacagcaagaggatcaattattcaaggtggggtatgcagcaaataggtcataactaccttaacccaatttcaaataccgatataatctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaaggacacgatatgcaattaaacaccgaaagagctgaaaatccaaaatgctctaaaatgcatgatttatgcacagtgggttggtactgatctaaaatgaatttaggtgaaagaatttttattttaacttattccattagggagttatgaactttttagaagttttatcggtttatagtagtatagtcttaggtagtgttatgaaatacttttgtaaagtgatttttactagattagacttcacaggggtgtggagatgtgttttctaatactaacacatttggtttcacaatttttggatttataatgaattctttatgcattttacaagttataacgtgttattggtgtatagtgttttatatgttcatgacttttgagttataggttcagaacatgctacttcctgtttaagttgaataaaaggaataatttggttatctaaaacatttttagttcacatgtttatggtctttactagtatggttcatattttataaactagagatgctctaatctaaactagcaatatattatattaacctagaaattgttatatgagccaagttcttctaagttttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggtttcgatctatgttctctacaaaaggtgccaaattttattttaccatgttgaagataactattttctggttctatagaaactttgttcatttcatttggactaaaaataaattttctacaagttttacaaattaaaggctgctctatgttagtaaatccttatatgaatatttagagacttttactacacagtaagtatataatcttatttcataacttagaaatacatgtttagtgatcctacagaacttaagtttactcaaattgaagctaaattgggttctacatgaatttctaaagtttagcttatctaaaactaatcattatagagataatagttttagaggcatttgatgcaaagtaagtaattacttttatttcacctaatcagagactgtatgatgatgaatctgtagaatttgattttgtttcaaaatgagttgggatgaattttctatgtattttataagtttgtacatgttttatgtatgacctatcttagataaattttagagacattatttgtacagtgagtgtcaagttttatattcctggaataaagttcataacttcaagaatctacagcaactagaatcacttcaaaatgagttatatttgattttatatagattttacaactttgtgcatttttctgctaaacatatttgtttgggcattttcctaattattcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcggcaaacggtggctcgtttgaggttgaggtcaaaagataaaatgaagagaaagctctcgcgattccattcctctagttttcttggttagaggacatcggagtagcgccgatggcgagtgtgagcggcggtggttttggggtgaaagtgcatgtgtgcatggaagtcgattacgaacgaaaaggatgcatgcatgtagtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaaacgacgatgacggcggaggcgatccaagattggtgccggtgaagaaaaggatgtgttctctgtgttcttgatgtttccggctggggttcttgaggcgttttgaagaggaggtcgaggcgatgacaatggcgcagcggctttctctgaggtggatgagaatggccggacggcgacgatggttgaagcggcggcgctccggtgcgtgctccagggcgttgtcggcgtggcttgcgttcctggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccagtggcgaggttgaggatgacggagaggctgaggacctctccctcggcttcttcagctccagagtgatgtgtggagttgggcgactcggtctggaggagatggaggcatgactcagtgacttgaaggcgtcgacacgtcgtcaccacgcgtcgacgcgtccaggactcggtcggctctcgatctctccctctatgtgtttcttggtcggctgaggatgagggacagaggaagggcgagctggagaggctgccaggtgggtccaggtcatggcaaactaggctagggtgagagggttgggtaagattctgggtaaacttgatttttagatcatttttttcggaattattttctcctctaactttgtaactacataattcaatgtgtagaccagaagaattagtgtagattttactggtggtagatgattacacctagattccattttctttggttgcactaaaaaaataatgggtggactgctcacagaaattaaacaaagatgggctattagaaagctagattgaatttttaggaggcttaaacagaggaggaaaattctagaaaaattatatttaggcatgataactagtctagtatttgaataaattatttcccatgttcacttatgtgcagttaaatgtacttttggatgaaatatggttttagccgattaaaatttaatttgatttcttttagttgtctgctttgaccgtttaatttgaggtatcaacttgagtgttaacacgttaccaaattacggaggataagtttgtgctaatcactatccacataaatttttccatgattttatcttgcacaaaatattttagagaattaggatgacctttgtttgtatatgtattcccacttcataattgcatttaatattattatagggattacattaaattttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcaagcctaggcatgcattatgtacatgtatgcttggtgacatttctagtctaatgttgggaatgaaaagattttattttgttctcaaattataatcatgcaatggtttaagttgatcttcacctaaattaaaacggaaatttttggctctctcaaaattggagaagttaacctctaactattttgacaagaaattttaagtcctaaaatttcgggtatgttacactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatacgctaagaataaattaagtaaagaacatgcacacacaaataataataatcatgttgcattaaattgctaaggtcagagaccaacagatgacacattggatagtgctatagccttattaaaagtagcaagagaaattaaatatgcttgtgagcgcacatatgcacgacatacaaatagttgggaccaacagatggatcgactatagatcgctccatatggtcaacaatttattggagataaacattaacataacttggccataacttgaagcaaaacaacatattcttatgaaaggcattaagactggtagcaatgcgagtaggttgttttaggcttgtccttccatcttagcaagaactcccatttcgtccatcttagcaagaactcccatttcgtccatcttagcaacaactgtg

SEQ ID NO: 35181 - DNA, 3532 bp, Oryza sativa
ggatcgtcttggtatggataaggtgcggatggctgcctacttgtatattatgaatatggtgcaaatggctacctgcattgtatgtatgtatcctatgcatgtatatagttgatggatgtatatgtttgtttcacaatctctgaacaaactcttcatatctagtcctgcgtaccagggaattttaaatttgcacgttttcgccgatggacagaaggagatgattttcagatacacttagctcgtacccgtcagatgaaggtaaaaggaaacgagtaataatgttttaagtgtactattgagtagtccttcataagataacttagttgtgtttgtagcgtactatggcgtggtagacgagttagtaccatggctggcttgcatgccatgtgagtccatgttagtttagttaggctgcccaatgtgagtaagtgaccgaataggtttagaaatggtatatttctaggtctagctagcttgcctatgtaggttaatgtgtgtgtatattatcgcacaaggtcagaactttttggaaattcgatactgtacttcttacaaatactacatacgtttctatgaataacacacatgcacgtttttgaccgaaagaattgagaaacaaagaataaatcttatatttagtaattggatgcaccaataaagcttccacgttagttaattgatgtcataatttttctagcgcatgcaagtgcataggttgatgactagtaatacataaatagaattgttgtattcgtattgaaaaacacgttgaaatgatgccactagaacggataccctcatctcaatcgggcggtaagccccatctcaatcgggcacagcgtccgtcacaggctagaaatcactgatgtgaagagttatctcaatcgggcaaacggccgtcacgaatgaatatatctcaatcgggccctaagtaaagcccgtcacagatagctttgacccagacgaccagtcaaactatagcccgtcatagatgacctatctctatcggaccacaactagagcccgtcacagatgactactaacctttatcgggcctaaactagagcccgtcacagatgatactcatctcaatcgggcctaaactatagcccgtcacagatgcctactgacctcaatcgggcctaaactagagcccgtcacatatgatctcatctcaatcgggcatttagttatggcccgtcacagatgactataatacacaaaaaaaataaattttgttttttggctagcctcaagcctttgctagccatgcccgctgcaaaaatgacagaaacaaacacagatattcaatatccccagctccccagcctcaaccattcatatacatatgcattcacatacacagacatgaacatatttcacacaaccacacattcacagccatctcatatttcacatccattcacatatttcacattgaatatttatcatgtttcaccaacaaaaccgagttaattggaacaaatatttatttagcaagtcttagtataaacatatgaaacatatacataaatataaacatcacagttacatcatcacagttgcataataagtgttcatcattgcctaaacataaaagatcaacattgttcatcattttagtttaagcctaaacattcctttggagtattgtcacagtttctttccaaggtaccgtggtggtactgagtcgcatggtgacatgttgtgggattgtgtcttgtgggtacagtggtacacctctaatcagagtaaaactattcgaatagccgtgcccgcggttatgggtgagttgaacaatgtttttcatgattagtctcacactactcattattggtaattgtgttaattaatttgactcctggtttggaatggcatattcctggtatcgaggtttgatttgtacaaccggggtggttgttcagatgaggtggggcctatgcaacacgggtgtgttgtgtagtgtttatttaatactgattaattattcaactgttttactattctcctaaatatttattaaatgttgtttatgcaaatgaactttattatgccgtcctttgttatcctgtgcacttgcatatttgctgtgtggcttgttaagtatggcatatgctcattcttgcaatattcattcatcagaggaggagtacttcagtgaaggtgatgatctggaggactaggcttgatccgggttaagttgcttgtggagtggagtcaccatagctgttccatagtttgttttattttccgctgcgtagaattttattctttgagaggaactatctacctctgtaatgatttattatttgtgaatattaattcgctgtttattcatactctattatcaatttgttattgtgtgcctcggctgattcctggacgagggtttaacacacatgtaagcgtttggaattttggatggaaattccggaggtgacaaaaacccactcccctccacagcaaaataaactaacatttgcgccctaaccatgtacatttgctcccaaatccatctccaaacaagcagaacaaactaacatctgtcctaaccatgtatacccagtaatagtactcgccatatctattcacaagcagatatcgccatatctattcacaagcagagaacacagagcacactcgtcctctgtgaacactgcacatctgttttaaattttattactgttccactgctgcagttcagctagcaagcacacactgttctaagatctcaaggagagtcctgtcgtggtcgagatgccctgcgcgtggcattttaaattttattactgctccactccactccgcatttccactccatgggtccatttactgaaactttttaagctcatctccctccatcgaggagcgcctaccgataagccgtcaactcttcttggctttttttatagaaaaaaacaaaactgtcaatatttcagagctccacgtatataaaaaaagaaaacatttcacagctccaatttttctccagtttgaggtgtcaaacgtcgcatatttcactaccatagaaactaaaattggagacgtcactacaaacgtactcactctttactcgtccggcgtatataaggcgcaccctcagttctactcgtcgttgcaccgcacaagtacagagagcacttgcatgcatataataggtcaggaggaactggcaatatgcaattaatctctctggaggattcatcaagatcaatgctttgctttgcttgcccggtctcctagctagctaatagtctccatttgattgatgcttttatactaattaactatcactactaattttcttataccaattaagtatatgtgtatcagcatagttaattaattcacctaggagactcttgctaatgggtggtttatatatatgtctcatgagatgatcaaaactgtgaaggcagattgatgattatttatccttctggctaatatgttatggccacttgagaggcacagttggagaagataacctaccacaatcctcccatcttgcgatttttgtcggttctcgtag

SEQ ID NO: 35182 - DNA, 5169 bp, Oryza sativa
tatactccttcaatgaggaatgtagtatatatacactgaccaaagagcaggttataccgtttgtagaagaaataagtatataccactccgagtagctgttcataccgattggagaagaaataagtatataccactccgagaaaagtcagtatatatactcgttccaaaaaaaaaatcagtatatactcattccgagaaagaacagtatgtactcattcgctcgttgcagtagtatatactgcacgtaccaataaaaagacataatcagtatatatatactcattagttctggagtaagtatattcggctgctaattaaaaaaagaagtattcactgctacaacaaaaatataaggtactccttattaggtactgctaatacacaaaaaactactatatagtactgctcatcacttcaaagagtatatatactgcggcttaaaaaacagtatatactgttgcatactagaaaaggtggggatatctaaggtacgttatcaaatttgaaagcaaatgcatgccaacaatcttgttcaaatctgcacccaatccggtgtgcagctatgccacatgcatgcagtcatttggaaattaatattattaatttttttcatagctaatttgaatgctaatggatcatccattaataaaagggtgtacatacacctgggcgtatgaaagagccatcatatatatatatatatatatatagatatatataatgcatatatatgtattgtaacataaaccctaaaccatgcagcaatagggccatgcaaataagaaaaaaattggtagatcgatctttagtccaggttatttcactcaggactaaggatagcgatctttagtcccggattcgtagtcccggttggataaccgggactaaaggggggttacgaaccgggaggaaaaagggtttctccaccagtgtagctgatgctaatttacgtcatgaaaattgaattttaagtcatgttgtgaaatctaacgttcgtgtgacaaatatcattcgtcacctatgtcacaccctaaaaatccgaaatatataaattgttgtttaattggaattattagaattgatattaaaagcctagaagagaagatctatttttaaataataaatttcaatataaaattgggccagataaaattttattaaatactttgcttaattctatagttcctagatttttctgggatttatttgagccaaggaagtatttttaatcaatggaattgcatttcatgaataatttaaattgaaaaaggttttttaaatcctcttttggctttgggccgaaagtcggcccaaacccctctctctctcccggcctaggtcggcccgcagccgagcaccgtctgcgcgcgcgccctcgcccgctgataggtgggacccacctgtcagactcgtcgtcttcctcgcgccgtcgcccggccgaaccctagccgagccacgccgctgcccttccaaattcgatcgtgtctttcccgatccggtgaaatttatagaggggaaatgatccccgagatcccctgtaccttttctcttttggaatcatcggctaaaatcgttcggaaatccatggattcgaactcgaatcggattcgtctctctccccgaaccctagactttccattgctgccgccggtcgccgtgggccttcgccgccaccccctagccgctataaaaggacccccggtgtctcctctacccgccgccaccctcgcctaagtctcttgtcgccagtagagccctagcgtcgtgtagtctagcgccgccgtcgccgccgttcgtccagccgtgcgccgccgtccttccggtcgtcgtcgtcgctcgggaaagccgccgttgtgatcgtcaaatcatcgccgacctcgtccgcctctccgccgtcgctgtagatcgccggagccccgccgtcgtcgtcgagctgaaggtgaccaccgcttcttcctcgtcgccgtcgccgtccgttgaccttccgccgctgctttggtcaccggtgagttcgccgtgtcgcccgcaacccgtaggtgtccttcattcgcgccgtcgcgccgtcgttcgccggcgagcacgcgaggccgagccgccgtcggtgatgacgtcactgctgatatcatcgacgccgtccaccgtagaccggtcgtagaccgttagatcttggtccgttttggatagatcgatctcggccgttcgtttccgtgaaccaccgccgtgcacccggtccaccgtgagccgagtcctctgacgcaataatccctttttcctttttaaaaataattcattattacgtcataattcaattaaaatctatataaatgatttaatccgatttaatctatgaaaattcataactaattcatcttagctcgcatttagttggttcaagtctctaaatttttctaaaattgagatctacatgttaaaaatatccacatgtactgttcaggcttgtttatgtgctgttttggtgattttgctcttttctctttagagtccgacgttcccggagagtccgaatttgcaggagaagactttgaagagttccaaggccagcaaggcaagtcacacagatcccaaacaaccctttgagtatgttgatcccgtttaaagctattgtttctattcaactattgcatttattttcgaatgtcattgggtggaattaacctattgccttgttatagcccttttgttcttgattactctattccttgataccttgggttattataacttaactagttgagctttatatattggttcagctagatattagacataattgcttagccatgcttagaaacattagcacactattgggataacttatgcttcactattatttaatgatggcttaatgatagctcatgatggttaatcatgattggttaagtaattaatttgccaactaaaacctgataatggtgggttgtgagcatatggttttgatgggttgtgagcacacgattttcggttgtgaaacatttaccgtgtcaaccacaagccagcgtgggcaacggctttactttctatatagtatggttcatagtagagcaccagagtgtgaagtggcggagataagcccacgggggtcgctggggagtccataccttgtttataagggggtgattatgatccgggaacggtgcactgctttgaattgtattatatagagggtattgtcacaatctctattcgggtacttgtcaagtatcgcgacgcatggttgacatgatgttgaggttgtgtctttgtgggtacagtggtacacctctggccagagtttaaactattagaatagccgtgcccacggttatgggcgggtctaacaatgtctttcgtgattagtctcacacctctcaccatactaaatgatgctgttaataacttgatagctcctggtttggaatggttaattcctggtttggagatagaactgtgcagtcgggactggttgttcagaatggttgggcctatgcaacagggtatgttgtatagcgttggatcaatattgtttaattattatttaactattttattaaattctgaaataattgttacatgctatttaagcaattgagactatactatgccatcctttgttatcctgtgcacttgcttaattgttgcgtggcttgctgagtatatcatatactcaccttgcaatcattcatcagaggaggagttctacagtgatgctgatagtgtggatgattaggcgtagccttggtcaagttgcctgtggagaggagtcgcctgcgctgtttcttttattttccgctgcttagatctttattgattgagaggaactatctacctctgtaatgacattttattcgcttattaattagagtaataattgtgctctattatcaatttgttattgtgtgcctcggctgattccaggacgagggtttacacacatgtaagcatttggaattttggatagaaattccgggcgtgacaacctatcatgcgtctctaatggcgttctataaagaatgcttatcttttcgtcattaatattgtgatgatccttctgtcgtcatacagtctatgacgtccatcttcgtcactatcaagcccagaaatcatgataagatgccatgtggcctgttaaggcccatgtagtcagggccgacgagggggggaggggggagcgggatggccgctctaggcccccacccacacaccttgtcaggtcccaaaattaaagattcggtaaccgacatgtttaaactgtatcaagccctggatcagtagattgatacaggttcaacaatctgaatcttcatcgcatacatttgatcaaggctccaaaggtgatttctttacataaaataatagggtatttacaagattgtggctatctattactgtagaagctataggatgagccaactctaatgttttgctatagaattaaaccatctatctaatctatacttgggaactaagttggaatgaaactaatttatatgtttaaactcacggcttcagcaaaaactccaaattgattctcaaagagagggttaaagcaatggtgagtacaacatactcatcaagctattatatcaagtaatgaatgcatgaaatagtaatctctaagtagggtttaggacttaccctaaaccctatacaaaaaggtccatgggcattaggtgaactgcatttaggtccataggcccacatggcatacaaagcaattttacaaaaagaaccttacaagatttaaatttctactaatgaaagtccttacgcctaatgaagtggctaaatagccggggcccacatgtcagtgacttggcggctagggaagcagaggcaataggagggcaacggcgactgatggcgttcgcggcggcatattggcttgatcatttttgggcgtctttctcctgggatgtaggcgacgtcggtggcgcaatggctcggccagggatggttcgagtcgacgggaatgacgaagtcgggcgatggtggcgcaatggaccgggaacgccgacgagcatatcaccaactgttcgatctatgccaaaataggaacaaagaaaatggattgattaggtagagaaggaacttcacgttcccatggttggagtgcggtgaagctcaccagagaatacgtgcgatggatgaaactccttcaggtgaaaagag

SEQ ID NO: 35183 - DNA, 472 bp, Oryza sativa
gtcacataggagttatagattgtgctaaccgtaatgtgactttaccaagtagcaatggacaaacagtgtctttctttgtgtcatccccaaaatctcacggtttgacattaaatcaagttgctttgcaagagatcccaatagtacgagactatccagatgtgttccctggggatttgccaggtatgccacctaagagagacatagagttccggatagacttagtacctggaaccaaccctatccataagagaccatacagaatggcagctaatgagttagcagaggtaaagagacaggtggatgatttgcttcagaaaggatatatcagacccaatacttccccgtggggagcactagttatcttcgtggagaagaaagatcatacccaaagaatgtgtgtggattatcgagcattgaatgaggtcactatcaagaataagtatcctctacctacgattgatgacttgtttga

SEQ ID NO: 35184 - DNA, 6095 bp, Oryza sativa
gtcggtgactttccccacgaccctctcttttcttagctctcgtctcggaatgacgtagtaacatgttgttcatcatgtagtaacacaatgttttacttacagtaacaaaattaaaatttactcataatatacttatgatggatctacttttggtaagtactttttttttgaacatcatggtgcaaacggtttttaaaaatagtacatggtgtgagagatattacccttcaaagatttgtttttaagatttaactctccacaagtagtaatactaaattaaaagttttactactgcctgttttgcgttactgcaatcacatcatgtcattactacaagatgtagtaacgattataattttcatgtaatatagtgtcttactgcaattacttgataacgttactgcaagactataagttttgcagtaataaagcgtctaactacatattttgagtagtgttactgcataaacacgtggtaacgtgtaattgtcgtgcagtaacactgttacttttgtgcaaactttttgtgcagtaacaagtgtatgattagcatctgagacttttaacccatatatttttgtttcaattgctgaattactgcaattcaccacaatattacggtcaaaagtgcaataacgtcatatacatgcagtaacgctatattggagggaggaaaccaattttcttgagaagagggaggaatgtaacatacccgaattctaggattaaggaatttccatcaagactagctgaaagggaagttcttcaattttgtaaaccaaaaatttccattttaaacaaaggtgaagttgatccaactcttgcataaataaaatttgagaacaaattaaaactttttcatctttaacataggacttggatgcaacccaagtgaaagcatgcatactctcatagacatgtttgacttgagtccttcatatgcatttggatttggattgcatttggattttcgatttgcatttcataataggtttcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaatagattatatcatatagggtatattctatcttaatcatcactataagcattctcttaatttaatactaaagtaaacttatgcataataggtaaggagcttatgacctgtgtaatgtaaattgtaattctaacatatcaacatcacctaggttaatgagagtccaaatataacttttataaacatttacatgcatttaggaaagggaagcatatataagacataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcattttactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaatttagaggacaaaataattccggaaattcgtccaaaaaccaagctcacccatgtttctgcctacacatctctcttccacctagtttacttcgacctgggcccccttgtcagtccctccggcttgctcttcctctgtgcaacttccctagccgaccgataaacactgagagggagagatcgagggccgaccggctctggacgccgcgcgacgcgtggccacgacgtgtcgacgccctaaaaacgccgagctccatctctgcctctcccagacgcgtcgccactcttcacccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatatcaccatgccgaacaactttggttttgatcccattccatttcatcttctacagcagcgggaacgccgccatgtcatggtcgctctagggcgcgctctgtgcaccgccgcagcgacatcatcgcagttcccgcttatctggaccaagccgggccaagctgtcgcgccagcgtcttcgcctcgacctcctctccatttccccttaagaatcttgaaggatggtgctatgagtgtggagatcgtccaccgtcttcttcacctccggtcgccgtcgccattgtcgattccgcatcgtccggtgagccattgtccgattcttcgcgtatacaccatccctggggcctcactaacctcatggacacacatgcatgatagttcttggagctgattgagccatcgccgttcacccggaggttcttgccgccgtcatcagcctagctaccccagccatgtctagcatctcggtgagcacccttcagcctatagaacatacatgcacgcacccaattaaccaatacatgattgtagaagcacatgcatcaccacccgaaaacatcctcctttcgaactcgccgccggcgttactccgatgtccactgaccaagaaaagtacaggaatggaatcgcaatagcatgatcttcattttgtcttttggttgcaccctcaaacgagccatcgtttgtcgccggtgagctcgagatcgagctcagccatggctgttctgcctctctgcgtgagaaaagaagtcagggaccttgtttcgagaatttaaacaactatggaggttatcgaaaatgtttgcaaatcctgcatgtcgattgtacattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatatgaaaaattgatttagaaataatctggacagaactttaatacttgtgattttgataaataaaatgatggaaaacatggattttaggtttgggcctcaagtggtgcacatatggtgattagttgtgtaccgataggaggagagtgtgcccaaaccgacctaaggacttcactcaatgtcagttcatttcgtatacagtgcaaccaaatgtgctagtatgggatagcccaagcttagtaaattatttatggtttagccttacattctggtaggccggtgtgtatgagttcggataactcagaggaacttcctatttaccccgacatggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggtcatgagcggcgtgtggatatatattgagtatagacttgtgttaattcttctaaatgctgaaatttaccttcaaattgtgatgagatttgagaatgatctccttgctgccatggaaggcaatgaggtgcatatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttctaataatgtactgactcttgctattgaattaaccttttgcttgcaggttttagatttagtctttgagtgatgcgggtaatcgactgcttcttctaggacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttgagaatatttgagatgttgtagatctttagctatttttgtcaagtctcctgaatgtgtaacacatctggtcgccgcctacgagtggtttgacgggcacatctcaggctgaagttgactggcaagctaaaggcctagcaatgtctccaatattcttctctcgaggcgtcggatgtttcattatgtttgtttgatgacttgaattattcacttcatccctcaaatataatgaaagttccggaaagcctacgacaaggaaaaacggttcttgaggaggggagtacgtagatgcattttgaagtttaatcctgcacatgcagtaacacgataacatcatggtggaaacggttttaaaaaataatacatatcttatgactattgcttttcaaagattgacattttgaactttagccctccacatgcagtaatagaatgtgtaatttacagtaacaggggtttatacatgcagtaacatggttttaccaaatgtataaaattattcaaaacactcctacatcaatcagaccttgctcaaagccacctacaaacttacctatggcccacctattcgaacttcatctcgtaaaaatgacatagtaacactgcatttatcatacagtaacatatctacttggaagtggtaacatgcacctattatgtagtaacgcttctacttttgtgtagtaacaagtatacggttagcatgtgaggctttaacccatatatttttgtttcaattcctagtttaggtagtaatactattcaagaaaatgcaagacactttgttactgcaaagcttattgtgtttactagactcttatggtaacgttgtgatagaactgtagtaacgtacagtagtaacaagtaatgctattgtattactacttgtgaagagtcaaatcccaaaaagaaaagcttttaagaacaatatctctgatgtcatgtatggttttttaaaattgtttgcaccatgatgctagaaaaaaaaatgcttatcaaaagtagatccatcatgactatattttaactatatttgagcgttgttactgcatgtaaaacacagtgttactacacggtgaccgtcgcgttactgcacagtttcgcgaaacgagagctaagaagagatgggtggtgaggagagttagtaggtgggtttgactgagctttgaccggcgggagggagctttgaccggcgtttgaccgatgtgggaggtggtttttgggccttggaaaggagggggaggtgggtgtggcccttgagagcgaggggggtatagaatagttgttctataccccagatgtacaatagtcttaccctatatatattacatatatattacgcaaatatatatatggaatacatatatatatatatatatgcatatgtataaatacatatacatgcatgtatagtacaattcatttgctcact

SEQ ID NO: 35185 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagaagatcctacacatattattacatggatggaatttactacaacttttagagatgcttttatacctacagctgtgatcaggatgaaaaagaatgaatttcgtagattgaggcaaggttttatgacagtacaagaatatttgattaaatttacacaacttgctcgatatgccgcctcggacattcaagatgaaaaagaaaagattgaaagatttatagaaggactacgtgatgaacttcgaggaccaatgattagtcaagatcatgaaaattttcaaagcctagtcaataaagtggttaggctagaaaatgatcgtagaatggtggaaggactccctaagagaagaatgaatttacaatgacaatcactaactagaggttcactacaagttcggaggccttatccatttaagccatctctacccaatgcaaggccaggcatgccaccaatactaccaagacctggattaaaaatggaag

SEQ ID NO: 35186 - DNA, 5416 bp, Oryza sativa
tgatcaattgtgcaacaagagaggttatccttactgatgaacaaggaatgaatacaaggataatagttaaatccaatctatctatggaacaacatatgacagacatttgtatgcttaaaccaaaagaagaagtcccagtggtgcaagaatatttcgatgtatttcctgaagaactaagttcattacctccagatcggggaatagaatttattatagaattacttcctggaatggcacctatatcaaaaagaccctataggatgccaattaatgaattggaagaattgaagaaacagatagctaagctgcaagaaaaaggctttattcgaccaagttcttcagcttggggagctcttgtattattcgtaaagaagaaagatggaagtttaagaatgtgtgtagactaccgggctttaaatgaagtagctattaaaaacaaatatcccttaccaagaatcgatgatctatttgatcaattaaaaggagcaagtgtattttctaaaatagatcttcgatcagcatatcatcagttgaaaattaggcaagaagcatttggattaaccaatgcccctgcctatttcatgaatcttatgaacaagatatttatggaatatctggatcaatttgtggttgtatttattgatgacattctgatatattccaaaaataaggaagaacataaacaacacctacgaatggtattggagaaattaaggcaacatcagttatatgccaaattcaataaatgtgaattttggctagacaaagttgcatttctaagacattataactaaggaaggagttgccgtagatccggagaagattaaagcggtaatggtatggagaacaccaacctcagtacctgaaataaggagtttcttaggacttgctggatattatcggagatttattaaagatttctccgctattgcaaaacctatgaccagattacttaaaaaggacaggaaattcgaatggacaccagaatgtcagagtaattttcaaagattgaaacataagcttactactacgccagtattaatcttgccagacatccaaaaagattttgagatctattgtgatgcctctcgacaaggattaggatgtgttcttatgcaagaaggtaaaatagtagcttatgcgtcaagacaactaagaccccatgaagataattacccaattcatgatttggagttagcagcagttgtacatgcgttgaagatttggcgacattacttaattgggaatcattgcaagatttataccgatcataagagtttgaaatatatttttactcagatggatcttaatcttcggcaaagaagatggttagaattaattaaggactacaatttggaaattctataccatccaggaaaagccaacgtagttgctgatgccttaagccgaaaagctaattacaatctacaacaagaaataatatcagaacaattgcaagcagaaatgcttaaactaaatctgggtattattaagtttgaagaattaaacactttggagttaaaacctaccttaatggatcaaataaaagaacatcagaaggacattctgaaatacaaacttttaaggaacgaaaggtacaaggaaaggctgcagatattaccgaagacctggaaggaatattttggtacggagatagaattgtcgtaccacaatcaggaaacttgaggaaggtaatactaaaggaagcacatgattcagcctactctttacacccaggtagtacaaaaatgtaccatgatttgaaagacttatactggtggccaaatatgaaacgacatattgcagaatatgttgcactatgtcatgtttgtcaacaagttaaagcagaacaccaaaagcctacaggattattacaacccttacaaatacctgaatggaaatgggatgaaataggaatggattttattactggattacctaaaacttctactggatatgactctatatgggtaatcattgatagacttacaaagactgctcgattcattcctgtgaaaacaacttatactggagcacaacttgctgaactctatatgacaaggatagtatgtttacacatagtgccaaaaagaattatttctgatcgtggtaccaatttacttcacatttttggcagaaattacattatgaattaggaagttatctggatttcagtacagcatttcatccgcaaatcggaggacagacggaaagactaaatcagacattagaagatatgttaacagcctgtggtctagattttgctgctagttgggacaaatgtctaccttatgcagatttttcatataacaataattatcaagccagtttaaaaatgtcaccacatgaagccttatatggaagaaaatgccgaacaccattgatatggacataaaccggagaaagatgtatattcggaacggaccttttaaaagaagctgaagaaaaagttcgactgattagagacagacttaaagtagctcaatctcgacaaaagagttatgcagattctagacggagagagttaacttttaatactggtgattatgtttatctaaaggtttcacctttacgagggataaaaagatttaaagtcaaaggaaaattagctcctcgttatattggaccatatcaaataattgctaaacatggagaagtagcctatcaattggctttaccagattatctatctgatgtacatcctacattccatgtttcacaattaaagaaatgtttacgtattccagaagaagaaatatcagtaagtactgttgaactgaatcaggatttaacttatccagaataccctatcagaattttagaagaagcacagagaacaactcgtactaaggcaataagaatgtttaaagttcaatggaatcatcatacagaggatgaggcaacttgggaacgggaagattatttacaattggtattcccgtatcttttcgaagactcctaagcaaatctcgggacgagatttctttaaggggggtaggtttgtaacatcctcaaattttaaactaaaatttgactgcatcatgctgacttttgattaatttagtgtgtttcaaaaatttatttggttcctaattggttcaagtattacttctttagaaccctactaatttacccaaattattccctttattccaaaccctagtgaatttgagcaaattctctcaaatttcaaactatagataatttccttagcttatcctaatattagtgaggacttgctatacttcaaaccctagtgaaacccttccaaattcatagattaaattcattattttctacggaaatattcaaaaattctgaaattgattgttcattgcacataaggtgttcggtagaatgcctagcccaactagagcagcccaatcccctccaatcttgtacaaagtctagaattgatcctaggggaccacaacccacttaaaaccgtggctttctttgcctcttcctccccttcacgcgcgtggcccgggcatccgacttagtcgcgcgccgtgtcgccgcgcgtcggcctcggagccgcttgcgcgtgcccgacctccttggcgcgccgtcgcccgtccgacgccatcaacccactgccactgcaccaatcgcaacgaggacaaagccaggacgacgaccgccgcacgaaatcgccgctcgacgccgtgcgctcctgtccaagccgccgccgagtgtgatttcgtttctatacggggtgaatcgcgccaattcttgccgcacggttggattgaagatagacggtggtatcccctctcacaattcaaaccattcacccccgagccggccgttttcaccctcgccgccattgcgcgtcgcgcctggattggcgccctcacgtcgccagccgattccaaccgcggtcaagtcaatccttcgccggtaagtatttgaacgtggcctcccgccactcaaatcgatcttacccgccctctcacagcctctgctgccctagctctatccaaatcccgagctcatccatggcgatgacggtgtccgagctcatccgctcctcctagccctataaataggaccccaatcccttccttgtccatcatccatcatcaacaatcaaagccctacaaccccgaagctctgcttcgccaatccaccccatcaaccaccatcgcccgtcggacgaacacttttgtgcgatcgactccacgcctctccatccatcctccgccctaaatatcccttagaacaccttatatcaaccatgttctagcatagtaagccctaaccgaagctctgcgtcgagttttacctcgccgcaccaagctgagcaccgccgcccccgcgttgctctgttcttcgccgccgcgaagtttttctggccgcaatccgtcgtttcaaccgatctcggtgagttcttccatttcaaccatctgcatactacctggattccattttagcaatccctttgcactgtcatgccaccccctgagctgccgatgtgagcacggccaccgccaatggaggcgctcgttggcaactatactcagtgccttgccaaaggtcggcaagctgccggaatccctctaggcacctcgtagatgctctagaacccctcccctaaccatgtctaactctcaacacctcgatcgccatctcggccaaaccgtgccaccgctcgccgtcaccggagatccctagcaccctcccctcgtcggctgcaaccactttccccctccatcgccgccgcaatcgccaaccctagcactgccggcctgatttggggaacggctggaggttgaagaagagaagagagagagagagactgacaggtgggacccacacacagtgccatttcacatttaatcgattttaactttagaagcccatatcttttaaaatatagatccaattccagtgaaacgtggaccaatattcttctaaaatcattcctatcttttgagcccctttttcctatttttgcattttattttattttctctatttttcttatttttggattttatttaaactccttttgaatttgaattttatatgtctaaccctaggtcttgaggattcttctgacacactagataatatcaataaagagggggaaatcactccccgtgattccctctccctttccccccacttttccctctctctctccctcggattcgtttggaaacactcccgcaaacttcgtcggcgcatcaatggcgggcggatcttccgcggccgattccccctcatccgttcgttctctcccccttccaacactatttaaacgctccccgtgcctgcctgcaccgtttccggcactcgccgctctctctccccgtcggaatcgagctcgcgcccgcgttatctctcttcgacgtcgcgccgagcttcggtccgccggcgtcgtcgcccggaccctctttcgtttcggcgt

SEQ ID NO: 35187 - DNA, 12801 bp, Oryza sativa
caagtctctaatttttctttaagaagccaaagaacaatttttgtgctttatttcggtttgtatatgaagtttagtaaagtaaagccttttctttccgtttggtcgtgtagacactcaagcttcggaagatcggctcttcgtgaaatttaaaccggcgtttgggaaagcaagcaaggcaagtcacatcatctttgaacatattgaatcccagtatgtaaaattatgttatttacttattgcattatcgctttatttaaattcccgagttatcactgttttatttagccatgcctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgatgacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcaagtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttagcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgcgtgtgctgggccttcggtgcccatgtaataaattaactatttacgcttccgcttgttaaactctgaattgtatcaacttttggtgtaccttgcctcctgggacaaggattaatgcacgcacataaggaacgctcgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtgggtttttctttctgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggactgtgacgatgcagagccccacgctggttgggaggtcactgcagtgatcctctctggctctcccgagcggacttcgctggcagtcaccacgggtggagattctttccccgccgcttgccagagcgccgctctcctcgccatcggcactcttcaccagcgatacccggacgagttgcagcactcgccctaccgctaccaccctcgccgcggaggagcccgcgactacgccaccttccgggatgctagctcggaggatgacgctaccctcgtgcacctggcgtgcatggtggaggcgtacgacgcggctcgtatcgacttccatcagatggtgcgccgtgggatggtcgagaacaacatgaagatcctggagctgcgtcaagagaatctgcagctcaagaaggacctagacgcagtggaggcgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccagcgttggtagcacggaggatgcgctgttgctcaccttccgttcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacctgaaggcagcaaccaccaccaccagggcagcccaccttcaccttcttcttcgccttcaccaccaccaccagataccaacgccattctcacccaaatcctcacccagcaggccaacatgatgactgctttcctccaccacatccaaaatccgccacaacataatgctccaccaccacccccacaacactctaaactcgccgagttcctgcgcatccgcccacctaccttctctagctccaacaaccccgtggatgcgttggattggttgcatgccgtggggaaaaagctggacactgtgcagtgcagcgatgaggagaaagtcatcttcgccgcccaccagctgcaggggcccgcatctctatggtgggaccatttccaggctacgcagccagaggggcaacctattacttggacccgtttcaccgccgctttccggagaacccatgtgcccgccggagtcgtggcccttaagaaaagagaattccgagagttgaagcaaggcaaccgctccgtgatggagtatttgcatgatttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtggcacaagcgccgcttggcgaatttccgcaaccaacagggtgctaaccaaagggtccgctacaccaatccctatccagggggatcctcctcgcagcagcaacaacaacagcagcaacctcgctccgcgcctcgacctcaattcgtggtgcgcgtcccacagccgcagcaacagcagagtcagcaagggactcgtgcgcctcgtcctcctacgccaactgtgcagcctggccaaggccgcagggacgcttcaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccatgtgacggccgagaaggtgttgacaactccagacgtaatcgttggtacgttcttcattcattccatccctgctaccattttgttcgactctggagcttcccactcgtttatatctgtgccattcgtggggagaaatcagttggggatagaaaggcttaggaaccctctgctcatcaccacccctggaggggttatgacagcaaagtattatagtcctgccgtccctatagaaattcagggaattccttttccctcggatttgattctgctagacaccaagaacttggatgtgatccttgggatgaattggttggctcaattccaaggagtagtggattgcgcgagacgcactgtcaccctgtaccgagggccggaacaaccgattgttttctttgcacccccaacctctgtcagaagttcagaacttcatcagataggactgtcagaaatccccatcgtcagagagttcggagacgtgtttccagaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatataggtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacatattcgtgaagaagatattccgaagaccgcattcaccacgcgatacggactgtatgaattcacggtgatgtcgttcggtttaaccaatgcacctgccttcttcatgaacttaatgaacaaagtgttcatggaatacttggataagtttgttgtggttttcattgatgacattctgatatactcacaatccgaggaagaccatcagcaccatctccgtctggtgttgggaaagttacgggaacatcaattgtatgccaaacttagcaagtgtgagttctggttgtccgaagtcaaattcttagggcacgtgatatctgctaaaggagttgcggtggaccccgaaacagtgaccgccgtcactgattggaagcaacccaagacagtcactcaagtccgcagtttcttaggtttggcaggatactaccgaaggtttatcgagaacttctccaaaatcgctcgacccatgacacagttgttgaagaaagaagagaaatttgtgtggagcccgcaatgcgagaaggcgttcaaaaccctcaaagaaaagctggtttcctcaccagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagcttgaaatacatcttcacccaatcggatctgaatcttcggcaaaggagatggttagaactcatcaaggattatgatgtgggaatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggttataattattaagtaacaaaaaccattatcaaagtttattaaaaagaacaacctaaaaataaatcctcttcctcctttgggccaagcccagcccaaagtctccctctcctccctctctttctctcttctccttctctccctcctcctcttgggcctcctcccctcccggcccactccctcctccctctctctcccgggctccctcgccctcctctcctcccgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtgaggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgccgtcctcctctctctcccgtgccaccggccggctccagccggctttccctcctcgccggagcgccgtccggtcgcgccgtcgcctcctccagcatcgcagtggcctccccttccccggcttggcctccgtttcccgcggagacccccggagctgcgttcccgccgtcgccctttcctttcctccgcgccggccgcctccagccgcctctgtctccctgcctgagcaccggtcgacgtcgccaccacctccctcgcctctgcgacgccgctctcatccccggcatcacctcctcctcgcccgaatttcgccggaacaaccgtgccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgttggtagtcgttcgcttgtgcgtgtggtgaccgtgttagtgtgcccgctcggtagccgcgtggtttccacgtgtgcagcccgtgtggtgtctagtggagtccgtttgttggcccctcgcctcggttgacacacggggtccgcttccgtcaacccgtggaccgtctctgtgtactcggtctaccgtggtcctttaggttgacatgtggggtccgcatgtcaacagcgcagccttcctgtcttttccaggctagcgcttccacatgttttatagttgcaaagcttaattacaataatccgcaaatctccatgtaacagcattaaacttcggatgatcatatcttggtcatacgaactctgaatcgacccgttcaagtctcttaatgtttgttataacctaaagaaccctgtgctttctttttatgtattgttattgcttctttataggcttgtagctttgcttgtgtgcttcgcgtagcttttgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgtttaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttatggtggaattggacatacccctctcttcctctttcaaagcccctaaaacctgtttttcggtggggtttgggtgcatgatagttgtgggaagtagcaccccggccactataaggattaagctcgggcctttgttgcaaagcactaccgtacttccacatgtctagtgggtaaggcttagtttgtggctcagtctggttataaacagaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaaatgctgtttactgcaaaacctaacccttatattattaccccttgtacccccttgcattaatcatgcatctgccggtgtggcttgctgagtactgtggttgtactcattcttgctcaatctttcccccccttcagtaagagaagctttggagatgaagtcctaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgtcaagctggtatcagagccatctcgactgtaggataagccaagtggataaaacctaaggacatattttataaatgaaactatttccgaaagtccctttttcctcctttcccctgtgctatttgcaaaatatttactctttcttccttcttcaaatttcaactagtactggatggttagttttgcgaagaagaagatgtcgccaattgtctgccgaagctccggaaggctgcaggatctgctagcgaagtggaggaagcagtgaagatcttggagaacccgtcgcagaacctaagccaccctctagggtagagtcgttagttgtgtgtttccttgcttgtgtgtgtagcgcgtggtttgcatctgtggggtgtgatgtaaccatgctaggttgtttgcttaatcaacttgcagaagaagtgaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattctgagcatgctgcttggttcacagttaccattagttggaagtcaagaccaaaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaaatgctttcctcctagcctttcgtaccacgtggggtcacgtactaagcaagccaaaagcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatctcggtgaggaagagatggaatcaaaggcatgcacccgttgtggagaaattggacacattgctagcaggtgtctcacactctgccctcattgtgaagaagaccatccaccaggggagtgtcccacccgcaaggtcacatgttttctgtgcaaaggtacaaaccatgtgcccaaggattgccaactcagtgtgttgttgatcaagaccgcagaaatccaacgaacaaccctacgattgtctcgtcagctagtcagctccaacagcaacatcgacgatatcatccacagcaccaatgctcctcctgctgcgcctgactctgcaacaaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatggttatggatgattcatgttgaggatgcaatgtaccgatgttaagcaccttccctttttgtttaaggcaaggccttgtattcatgtaataagggagacatgtgtaataaaaacaagttctatgaggattatttcggaagatgttgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacaacgaagcttcagatttggcaggataatgatcagacaataacaagtccagcagtaaagccatttgggaagacatcaaagcatgtcaagtgggataagttggttcttttagaaacataattcaaaggaaaagttaccgacccttgcatcgaatagcagaagtagctggcactcggagagcaggaaagctaatatgaggcagttggtgacaagttagaagtaaatgacaagcatggtaccctggtaatgacgagctgatctcgacacatgacatgaagtgggtaacttgtatgaggttgactccaaagatttgaactatgcgaagttctggaactgaagccccatcctcaagtgccgcaacccagtcgaagtcagctaaaggttcaaccagggacaagtcaggtgaagagaagattccatctgcaacaagggatcgagacaagcagcctagagtggagaagtttttctaggcaagtttgttataaaagacgcgacggaagaagtcagacaagaagagaagaccgcccaacctatcttcatgctagcctcctcgaatctccgggacgagattcttgtaaggggg

SEQ ID NO: 35188 - DNA, 13926 bp, Oryza sativa
cattcttgctcaatctttcccccccttcagtaagagaagctttggagatgaagtcctaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgtcagaattcactatcatcctggtaaggccaacgtggtcgccgacgctctaagtcgaaaaagccattgcaacactcttaacgtccgtggcattccactcgaacttagtcaacagatggaagccctgaacctaagcatagttggtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggactcccaaagacccaaggtgggtatgattccatatgggtagtggtggatcgattaaccaaggtagctcgattcattcctgtgaagaccacctatggagggaacaaactagccgagctctacttcactaggatcgtgagtctccatggcgttcccaagaaaatcgtatccgataggggaagccaattcacctctcacttttggaagaagcttcaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctaccaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtagcccagtcccggcagaaaagttatgcagataaccgtcgccgtaacctggaattcgcagtggatgattttgtgtatcttcgggtcacgccattgcggggtgtacacaggtttcagacaaaagggaagctcgcaccttggtatgtgggtcctttccgtatcattgcccgacgcggagaagtcgcttaccaattggagctgcccgcctccttgggcaacgtgcatgatgtgttccatgtgtcgcaactcaagaaatgcctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagccacctgggagcgtgaagacaagctgaaggcagcccatcccgatctcttcgccagttcttccgaatctcggggtcgagattccgtttaaggggggtaggtttgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatctttcctaaaagcctaaaatgcgtaaataaattttagtggaattttcagagcacaaataataattaagaagaaataaacaaagttaaaaaggttttataaaaagaaaaaaaccctaaaaagtctttttccctccccccttccccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgcaaccgccgcctcgcccgtgccctagcgccgccgccgccgcggattccgccgcatcctgccgcccccgcgcgcaataaagagggggaaatcactccccgtgattccctctccctttccccccacttttccctctctctctccctcggattcgtttggaaacactcccgcaaacttcgccggcgcatcaatggcggccggatcttccgcggccgattccccctcatccgtccgttctctccccctcccaacactatttaaacgctccccgtgcctccctccaccgtttccgccactcgccgctctctctccccgtcggaatcgagctcgcgccgtcgttctctctctccgccgtcgccgccgagctccggtccgccgccgtcgtcgccccggaccctctcccgtttcggcgtcgcctccttcggctccgccgcgacctcggcgacctcgtcaccccccccccccccccccgtttcgcccgccgaccgccggaacgccgccgtccccgtcgacccgagccgcgccgccgcctctctccgcttcggtcgccgtttccgttgtcgccgtcgacccggggtgagccgtggaccgccgtttcgcttcccccttccctcccttctctcgggcgccgctccgccgcgccggtggtcgccggcggcgaccatcggggcgcgggcgcgccgcctcccgtcggctctgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccacgtgggccccactcccgtggacccggtccgcgcgctcctctctcccggctgacgcaataaatccgattttaaattaaaatttaaatgaagaaagtcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgtgttatttagccatgcctatttacctttgttatgaccttattattattggtattgttattattaccttgttcaccctagaaccaacaaaaccccaactagtggacactctactcatggtaccactagtatgattttaggtagatgcttcgctttaattaggtaacattaggtggttttacaactctagactttgggaatattcatatcacctggatactttggaatggtttggttattgtggaatgggcttcacaccgctccttctattcaaaatccccaaaatggttttaggctgggctcggggtgcatggttttgatagtagcacctcagccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatagccgtactcatggaattgagtaccgggactcatatgacaccttggttagaaatctaaagtctatatgtttataaattcttgctataactcttccagattgcttattactgccttttgcaaagaaccctactatatgtcaatacataacatatttccatgatgacttgctgagtattgcgaatactcattcttgctcttataacccctttttcagatctggatcaagaggaggacccttatgactattactacgatgaccccgataatttagggaacccctaaaggttataccttcctagtcaaaatgtactaaaatttccgctgtgtaatattagtacttatgtaggtaagtacctacccttgtaaaaccctagcattgtaaactttaatgtatgcaattaagaaccagttatattgtatgtatcaacatctactgatccagggatcgattcattaattttagtcggatccaaatttttagtttcgggtcccgacattggttgaaatctatattgatgatgtggtcgttaagtcaaaggaaatagatgaccacatagccgatttgaggaaggtttttgagagaactaggaagtatggcctgaagatgaatccgacaaaatgtgcttttggcgtatcggctggtcagtttttggtattccttgttcatgaaagggggattgaaataactcagaggagtgtgaacgcaatcaagaagattcaacctccggaggacaagaaagagttgcaggagttgatcggcaagatatatattgttagaaggtttatacctaatttgtctggaaggttagaaccttttacacctttgttgagattgaaagccgatcaaaaatttacttggagggcagagcagcagaaggctttggataatattaaagaatatcttagttctcctccagttttaatccctccacaaaagggaataccttttagattatatttatcggccggtgagaagtcaatcggctcggtcttgattcaggagcttgaggggaaggaaagagttgtgttttatttgagccgtcggcttttggaggcagagacaaggtattctcctgtggaaaagttgtgtttgtgcttatatttctcttgcataaggttaaggcattatctattgtccaatgaatgcactgtaatatgcaaagccgatgtggtcaagtacatgttatcagctccgattctgaaaggaaggattggaaagtggatatttgctttgatggaatttgatcttcggtatgagtcaccgaaggcggttaaggcacaagctatagccgattttattgttgatcatcgtgatgactcaatcggctctgtcgaaattgtgccttggactttgttttttgatggatcagtgtgcactcattggtgtggtatcggcttggttataatttctcctcgggaggcaagttttgagtttgcctatactatcaagccctatgcaactaataatcaggctgagtatgaagcggttctcaagggcttgcaattgctcaaggaggttgaagccaatgctgctgaaattatgggtgattccttgctgttgaaattatgggtgattcaattagtaggagaatatgagtgcaaaaatgatatattaatggtttacagtgagaagtgccgagagttgatggatggatttcggctggtaactttgaagcatgtatctcgagaacaaattgtcgaagctaatgatttggctcaaggggcatcggaatataagccgatgatgaaggatgtcaaagtagaagttgccacaataacagccgatgattggagatatgatgtttttcgatatttgcagaatccgtctgaatcggcttcgcgaaagttacgttataaagctttaaaatataccttgttggatgatgaattgtattgttggacgattgatggggtattacttaaatgtttgagtgccgatcaagctaaggttgcgataggagaggtacatgaaggaatttgtggaactcatcaatcggctcataagatgaagtggttgctttggccatttagaggttgattctggggatgctataaaatttgttcaagagcatattatttatcgatttggtattcctcaaaccattacaaccgatcaaggctcgatcttcgtgtccgatgagtttgttcagtttgacgatagcatgggtatcaaattgttgaattcttcaccatattatgcacaagccaacgggcaaccgaggcgtctaacaagagtttaatcaagttaattaagagaaagattttcgattatcctcggcaatggcacacttgattgtggtcctataggatggcttgtcatggttcgatccaagttcctccttataaacttgtttatgaacatgaggctgttttaccatgggaagttagaattggctcaaggagaacggagttgcaaaatgagttgacagccgatgagtattataatctcatggccgatgaaagggaagacttggttcaatcgagattgagagcccttgcaaaagttaataaggataaggaacgtgttgctcgacattacaacaagaaagtggtgtccaagtcttttttcggaaggtgaacttgtgtggaaattgattttgccgatagagactggagataacaagtttggcaagtggtcaccaaattgggagggactgtttaaaatccataaggttgtatctaaaggagcttacatcctacaaggacttgatggggaagtttatggccaagcgctaaatggcaagtacttgaagaaataatacccaagtgtttgggttaatgcatgatcggctggtgttgccgatacatgatagccgatgtatttacatcgccttgagatggccgatattgctatatcgcccttagttgtttttatgttgtaatcggttgtgatttgccgatgtacaatggccgatattgttatatcgcccatagttcaatttataattttatcaatgccttcgtccttgtaaaattaggggggcacatatatagaaaagttgcaaatttgaatttttgagtttttgaggaaattttttgagcaaattgaaagttatattaatcggcacagcagtacagtgatacaaggagcattaaagtttgctagccgattacaaagataagttatcctattacaagaccaatcatccagacaaataacactggatagccgatacaacccgttgtctaatttgaactacttcttcgatggcttggatgtcttgggcgtcggttccagggatgattttgagggacttggtcatatcagccacattctttatagccgatttaagtatggatttatgttcttcgacagcatttggaagattggctaacttttgcttctgcagatccaactcagcattgcattcttcaagttgagctattagatcaatcttgcgggcttcaagccgatctatgttcgattgaatcggaccagtagagagttgatcaagcttggctttctcctcatgcacaagctgccgattggcttggatagtggcttcaatatcttttcgctcccgtcgatcagctattctttgcttagccttctccagcttgaattgatgttgctcgaggtatacagctggagtaatggtgttcgccagatcatccgggattaaggcttggatttcagcaaaccgtgcccggattgagccacaatcggccaccagattatccaatgatgactctagcggaagggatatgtcttcaagtgttttcttgatagtttcatccagagggtctagagccttgctagtggtttcttcctttgtctcatcaaagtaatcctttatatcaaaagagaacaaatcggctaaggcctgcaaaagagaaatccgaagatagttaaataatcaaacaaatttagccgatctaagatcttattatagagagaaacttactaggatggcaggagcggctggttgttcttcttcttcatgatgatgacttcctgtagccgatggggtacagtcacttgacatctgctatacaggtggggaaggaggagcaggaggctgcaaaaagacaaatgttaagtaaatatcagctatgatcggataaatggaaggatttatataggacaatcttaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccgatgccttggcctttctcttcctgccaacatcggccggttctctcatctgtccttgaagcagacttgaggtcttgggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatctgtcaaaattcctactcctgagtcttgccaactctatgttctcgatgctgcccagagggggtgatgtgcactagggttcccgatcttccgaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcacccattttagtgtagactggtcctggactccgaattgcacccgatgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatatccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacggctgagcagacaacaattttagccgatgcattgttcagcatttgaaacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacatgttctcgggaggtggcaggtcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgatacccgtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaacaagatgaggcaaggaagaaccaatctattgcgaaagaagaggatctagccgatgggtacttaactctgcgtattctgccgatggcgcgacggatggactggcggaggacgacatctttgcgggcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagaagaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgtttgggcaaaagtctgccgaaaaggattatggtatctttgtcgacgggtggcacccgtagaccggatatattgggtattggggtatgttggtacaaggatctacgtaatacgacatcaagcaaacaaaagacaaggattatactggttcaggccccttgacaggtaatagccctaatccagttgatatgggattatatggtggaaaacacaggttacaaagggaacaatggaacatgacggatccggcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcagaaagtatccgtatgcgcgtgggtataccataccgatatgtgacgtatatcgaagggtaaagggtatgcctaacccgtaaccctgacagtagcccccgacttctgcttaaaatgagttcgtgtaaccgttcacaacttctagcgtcgagactgttgtcgttcccagtgcgaggaccgtagagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataaaaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcagcaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattatgaacaaccaatcccggctgcacagttctatctccaaaccaggagctaaacaagttattaacatcatcattt

SEQ ID NO: 35189 - DNA, 17327 bp, Oryza sativa
cgctggcttgtggttggcacggttaatgtttcacagcgaaaatcgtgaaccggtccttaattgtcatgagcacaaccatcaaaaccatatgctcacaacccaccattatcaggttttggttggcaagttaattaattatcaatcatgattaaccatcatgagctatcattaagccatcattaaataatagtgaagcataagttatcccaatagtgtgctaatgtttctaagcatggctaagcacttatatctaatatccagctgaacccatatataaagctcaactagtcaagttacaataacccaaggtatcaaggaataaagtaatgaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaattcttttcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagccaagatgaattagttatgaattttcaaagattaaatcggattaaatcatttatatagattttaatggaattatgacgcaataatgaattattttttaaaaggaaaagatgattattacgtcagcggctagggttcacggtggaccgggtgcacggcgggggctcacgaaaacgaacggccgagatctaaccctatccaaacagacggccgagatctaatgggtctaccgcggctcacgggaagcgacgatgatgacgtcggcgatgacgtcatcaccggcgacggctaggatggtgcaagctcgccggcgaactacggcacgacggcgctaacgaaaggcatctaccggttgcggacaacacggcgaactcaccggtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccctagtcatgagtgggtaagaaagctcatcatttagtccttccaagaacttctcttggcgctcttcatcagtgcgcacatcttccggagcataatgagccagacgattgaactcgtgaagatactcagtgaccgtgcgtgaaccctgagtgagcgacctgaactccttcttcttgagagacaccactcccgatggtatgtgcgtcttccgaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgttgttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcgaagttgattaaaggctcgttcggtgcgtccccatcgtcttgagttggtccccactcgatcttggaatgggtgcgcttggattcttcttcatcatcatcactcacattgacgaccgaaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccagtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaacaggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcataacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactttaattaataagcgaataaaatgtcattacagaggtagatagttcctctcaatcaaaagaaacagcgcaggcgactcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaaacagttaaataataattaaacaatattaatccaacgctatacaacataccctgttgcatgggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcacggctattcgaatagtttaaactctggccagaggtgtaccactatacccacaagacacaacctcaacatcatgtcaaccatgcgtcgcgatacttgacaagtacccgaatagagattgtgacaataccctctatataatacaattcaaagcaatgcaccgttcccgcatcataatcacccccttataaacaaggtatggactccacagcgacccccgtgggcttatctccgccacttcatagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttggttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagccaagatgaattagttatgaattttcaaagattaaatcggattaaatcatttatatagattttaatggaattatgacgcaataatgaattattttttaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgcctgagaactacggcacgacggcgctaacgaaaggcatctacgggttgcggacaacacggcgaactcaccagtgaccaaagtagcggcggaagatcaacggacggtgacggcgacgaggttgatacggcggtgaccttcggcttgacgacgacggcgatgctccggagacctacggcagcgacggaggggcggacgaggtcggccacggcttgtgatcacgatggcgaccttcctgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccaaatcgagctcaaatccgatgatttccaaagcgatatagacgatgcttccaaaaggaaaaaggtagaggagatctcggggatcctttcccctcaatcaatttcatcggatcgggaaaggggcgacggaattggaagggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagaggggggggttttgggccgaagccagaagagaactttttaaaacctttttcaatttaaattattcatgagatgcaattccatttattaaaaatacttccttagctcaaataaatcccagaaaaatctagggactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgccttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttgaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgtttcgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccggaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggtgtcaacccccttggtaagttatcctgtcgtcagatcgtacagccagaagaattacgccttacttcgcatcgaccgtttttcaggcctcggacgcgtctcccccgccttcacgacgacaacgtcttgtgacgattggcgagaagtaagtagacgaatcttaagcttccgtgattttattcgagtgttgtctgaaccgtggtcgtctcacagggcggcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctgcaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgaaaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgcgtcgcccgacaatgtggaccagacccttgctacggggacggagatggcgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagttgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatagagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcctggttaatacgcacggcgagaacccttacacgaccagatcttacatggtctttagtctctacaggatctgacaaggccttatcggctctgggcgtccccagccgaagatcccttaggttcctcggaggccttgtcaagatggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgattgccgactgctcgaacggcaactcgttcgcgatgttcctcgagtagatttacatcgacgtttcgctgttcctcctagtcctcgtaggagtgcttctgtactcgtgtactcggatgtcgtagctcgctggggagcatggcttcggagtcgtacacgaggaagaagggtgtttccttgttgtcggtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcagcctagatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccaatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgttggcaacggcgcgttctgcttttgtggcctccgagctaatgtcgggggtggccgagctgacttcgccgctaacctcttttactgatggcttcgtcaggatgtccagaaaagtgccgggctcgagcggttgtcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgactgcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtctgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccagaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgtgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctgatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcctttcggtcccggcatcttgagcacttgatacgcgtagtaagatccggccatgaacttcgcaagtgcagttctcccgataatggcgttgtaagttgtatgaattcaacggacatcaaaggtgatctgctctgttcagaagttgttggcttgcccgaaagtcacgggcaacataatcttgcccaatggtctgtatagtccgactaggtatggaatgtcatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccggacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaacgtgtttttcaatacgaatacaacaattctatgtatatattactagtcatcaacctgtgcacttgcatgggctagaaaaattacgtgacatcaattaactagcatggaagctttattggtgcctccaattactgaatataagattttttctttctttctcaattctttcggtcaataacgagcatgtgtgttattcatagaaacggaggtaggtagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagctagccatggtactaactcgtctactacgccatagtatgctacaaacacaactaagttatcttatgaaggactactcaatagtacacataaaacaatgttactcgttgccttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcagaaaaaaaacgtgtctaaggtcagaaaaaaaagtacgaaaaggagaaaaaaagagctcggggaggggatagccggcatgcgcgccagctaaattgatttagctggcgcgtacacgcccattagcaatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtaatcatttgcctggtcatcttgagcctcactgtcgactccgccaccgcagcacagtgcggctgctgcatatcctctcgggcaaaagcatgttgtgttggttgtattgctgctggtggctccaactcagtctgcaagaacacttgtcgtttcccatgtattctggccgattctggtaaattcactattgtcactcttttcaatgcatttcttatatgtagatacagactttgtagcatatcgtggactaatacatatgtgtggccttccatgcattttcctcaatatagtttgttgacttcacttcccatctgacaacttcaggcatatatcttgcaacatgaagacattttatgctctacttccactacaaaattaattaactaatgcgctaatgtgatttccatattttaatttcacagttgttgctaagatggacgaaatgggagttcttgctaagatggaaggacaagcctaaaacaacctactcgcattgctaccagtcttaatgcctttcataagaatatgttgttttgcttcaagttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggctatagcactatccaatgtgtcatctgttggtctctgaccttagcaatttaatgcaacatgattattattatttgtgtgtgcatgttctttacttaatttattcttagcgtatttctgatg

SEQ ID NO: 35190 - DNA, 2511 bp, Oryza sativa
ctgtagttaacaaaggcatcgagcagtagttcgatacaataagattcatggcacccccaaaaccccatccattctaataaatatggcacgcatgtattttaagatttatctttgaccaagaattagtttaaatttacaaagatatttgatagaaaattagcatcatttcaacgtgtttttcaatacgaatacaacaattctatgtatatattactagtcatcaacctgtgcacttgcatgggctagaaaaattacgtgacatcaattaactagcatggaagctttattggtgcctccaattactaaatataagatttttcctttctttctcaattctttcggtcaaaaacgagcatgtgtgttattcatagaaacggaggtagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggactcacatggcatgcaagccagccatggtactaactcgtctactacgccatagtatgctacaaacacaactaagttatcttatgaaggactactcaatagtacacataaaacaatgttactcgttgccttttaccttcatttgacgggtacgagctaagtgtatctgaaaatcttctcttctgtccatcggcgaaagcgtgcaaatgtaaaattgcctggtacgcaggactagatatgaagagtttgttcagagattgtgcaataaacatgtacatccatcaactatatacatgcataggatatatacatacaatggaggtagccatttgcaccatattcacaatatacaagtaggcagccattcacaccttatccataccaggacgatccatttgcaccttatccacatcatcacataatgcttctgcctataaatagcagcagcaccttacattcaagaatcacctctcaacacacaactaagaaacatagctagataaccaggggaggtagcatcagcaacaggaggcaatggaaggaaagaggactaccacttcgatggtaatcattggcctggtcatcttgagcctcactgtcgactccggcacccaggcacagtgcggttgctgcatatcctctcgggcaaaagcatgttgtgttggttgtattgctgctggtggctccgactcagtctgcaagaacacttgtcgtttcccatgtattgtggccgattctggtaaattcactattgtcactctattcaatgcatttcttatatgtagatacagcctttgtagcatatcgtggactaatacatatgtgtggccttccatgcattttcctcaatgtactttgttgatttcacttccaatctcacgacatcaggcatatatcttgcaacatgaagacatcttatgctctacttccactacaaaattaactaatgcgctattgggatttccatattttaatttcatagttgttgctaagatggacgaaatgggagttcttgctaagatggatgaaatgggagttcttgctaagatggaaggacaagcctacactacaagaatcaatttaatctgtgacgaaatttgacgaaattttcgtgatgttttcagatatcgtcacggatatgcaactatggatacaaggcccataataccgtgacagtttatcgatttcgtcataaaccggcccaaaacctgtgacgttacagtaatttcgtcccggtttacaaatataatattaaatacttgaaaaccatataagagatgtaaattttgtgaataatgttactatcactttatcggatgaataaatgaccaaaataaaagttatagatattgatgagttgtacaacttttatgttgatgactttttcagttgaaatcatttagtatttgaaaataatattgtttgaagttgtcataatttgaaattcaaattcaaattagtgaaacagagtcatataccaaaatgaccaaaacaaaagttatagatattgatgatttatacaactttgttgttgatgactttttcagttgaaattatttagtatttgaaaatgttgtttcaagtagtcataatttgaaattcaaattcaaattactgaaacagagtcatatagcaaaatgaccaaaataaaagttgtagatattgatgatttatataactttgttgttgatgactttttcagttgaaatcatttagtatttgaaaatgttgtttgaacttgtcataatttgaaattcaaattcaaattcaaattattgaaacatagtcatatagcaaaatgaccaaaacaaaagttgtagatattgatgatttatacaactttgttattgatgactttttcagttcaaatcatttagtatttgaaaatgttgtttgaacttgccataatttgaaattcaaattcaaatgatttaaatggagtaatatagcaaaatgaccaaaaca

SEQ ID NO: 35191 - DNA, 781 bp, Oryza sativa
ttctctacctaatcaatccattttctttgtttctattttggcatagatcgaacacttggtggtatgctcgtcagcgttcccggtgtccagagcgccgccatcgccccacttcgtcgttcccatcgactcgaaccatccctggctgagccattgcgccaccgacgtcgcctaggtcccaggagaaagacgccaaaatatgatcaagccaatacgccgccgcgaatgccatcggtcgccgttgccctcctattgcctctgctccccagcaaccaagtcaccgacatgtgggccccggctatttagccacttcattaggcgtaaggtctttcattactagaaatttaaatcttgtaaggttctttttgtaaaattgctttgtatgccaagtgggcctatggacctaaatgcaattcacctaatgccaatggacctttttgtatagggtttagggtaggtcctaaaccctacatagaaattactatttcatgcattcattacttgatataatagcttgataagtatgttgtactcagccttgctttaaccctctctttgagaatcaatttggagtttttgctgaaaccgtgagttaaacatataaattagtttcattccaacttagttcccaagtatagattagatagatgggttaattctatagccaaacattagaagtggctcatctatagcttctacaggaatagatagccacaatcttgtaaataccctatattttatgtaaagaaatctctttggagcctggtcacatgatgctatgaag

SEQ ID NO: 35192 - DNA, 1254 bp, Oryza sativa
gagcacggtaacgaacattcttctccaaaacgcccatgtacttctagaaaaaaaacatgttgtgtagtaacacaggccgagaataccgatctctttgacagggtgccaaagcagatgcatcattatattgaaaaatgaaggtggaaatattaactcaaagctgacaagacattgcaccacatcattttgaagggcttccaatctatccggatcgatgaccttctgcgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtggaggacgtccaagaattcccaatagggtaactcccaaaatatatagttcttcgctatcaataggctggctgccaggcccctttccaaacactactttaagatctttcaccatagcaaacactgttttcccactgcgatgtttaggcttcgtacggtggtctgccttatgttcaaagtgattgcctttcttccgtacagggtggtttgcagcaaggaatcgacgatgacccatgtacgcaaccttcctacagtgcttaagatacgtactttctgtttcatccatacagtgagtgcaagtcttgtaccccttattagactgcccggatacgttgctaagtataggccaatcgttgatggttacgaacagcagcgctcgtaggttaaactcctcctgtttgtcctcgtcccacacggggacaccttctttcttccacaacagtttcagatcttcgaccagtggtcttaggtacacatcgatgtcgttaccaggttgcttggggccttgaataataatcagcatcattatgtacttcctcttcatgtatagctagggggaggttctagatacacatcgtaacgggccaagtgctatggccgctgctcatctctccaaaaggattaatgccatccgtacttaaaccaaaccgtatgttacgtgcgtccttaccaaagtctttaaatgttctgtcgatgtttcgccactgcgaaccatcagcggggtgtgacacagtatcccgtcctgttgatgttcctcagcgtgccaatgcatcattctagcacttccccttgctcctgaaataacgccttagccgtagtattatagggaaataccacatcaccttaggaggaattctctt

SEQ ID NO: 35193 - DNA, 8703 bp, Oryza sativa
cgggcaatttgtttccctccggaagaatgttcttgacgagtttcaataaatcgccaaatgccttgtcactaacattattttttgccttccattgcatgaactcgagagtggtatccaactttttgtgcccctgctcggaacctgggtacaacgacgttctgtggtcctctaacatacgcttcaatttatgggcctccttttcactttcacagtcctccttggcatcctacaacatctgaccaagatcatccgcagcgtcgttattattagcatccctgtccacctcgcccgtttgatttccttcaaatccagcgtattgagcccagtccggaatgttctcgtcttccacttcatcttcttccatctcaaccccttgctcaccgtgggatgtccaacaattatagcttggcatgaaccccgactgaaacaagtggaaatgagtagtcctggatacataatacttcttctagttcttacacttattgcatggacaaccaataaaacccttatgcttgttagcttcggccactctcaaaaaataatgcaccccgtcgataaactatttggaccaccggtcagcgtacatccattgccgatccacctacatgtaatgaaaaaaagtcatacataaataaatattcataaaataatgacagtcatacaataatgatcaaataattaaaaactctttcaatagtcatacaataatgacatatcattattcatacaataattataaaataatccaacaaacaattcttatttattatttttgaatttttaaactaatattaatgttgtacttcttttaattttcaatttagtttgttttctattttccatgattaattttcattatattttaaactatgagaataaaacttttttaaataaacaaacaaaattcctatatattattcttccccacacaatttgtttctctcatcaacttacaacaaagttttggagacaaaaaatgtgtgaaacatagctccaaaagtaatataacaacaaaaaacattggaggatgaagttactaaccttttagacacctccgatttgtatataatcaccaaaaaaaaaattcacaagaaattttggcatgacctcccctcttttttggagaaaatttgaagcttgctcgggctggaggaggaagaagacatatataaagagggagataattagtcccggttgatgttatcaaccaggctaaagatcgccgagatctttagtccctgggggtctgacaaggcctaacatctttagaaccgagactaaagatgatcttaccaaccgggactaaagatcatatatgcccgctgtagccaccaaccgggtttttagtggaaccgggactattgtggatttcggaactatgataagatctcttgtagtgacggcttgtttggctattagagaggcagtttgagacatacggcacacagtttcataccgtgtgcgtgccaagttggcaattggatcctagtagcagcaaattttgaaacactcaacccaacccaatccttcttctcttaatcttctcttcctactcttgtgtttgtgtgtgtgtaagaggctagtagagttagctagcctaattttttttgcacgttgcagctactagctgtgctgctggcttgtcgtcctctgcttcaactttaaagagagagctaatagatcggtgatccgcttgggtttctggtgatcatatgcaacatggactagctacttggatttgttcaaaggatctgcttcttggatgctgtccggccacgtcgccatgcatgcgaattttgtggatggagtcaaaagctgcatgcacggagctgatttaattaagggcatgttcacattgtagtcaaaataaaccttaccaagtttttagcaatgccaaaattttggcaggatttcttatgtattaaccagatttgccaacaactaaacgtagatattttttggtaactttggcaaaaaatgatatggttgaaaatggcatcaaagtgaacatgccctaattaatttgttgacagctactccctccattccaaaatataaagtataactacccttaactcaaagaccaagaaaaaaatattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaacatctaagaaaagtggttgtgccttatattatggaatagagggagtagtacctaattaagcacgtgtgttaatttattattaactagtaatctgcccgtgctaatgctacggcgacattcagaaatacaaattaagatcgatggatatagttattatgttgttaattaaattgccacatgcataaaataacatagttattatcctggttcaaatggagtcattagtgacaacataccatggtaaaagcaaaagtaattaaactttggaacttggcaccttgaagcatcaaatccttgtctaccttgctgtctccctgtcaccccggccccacttaattctaaattaaatggatgagagaaagagattaatatagtttagtgtgatagtgccaacacatggaaaatttagagcttctagttctctccttctacatctctcttaaatgtgggaccaagtccttatggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctgcaaacaaccttggtgaatcatctctttgatcctaaattatattttcaaagagagaaagaaagagagagagggagtgaaagtccaatttacacccaaacttcaccatacctctcatcttctcataggaaacatctacatggggccactagacagccactcatacttggttgagtgaagtacaagtgggatcacagcctcaaaccactgccaactcctttaaatcgtttctacccctcatgttgacaactagctctcactttgcacctttacttttaccattcactactacaaccaagatttttgtgtgagggctaaaacgatttttccgcgcgggtaggcggcccgcacgcacctaggggtctgggaaaatgatgatttttgcgtgcgggtggtgcacccccacgggaaaacaaaaatccgaaataacatatttttttttaaaaaaaacgaaaccctagaatctggcggtgggcttccgcccgacggccatagtgccgcctgcctcccgccggcctccccgccacccgccgtgggatccgcgctcccctccggccgcaacgccgccgtcgcccctcccctccgccggatctagggagggaaggaaggggagaggaggggagctggatcccacgtggggagaaggaggctggctaccggatccgtgcggggacggctaccaccgcaggattcttgcattgacggccaccgccgccggatccacgccctccaccgccgccacgtggaggaggccggcacgctcctactcccaccgccgccgcgccgctgctgtcgccgcgcgccgccgccgctgacgtcgtcggcgttcccggtgtccagagtgccaccatcgccccactttgccattccagtcgactcgaatcatctcctgctgtaccattgcgccactgacgtcgccttggtccctggagaacgacgcccacatatgatcaagccaatacgccgccacgaacgctgtcggtcgccgttgctctcctgctgcctctgcttctcttgccgccgagtcaccgacatgtgggcccggttgtttagccacttcattaggtgctaaggactttaattagtagaaattgaaatcttgtaatgttctttttgtaaaattgctttgtttgccatgtgggcttatggacctaaatgcaattcaactaatgcctagggacctttttgtatagggtttagggtttaccaactcgacccgaacaaagcctaatcctcctgatcatcaccttcactgaagcactcctcctctgaagaatgaatattgcaagaatgagcatatgacatactcaacaagccacacagcaaatatgcaagtgcacaggataacaaaggatggcataattaagctcatttgcataaacagcatttaataaacatttgagagaatagtaaaacagttaagtaattaagcaatattaaataaacactatacaacacacccattttgcataggcccaaccttatctgaacaaccaacccctgattgtacaaatcaaacctccaaaccaggaatataccattccaaaccaggagtcaatttagttatcacagtattttcattaatagtgagtaatgtgagactaatcacgaaaaatattgttagacccacccataaccgcgggcacggctattcgaatagttttacactgatcagagatgtaccactgtacccacaagacacaactccacaacatgtcaccatgcgcctcagtaccaccacggtaccttggaaaagaactgtgacaatacctctcacacaacacaactcaccacagtgcactgttccgggatcatagtctccccctcataaccagaggcaatggagtccccagcgacccccacggacttctcgctgcttcacagtctggcacccccgtaatgaatcatgctatacaaaaggtaaagccgttgctcacgctggcttgtcgttggcacggtaaatgtttcacaacagtagctcgtgaaccggtccttaattgttatgagcacgaccatcaaaacgatgtactcacaacccacctttcatcaggtttatgtatcaattaattatcataacacgattaaccatcgtaagctaccactaaatataaccataagtaatatcgtaatatgattaaccccattggtgagctaatgtttctaagcatggctaagcaattatacctatatagcacttagctgaaccaaaccaatacataaggtccaagctattcaatttattacccataggaaaataaagtgattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatccgagttacgatgatttagttatgaatttccagagtttaatcgattttcaactaataaaaaaactaataaaaatgatttatgacgtcatcgatgacatcatcgccgggcatggcacggctccacgtgaccaccggcgatagagagctcggttgggctatccgaggacacctacgcgaagaggacgacgacgcgaactcaccggtgcaagaaactacgacggacgacgacgtacggcgaccggcgacgaggaccaacagcggcacggcttggcttgacgacggcggcggcgttccagtggcttgcgacgacggcgaaggggcagccaaggtactcctccaccgtgcgaacccggcggcggcgacggacagcgacggaggtgacgctagcggcagcgcggcgtgactggagagtcgccagcgacgacggcggcttgagctacgcggcggcggcgctacgagcaacggcgagacacgggacttggggcaaatggaagaggacaactaggggatgctttatataggcttggattagagagatcggactccaaccgagaggaatcgagctgggaaaaactagggttagttaggagagataaactcaaaacgaattcgatttggtttatccgggcaaaattgatctccgaaactctaggggaaagggagaggataaggaggagatgatttcccctcaagcaatcggactcgggggcgaccggttgaggaggaatcgaaggagaggcggcggtgctcgggctcggctcggcccagccggaggtaggggatgaccccgacatgtgggcccccatgtcgatggctagaggagaggagggacggctgggcttggattgggccggcgtggctgcacggccacgcgcgagggagagggatgttgcgccggaaacggccaaacggcctaggggaggattttaaagactttttcaattaaaataattcgtgaaatgatgtttcatttattaaaaatacttcccttgctcaaataattcccagaaaaatctagaaaaatagataaccaagcaaagtatttaataaatttttatctagctcaattttatgttgaaatttttcctagattattagagtttaacttgtaggtttttaaaataatttcaaaaaatgcattaaaaattgaattattaaattaggcgattttcagggcgtgacaaacctaccccccttaaacggaatctcgtcctcgagattcagaagaactggcaaaaagatgaggatgagttgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttctttaactgcgacacatggaaaacgatcatgtattccctccattgacagaggcaactctagttgataagctacttcacttcttcgactcacaatcttaaaaggtcccacaaaacgcggtgccaatttctctttggtctgaaaacgatgaactccccgcagcggcgtaacccgtaggtatacataatccccttcttcgaaagtcaaatccctacaacgattgtctgcatagctcttctgacgcgactgagcaactcgcaacctttcttggataatcttcactttttcttctgcctctcgcaatacatctatcccaaaaacttgacgctcaccaatttgatcccaaaggagcggtgtacgacacttacgaccatacaatgctttgtatggagccatttgaagactagcttgataactgttgttatacgagaattcagcatacgacagattcttatcccaacttccaccgatatctagaacacaggctctcaacatgtctcctagaatttaatttactctttctgtctgaccgtcagtttgagggtgataggcagtactgaaattcaaacgagtacccatcccttcttgtaagttctgccaaaacttcgaagtaaactgactacctctgtctgacactattttcttgggaacgccatgtaaacatacaactcttgccatatatagctctgcgagcttatttcccgtgtaggttgttttgacgggtatgaaatgagcaactttagtacgcctgtcaaccactacccaaatagaatcatgtcctgccgacgttctgggtagaccggtgataaaatccattcctatttcctcccatttccactctggaatcttcaacggttgcagcagaccggctggcttctgatgctccgccttgactcattgacacacatcgcatagagccacatattctgctatctctcgtcgcatgctggcccaccagaattgttgcttcaggtcttgatacatcttagtgctcccgggatgaatggaatacaaagtttcatgggcttctttcatgatagtatcctttagctccttattatcgggcacgcaaattctttctcctagccacacagttccttgctcatcctctatataaccgatggctttacctcttctcatgttctttttgatttcttggatatcaggatcattcacttgagcctctctaacttgatcaaaaagagtaggctgagcttctaaagcggcaacaaaacctttgttgactattcccaagttcaacttttcaaattcctcgcataactcccaaggtaggtgtcgaccttctgacatattacagtagcttttcttgctgagagcatctgctacaacatttgctttacctagatgataatccttgatcaactctaaccaccgtcgttgacgcatgttcagatcaggttgagtgaaaatgtacttcaaacttttgtgatccatatacatctccgtacggttaccaaaaaggtaatgacgccaaatcttcaatgcatgaaccacagctgccaactctaggtcatgcgttggatagttattctcgtgggggcgtaactgtctaggcgcataggcaatcaccttcccatcttgcatcaaaacacaacccaaaccatgtctagaagcatcacaatacacctgaaaacctttccttggatcaggcaagactaacactggcgcagtcactagccttttcttcaattcttggaaactttgttcacactcttccgttcacttatacttcacatccttctaaagcag

SEQ ID NO: 35194 - DNA, 2789 bp, Oryza sativa
tgttgttgttgtagaactggcgttgagggcgagcaactgaagaggatcctccctgtgggtatggtgcagcttgaggtcccaaagcaatgcgtgcctctggctacaaccctgttgagccttgaaatgagcagccctacgctttttctgttccatcctattatacttgtcttcttggcgaatcgccttgtccaccaactgctggaaattccggtaatccatagccatcaatgcataagacaactcatcattcagtccctctaaaaacatctcatgacgttcttcatcagtgcgaacatcttctggggcataacgagctaagcgattaaagtcatggaggtactctgtgacagaacgggatccctagttgagtgctctgaactctctcttcttaagggccacaacacttgatggtatgtgtgtcttcttgaaagcagcagtaaactcccgccaagtgataggctgtccctcggctctgtttagacaaaagtggtcacaccgctcagcagcaggaccatgcaactgatgtgaagcaaaggaaaccttctcctgctcggtgcactgaaacaaatccaacttcttttccatagcattcagccaatcacctgtctctactgggttagtggtgcttgagaaggtaggtggtctcacacgtagaaaatctgccaacttgttctgcggaggtggtggtggttgattcttgttatttgcctgctggttctgcgcttgctgcactaacagattaatcaactgggtttgctgggccaaaacttgggcaagtgtgggatctccttcattgtgaccatttccacttccagtgcgggtgttcaccatctgaagaaaagcatgggcaaaatgaaagaacgacagagagatacccttagaacggagaactttaattaatttaaattctatattgctcttaactgtgtatgattacatttaaattgaattaacactatctcaccagctaacttactctctgacaagcaaaacaactaaacttatgtagttacatcccaccaatgatgtaagcaacatgctaaacccacacacgcacaagcaatcttaagcaagcgaactaacacagcgaactacggcaacggtcaaactagacaacaactctcgccttgcgtcggaacgaagagatggatcttcctcctctggagtagctggctctctttcttctgggtcttcctcttcttcctcatcacttaagacatggatgacaggttcagcatgatcaggcacagcgtctcccaccacacgagtcttcgaagctaactggagacgaggtggtggacgggttctcttccttgcggtgaggcgaagcttgggtgctgacggtcgtgcttctcccttaagcccagctagttccttctgcagacggtacaccttgctctccaacttacaaatcctgccacggttccagttttccctatcatgagctgctttctcccgctccacgcctactgcatccatggcgctaagcatatacacggcgtgcatcacaatggcgctaccttcaccttcgggacagttgtaagttccatagtcttgaccatgaggcttgtgtgggtgatactggaaagctgatgactctaactcctcatccaagcgatgacgtagctctccaatggccaccaaggctgcttcttgacaagcatggctgtactttcttcccccagcttcaaactttatcgacggaaggtcttcacgatcactagtcaacgtcacgcgaacacgacacttctcctcgttggggtcatggggaatctggtgatacttaggggcaacctcgtaacctacttcaaatgccatcattctcagcaagcatatgacatactcaacaagccacacagcattaacgagcatatgatatactcaacaagccacacagcagatatgcaaatgcacaagataacaaaggatggcataatatgacatacccataaccgtgggcacggctattcgaatagttttactctgatcagagatgtaccactgtacccacaacacacaactccacatgtcaccatgcgcctcagtaccaccacggtaccttcgaaaggaactgtgacaatacctctaacacaacacaactcaccacagtgcaccgttcctagaacataatctccccatcataaccagaggcaatggactccccagcgacccccacggacttctcgccgcttcacaggctggcaccccgtaatgaatcatgctatacaaaaggtaaagccgttgcccacgctggcttgtggttggcacggtaaatgtttcacaacagtagctcgtgaaccggtccttaattgttataagcacgaccatcaaaaccatgtactcacaacccacctttaatcaggtttatgtatcaattaattatcataacacgattaactatcgtgagctaccactaaatataaccataagtaatatcgtaatatgattaaccccattgatgagctattcaatttattacccataggaaaataaagtgattgtcggccattaattaactgggaatggctcaccacccgacgacattcgaaaataatgcataagttgaaataaaacattagctttaaacgggttcaacatgctcaaagggttgtttcggatctgtgtgacttgccttgagcttcttcaaacacttctggacctttctcaacgtaacgctctcctccggaacatcggaaactaaaagcaataaccaaatcaacaaacagttcaaaaacaagaataacagtacatgtggatattttaacatgtagatcttgattttagatgaa

SEQ ID NO: 35195 - DNA, 11941 bp, Oryza sativa
cgtgaaatgatgtttcgtttattaaaaatacttcccttgctcaaaaaagtcccagaaaaatctagaaaatagataaacaagcaaagtatttaataaaattttatctagctcaattttatgttgaaatttttcctagattataggagtttagcttgtaggtttttaaattaatttctaaaaatgcattaaaaactgatttattaaattaggcgattttcagggcgtgacattgatatagtttaaacatgtaggttaccgaatctttaattttgggacccgacaaggtgtgtgggtgggggcccctgcgatttgggagcctagagcggctgtaccgctcccccctcccaagcttgccctgaatacatgggccttgaaaggccacatggaatcttatgacgatttctgggcttgatggcgacgaaaatggacgtcatagactctatgacgacagaaggatcgtcactagattagtaacaaaaagataagctttctttatagaatgccattagagacgcatgataggtaacgaatgatattcgtcacaagaatgtcacagagttcacaacatagtgaatgatctatatatgggcctatttgtcgtccaaatacctacaaacaaccttggtgaatcatctctttgatcctaaattatattttcaaagagacaaagaaagagagagagggagttaaagtccaatttacacccaaacttcaccatacctctcatcttctcctaggaaacatctacatggggccactagacagccactcatacttggttgagcgaagtacaagtgggatcacagcctcaaaccactgccaactcctttaaatcgtttctacccatcatgttgacaactagctctcactttccacctttactttcaccattcactactacaaccaagatttttgtgtgagggctaaaacgatttttgcgtgcgagtaggcagcccgcacgcacctaggggtctgggaacatgacgatttttgcgtgcgggtggcgcaacccacgggaagacaaaaatccgaaaaaacttaaatttttttaaaaaaaacgaaaccctagaatccggctataggctttcacccgccgcccgccggccatagtgccgcctgcctcccgccggcctccgcgccaaccgccgtcagatccgcactcccctccggccgcacagccgccgacgcccctcccctccgccggatctagggacgaaaggaagaggacgggaggggagctgtatcccgtgcggggagagggcggccggccgccggatccgtgcgtgtacggccgccaccgctggattcttgcgttgacggccaccgctgctggatctgtgtagggacggccgccgcccgctagatcccacgccctccaccgccgtcacgtggaggaggccgctactcccaccgccgccgcaccgctgctgtcaccgcgcgctgacgccgctgccgccgtcgggaggagaggaggggagagtggagagagtggagaggagatgcaagagagagagaggactgaggagaagctctacgtggaaattttaaagtggaaaaagggatagaggggaggggagaggagagaaagaggaaaattttaaagctggtgagaggggaaagagggagttagtatttttgcatgcggctctctcaataggtccgcacgggaagatcggctcattttcgcatacagtccatttaagaggaccgcacggaaaaatcgatttttccatgccatcctcttaattgaaccgcacgtgaaaatgagccgattttcctagaagcaacgagttaccgcccctacggaatataaaagggtccctgtccaggaaaatcgtttctatattagtgattcgagaagttccttctctacctgatcgatccattttctttgtttccgttttggcatagattgaatacttggtggtgcactcgtcggcgtttcgagtgtccagagcaccaccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccattgagtcaccataagtgggcccgagtgtttagccactacattaggcgctaaggactttaattagtagaaatttaaattttgtaaggttcattttttaaaattgctttgtatgccatgtgggcatatggttctaaacgcaattcacctaatacccagtgacctttttgtatatggtttagggtaagccctaatccctactcagaaattactatttcttggatttattacttgatataatagcttgatgagtatattgtactcacccttgctttaaccccctctttcagaatcaatttggagtttttgccgaagccaggagtttaatcatataaattggtttcattccaacttagttcccaagtatagattagatatatggtttaattctatagcaaaacattagagttggctcatcctatagcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttggccagcctagtgcggctgtaccgctcccccccccctaagctggccctgactacaagggccataaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttataacgtaaataagcgtcacctataataagatctcttgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgccatgcatgcgaattttgtggatggagccaaaagctgcatgcacggagctgagtaggagacgacgtagacagatctgcacatcgtggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgttggatttacatgaaaaatacgagacagacaaaaatgatatctttcggttctaaattaatactcccggccatttgagagtgtaggatggtaaagggcctttcccaccccaaaagctagccattgaggtgaggggctcccccacttatatcttaggtcctttgcccttccacaaccaatgtgggactattcaacaatctcccccttcacacattggtgcctctcagcccttcaccgccccttcaccgtatccgggcccccaccggcccacggtccatcaggtatacgggtcccgcaggcacccacggtctatcaggccttcacacacgtgtccatcgggccagagaagttaacctagcctggctctgataccaattataggatcgtaaagggcatttcccaccccaaaagctagccattgaggtgaggggctcccccacttatatcttaggtcctttgcccttccacaaccaatgtgggactattcaacagagaggagcaatatgtacgtatgcatgcatcacatctcagtgttttttttcttttttttccttggagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccaaaggcaaatattcattttaatttgttgtgtatatatatatatatatatacacgagcatacatgtgaagatggaaatatgtgaaaaatataatggtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaatcgacaaaaatcgcaagatgagaggattgtggtaggtaatcttctccaactgtgcctctcaatcggccataacatattagctagaaggataaacaaacatcaatctgccttcacagttttgatcatctcatgagacacatatatataaaccacccataagcaagagtctccaaggtgaattaattaactatgttgatacacatatacttaattggtataagagcattagtagtggtagttaattagtataaaagcatccatcaaaaggagactgttagctagctaggagaccgggcaagcaaagcaaagcattgatcttgatgaatcctccagagagattaattgcatattgtccagttccccctgacctattatacacatgcaagtgctctatgtacttgtgcggtgcaacgacgagcaagagtgcgtacgtttatagtagaactgagggggtgcgccttatatacgccagacgaggaagagtgcgtacgtttgtagtgatgtctccaattttagtttctgtcatagtgaaatattcgacgtttgacacctcgaaccatagaaaaactggagctgtgaaatgttttcttcttttttatgcgtggagcactgaaatattgacagttttgtttttttctataaaaaaagaagaagagttgacgacttgatgggcaggctctcctcgatggagggagatgagcttaaaaagtcgcaataaatggaccgatgtagtggaaatgtggagtggagtggagcagtaataaaatttaaaacgccacgcgtagggcatatcgaccacgactggactctccttgagatcttcgaacagtgtgtgcttgctagctgaactgcagcagtggaacagtaataaaatttaaaacggatgtgcagtgttcacagaggatgagtgtgctatgtgttctctgcttgtgaatagatatggcgatctctgcatgtgaatagatatggcgagtactattactgggtatacatggttaggatagatgttagtttgttcagtttgtttggagatggatttgggagcaaatgtacatggttagggcgcaaatgttagtttgttttgctgtggaggggagtgggttttgctagaagtggacccatgaattttgctattccaaaattcctcaactagctatatgtctagctccaacaaatctgtgatgcctatatctcactagtcttgctatgtgctatgtcatgtacccgtgggtaaatagctaatttatgatttttgctgtctcatcatgattatgccaaatatacatatacctaactcatgaatttttctatgcctacctctcaccatttatgctatgtctaagctagacgattttgttatggccatacctactcttaaatttttttatgtcggccttgactcagccgccccaatagaagcgacaaaactgctgttgttgcaagagttggattccttcaagaaagtgatagatgaatctgaggcatcaagggagcagtaatcaaagaaaattgaaagtttgattggcctaaatgctccatattttgctctgaaattttgatagttatgttaccaatcatgtatcattgtcattttcatagccttcatcatggcgttgcgaatattatgaatataccaatggatcaacctgcacgccctaagtgtgcgcattcttaaaaaatgctgaagtgtgatgcatgcatatgtacatattgctcctcccaaatggacatcatgcaggatcgggacttgacaacacattaaaggctctcatgctacacgcttcttgcactgtagttaaacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacctgtttttcaatacgaatacaacaattctatgtatatattactagtcatcaacctgtgcacttgcatgggctagaaaaattacgtgacatcaattaactagcgtggaagctttattggtgcctccaattactggatataagattttttctttgtttctcaattctttcggtcaataacgagcatgtgtgttattcatagaaacggaggtaggtagtatttgtaagaagtacggtatcgactttcaaaaaagttccgaccttgtgcgataatatacacacatattaacctacataggcaagctagccagacctagaaatataccatttctaaacctattcggtcacttactcacgttggggagcctaactaaactaacatggactcacatggcatgcaagccagccatggtactaactcgtctactacgccatagtacgctacaaacacaactaagttatcgtatgaaggactactcaatagtacacttaaaacaatgttactcgttgccttttaccttcatttgacgggtacgacctaagtgtatctgaaaatcttctcttctgtccatcggcgaaagcgtgcaaatgtaaaattgcctggtacgcaggactagatatgaagagtttgttcagagattgtgcaataaacatgtacatccatcaactgtatacatgcataggatatatacatacaatggaggtagccatttgcaccatatccacaatatacaagtaggcagccattcacaccttatccataccaggacgatccatttgcaccttatccacatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccatttcgatggtgatcatgtgcctggtcatcttgagcctcactgtcgactccgccaccgcggcacagtgcggctgctgcatatcctctcgggcaaaagcatgttgttttggttgtattgctgctggtggctccgactcagtctgcaagaacacttgttgtttcccatgtattctggccgattctggtaaattcactaatgtcactctatttaatgcatttcttatatgtagatacagactttgtagcatatcgtggactaatacatatgtacattgtcctcaatgtacattgttgatttcatttccaatctcacgacttcaggcatatatcttgcaacacgaagacatcttatgctctacttccactacaaaattgactaatgcgctaatgggattttcatattttaatttcacagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattattgaccatatgggacgatctatagtggatccatctgttggtctcaactctatgtatgtcgtgcatgtgtgctctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactataggacataattaagattgtcatgccaaaaattattgcaaaacctagtaggaaagcaaaagaggcgggggggaggaaacatggtcaatttctcggctgctatcacattcctcgttttctcaggtttgggagacatatagccacactaaaggcagtaaacctgaggaatgacaaccttactcacaaggacaaatagtcgttaaaaaactatgacatcactaaccatatcttatttcagttcaccaaacatacatttaaatttaggcagtattacggagaactaaatgaacaaacaacaaaccatacttcattgtcaaaacaaattgccttctatgtacttcacaaattctcacaagatcatatttgcaatttttcctaaactaattaaccaagagcaaatatgcagtggagcattccacatataatttcacatcataagtacataatacagtatggtataatacacatatgcatactagggcctacggcaaaagaggcaaagatcaatgtgcatgctaacttgtgtataatacacatatgcacagtactttgaaatacgcataccaggatatatgcattagttcacaccattcattcttgcattcttgcactttcaacaacaatcagatctaccaagcattcttgcacattaaaccacaagtagatctaccaatgaatcacaaccttaggtagcaatgggggtaatcggaggggaaaaccttacctcgtcagacgacggaaggacaggagacggcggaagattcaccggctgctcaccatggcgcgcggatcactgaggtgtgggcatcacatctatcagcaccaatgacatcggcggggggggggggagggggaggactggggctctttcatagaccgatgtaaactagacttattggctttgatttagggagaggaaggaaaagagatagactttacccggcatggctttgggcctgcacggagagggatagtagttggcttggtttcagtcaaaagatatgaagagaattttaaattgtttttttcaatttaaataatgaccgaaattatgttagtattattaaaattacatctttagctcggaaaatttcaaaaaaatttaagagagcataattaattattgagaagttattaaaactattccaagtcatattttacaaggtaaaattttatttcacatatcaacttgtaacatacaaggaatttcaccttgaaaaatttttgtggaaaatttaaaactttttgaattcaaaagtttttggtgaacatagaagcatactagagcatataactcccttaaataaaataaaacacatagtttttctggccaaatcaaaactaagtccaaaagaaaaagtttacaaatcttgtggtaaaaaattttaaaacaaaaattttgctttgaccataaactagaaacctaatcttctcggttttgcattttcaacctaactaaaaaaatatatttaagttaaatataaaacaaattgaaaggtcagtatcaaaatacgcaaacctaaattgagataaaaagaacttgcttgtatgtgcatattattcttttaagattgtttttggatattcttggtacatctcataataggttgcatatgcatgctttgtctaaagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcagaatgttaaacatactttactctatcatctggtgcaatggcttagtctaattcgaaatgtaacctcataaaatgagagccataagttaggtaaacagtattctggactgtggtcaatagattaactagtcaactttactaaattaccatggcaaaagcaaaagtaattaaactttggaactaggcaccttgaaccatcaaatccttgtatctacctgtcacccctccctatcacccccccggccttaattctaaattaaatggatgagagaaagagagtaatatagtttactgcgatagtgccaacacatggaaaatttagagcttctagatctctccttctacatctctcttaaatgggggaccatgtcgctatggggcccactcatcatacaaccatagccaacacatcatcagcacttctctcatttacattttgttttatttctcaaaaagggagaggagggttaaattgaatttcccccaaattggcactctaccactccaagccttttaggaaacatctatatatgggcctattttgtcgtcaaatacctgcaaaccacccctggtgaatcatctctttgatcctcaattatattttcaaagagagaagaaagagagagagggagggaaagtccatttacccccaaacttccccatacctctcatcttctcctaggaaacatctacatggggccactagacagccagtcatacatggttgagtgaagtacaagtgggatcacagcctcaaccactgccaactcctttaaattgtttctacccctcatgttgacaactagctctcacttttcaccttcacttttaccattcactactacaaccaagatttttgtgtgagggctaaaacgatttttgcgcgcgggtaggtggcccgcacgcacctaggggtctgggaaaatgatgatttttgcgtgcgggtggcgcactcgcacgggaaaacaaaaatccgaaataacatatatttttttaaaaaaaacgaaaccctagaatccggcggtgggcttccacccgatggccacagtgcctcctgcctcccgctggcctccgcgccacccgccatcagatccgcgctcccctccagccgcaacgccgccgacacccctcccctccgccggatctagggagggaaggaaggggagaggagcggagctggatcccgcgcggggagaaggcggccggctgccggatccgtgcggggatggccaccaccgctggattcttgcgttgacggccactgccgctggatccgtgtaggggctaccgccgcccgccagatcccacgccctccaccgccgccacatggaggaggccggcacgctcctcccaccaccactacgccgctgctatcgccaagagtggagagaggagaggagaggcgtgagagagagagaggactgagaggagatgctctgcatggaaattttaaagtggaaaaagggatagaggggaggggagaggagagaaagaggggaaattttaaagtgggtgagagaggaaagagggagttagtatttttgcatgcagctctcttaataggtccgtacgggaaaatcgactcattttcgcgtgctgtccatttaagaggaccgcacggaaaaatcgatttttcccagaagcaacgagttaccgcacgaaaaaattgatttttccgtgccatcctctttaatagaccgcacacgaaaatgagccgattttcccagaagcaacaagataccagtccctgc

SEQ ID NO: 35196 - DNA, 21911 bp, Oryza sativa
  unsure (1)..(21911): unsure at all n locations
gtccctgtccaagaaaatcatttctgtagtagtgattcatgaagttccttctctacttgatcgatccattttctttgtttcttttttggcatagatcgaacacttggtggtgcgctcatcggcgttcccagtgtccagagcgccaccatcgccccactttgtcattcccgtcgactcgaatcatctccggctgtactattgcgccactgacgtcgcctaggtcccaggagaacgacgcccacatatgatcaagccaatacgccgccacgaacgccgtcggtcgccgttgctctcctgctgcctctgcttctcttgccgccgagtcaccgacatgtgggcctggctgtttagccacttcattaggtgctaaggactttaattagtagaaatttaaatcttgtaaggttctttttgtaaaattgctttgtttgccatgtggacttatggacctaaatgcaattcacctaatgcccagggacttttttgtatagggtttagggcttaccctaaaacatgaaattactatttcatgcattcattacttgatataatagcttaatgagtatattgtactcacccttgctttaaccccctctttcagaatcaatttggagtttttgccgaagccaggagtttaatcagataaattggtttcattccaacttagttcccaagtatagattagatagatggtttaattctatagcaaaacattagacttggctcatcctatagcttctacagtaatagttagccactaccctattatttcatgtaaagaaatctcctttggagccttaatcaaatgtatgcgatgaagattcagattgttgaacctgtatcaatctactaatacaggggttgatacagtttaaatatgtcggttaccgaatctttaattttgggacccgacatggtgtgtgggtgggggcccctgcgatttgggagcctagagcggccgtaccgcttgcgccccctcccccctgaggcggccctaactacatgggccttaaaaggccaaatggcatcttatgacgaattctgggcttgatggcgacgaaaatggatgccatagactctatgacgacagaaagatcgtcactagattaatgacaaaaagataagctttctttatagaacgccattagagacgcatgacaggtgacgaatcatattcgtcacacgaatgtcacagatttcatagcatgacttgaaattaaatttttatgacgtaaatgagcgtcacctatcataagattcttgtagtgatggcttgtttggctattagagaggcagtttgagacatacagcacacagtttcataccgtgtgcgtgcctagttggcaactggatcctagtagatgcaaattttgaatcattcaacccaacccaatccttcttctcttaatcttctcttcctacacttgttttgtgtttgtgtgtgtgtgtgtctaagaggctagtagagttagctatcctaaaattttttgcacgttgcagctacaaactgtgctgctggcttggtcgtcctctgcttcaacattaaagagggagctaatagatcggtgattcactttggtttcttggatgctatccagccacgtcaccatgcatgcgaattttgtggatggagtcagagggtctgcatgcacggagctgatttaattaattaacttgttgccagctagtacctaattaagcatgtgtgttaatttattattaattactttgctagtgttaatttatccttagtttttttattcgaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatgctgcttcacgtggtcggaactatatacgttaagatcaaatgtgctcaacgtggtctggcacatcatggaccatgctgcttcatgtggtcggatctagatgcattaggaataatcctttttgtagtagtgaaactaaagaacttcacttgccaactacttcctctatttcacaatgtaagtcattctagcatttctcacattcatattgttcctaatgaatctagatagatatatatgtttaaatttattagcattaatatgaatatgggaaatgctagaatgatttacattgtgaaacggagggagtagtttttttagagtctgaacaaagatgaaactttttggaaaggtgctcctgatgaccaagttcaattcaccaactgaaatcgcacactggatttacatgaaaaatgcgagatagacaaaaatgatttctttcggttctaaattaatactcccggccatttgggaggagcaatatgtacatatgcattcatcacacttcagcttttttgtctttttttttccttggagttttaagaatgctcataattagggcatgcaagttgatccattgatatattcgcaatatttgacgatttttttttcattttaaaaattgttgacgatattagcttaattttggtatggaaaatatcggttaatttatccccaatttttatcaagagagaaaatgaaccatgagagttggggtgctaattaaccacaagcagatattcattttaatttgtggtatatatatatatatatatatacacgagcatgcatgtaaggatggaaatatgtgaaaaatataatggtgctagtagatttgtctaaaacacttccataatactatgatcaggacactcgataaggacaaagttcaattttagggattgtgtcattatcaaaattatcaatgaataattggccatagggccgggattagcaagggtctactactgtcctgccatttcattaattaattagattaagtccccgattccttgcatcccaaattggcctacgagaaccgacaaaaatcgcaagatgggaggattgtggtaggttatcttcaccaactgtgcctctcaagtggccataacatattagccagaaggataaataatcatcaatctgccttcacagttttgatcatctcatgagacatatatataaaccacccattagcaagagtctcctaggtgaattaattaactatgttgatacacatatacttaattggtataagaaaaattagtggtcgttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagcaagagtgcgtacgtttatagtagaactgagggggtgcgccttatatacaccggacgagcaacagtgcgtacgtttgtagtgacgtctccaattttagtttctatggtagtaaaatattcgacgtttgacacctcaaactgcagaaaaactggagctgtgaaatgttttcttttttcatatgcgtggagctctaaaatattgacagttttgtttttttctataaaaaaagccaagaagagttaacgacttgatgggtaggcgctcctggatggagggagatgagcttaaaaagttgtagtaaatggacccatgcagtggaaatgcggaatggagtggagcagtaataaaatttaaaatgccacgcgcagggcatctcgaccacgacaggactctccttgagatcttcaaacagtgtgtgcttgctagctgaactgcagcagtggaacagtaataaaatttaaaacggatgtacagtgttcacagtggacgagtgtgctctgtgttctctgcatgtgaatagatatggcgatctctgcttgtgaatagatttggcgagtactattactgggtatacgtggttaggacagatgttagtttgttctgcttgtttggagatggatttgggagcaaatgtacatggttagggcgcaaatgttagtttattttgctgtggaggggagtgggttttgctagaagtagacccatgaattttgctattccaaaattcctcaactagctatcagcctcatcgtttggcatattttctgaatatgccaaacggcatatttgcaaacgaaaatcaatttgtgaataaaacttttatatatgtgttcttagcgatctaaaagcaaagggtgaaaaataaacttcgatgaaaaaaacctcaaaatcagctccaaatttaatgttaaaaaaaatcaaattttggctgataagcatatgaatatgccaaacgatgaggccctatatatctagctccaacaaatctgtgatgcctatatctcactagtcttgctatgtgctatgtcatgtacacgtgggtaaatacctaatttatgaattttgctgtctcatcatgattatggcaaatatacatatacctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctagaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttctgcctatatataggagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgactttaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaatttctcttgctgcttttaataaggccatagcactatccaatgtatcatctgttggtctctgaccttagcaatttattgcaacatgattattattatttgtgtgtgcatgttctttacttaatttattcttagcggatttctgatgtttttgtgagttttagactatgggagataattaagattgtcatgccaaagagtattccgaatcctactaggaaggcatagggtggggggggaggaaacatggtcaatttctcggctgctatcacattccttgttttcttagtcttgggagacttatagccatactaaaggcaatacagtcgaggaatgacaaccttactcacaaggacaaatagtcattaaaaaattatgacagcactaaccatatctgatttcagttcacgaaacatacatttaaatttaggcagtattacggagaactaaatcgacaaacaacaaaccatacttcattgtcaaaacaaattgccttcaatgtactttacaaattctcacaagatcatatttgcaatttttcctaaactaattaaccaagagcaaatatgcaatggagaattccacatataatttcacagcataactacataatacaatatggtataatacacatatgcatactagggcctacggcaaaagaggaaaagatcaatgcgcatgctaacttgtgtataatacagatatgcgcagtactttgaaatatgcataccaggacatatgctttagttcactccattcattcttgcactcttgcacattcaacatcaatcagatctaccaagcattcttgcacattcaagcacaagcagatctaccaatgaatcactaacttatgtagcaatggggggaatcggaggagaattaaaacctttcctcgtcagacgactgaaggacaggaggcggcggaagattcactggctgcacaccatgccgcgcgaatccctgaggtgtgggcatcgcatctatcagcaccaacgacatcggcagtggcaggggtggactagggctctttcgtagaccgatgtaaactagacttattggcttcgatttagggaggggagggaaaagagatagactttacccggctggcctttgggcctgcgtggagagggataggagttggcttggtttcagccaaaagataggaagaggattttaaataggttgcatatgcatgctttgtctaaagaaaattcctaaaaataaatgaatcagcaataaatcctaccaaaattcccataaatactaaacaacaccctaagctcccagcaattttagtttgaatttatcacatcaattgataacccaaataaatccttcaacacagctaaaaatctggaaacagcataccaattagcctactttgcaccttcaccgaaattaaaccataaatcctcttgcaaaatctcaaggtcagaatgttaaacatactttactctaccatctggtgcaatggcttagtctaattcgaaatgtaaccacatgaaatgagagccataaattacgtaaactttggaacttggcaccttgaaccatcaaatccttgtctaccttgccgtctccctgtcccccacacccccccttaattctaaattaaatgtatgagagaaagagagtaatatagtttggtgtgatagtgccaacacatggaaaatttagagcttctagttctctccttctacatctctcttaaatgtgggaccaaatccttgtggggcccacatatcatacaaccatagccaacacatcatctgctcttctctcatttaaattttcttttatttctcaaaaggttagagatgggtttaaattcaatttccactcaaaatgccactctaccactccaagccttttaggaaagatctatatatgggcccatttgtcgtccaaacacagcaaccaaccttggtgaatcatctctttgatcctaaattattttttcaaagagagaaagaaagagagagagggagttaaagtccaatttacacccaaacttcaccatacctctcatcttctcattggaaacatctacatgggaccactacacagccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggaacaccaccacgggaaaaaaaaacctgaaaaaacataaattttctttaaacatgaaaccctagaatctggtggtggcgccgccgctcttgcttgccgctgccgcctcctcgtcaacatcatcatcgtcagtggcggcctccgcgccgctcgccttggatccgtgctcccctccggccgcaccgccgccgacgcccctcccctccgccggatctagggagggaaggaagaggaggggaggggagctggatgccatgcggggggagggcgcccggccgccggatccgtgcggggacgaccgccaccactggatttttgcgttgatggccgccgccgctggatccgtgcagggacggccgccgcccgccggatcccacgcccaccaccgccaccacgtggaggaggccggcgcgtgcctatgcccaccgtggctgtcgccgcgcgccgccgccgctgccgccatcaggaggagaggagaggagagtggagagaggagaggagagtggagagaggagaggagaagcgtgagagagagaggactgagagaagaagctctgcgtggaaattttaaagttgaaaaggggattgaggggaggggagaggagagaaagaggggaaattttaaagtgggtcagtgggaaaagagggagttagtattttgcatgcggctctcttaataggtctgcacgggaaaattggctcattttcacgtacggtccatttaagagaaccgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactatgaacctcatctatttctcatagtgttccactatgcaaaccaccaaaaactacctcggaatctccaagaacttccacttactcttttcacccgaaggagtttcatccatgtcacgtattctctggtgagcttcaccgcactccaaccacgggaacatgaagttccttctctacctaatcaatccattttctttgtttctattttggcatagatcgaacacttggtggtatgctcgtcagcgttcccggtgtccagagcgccgccatcgccccacttcgtcgttcccatcgactcgaaccatccctggctgagccattgcgccaccgacgtcgcctaggtcccaggagaaagacgccaaaatatgatcaagccaatacgccgccgcgaatgccatcggtcgccgttgccctcctattgcctctgctccccagcaaccaagtcaccgacatgtgggccccggctatttagccacttcattaggcgtaaggtctttcattactagaaatttaaatcttgtaaggttctttttgtaaaattgctttgtatgccaagtgggcctatggacctaaatgcaattcacctaatgccaatggacctttttgtatagggtttagggtaggtcctaaaccctacatagaaattactatttcatgcattcattacttgatataatagcttgataagtatgttgtactcagccttgctttaaccctctctttgagaatcaatttggagtttttgctgaaaccgtgagtttaaacatataaattagtttcattccaacttagttcccaagtatagattagatagatggtttaattctatagcaaaacattagagttggctcatcctatagcttctacagtaatagatagccacaatcttgtaaataccctattattttatgtaaagaaatctcctttggagccttgatcaaatgtatgctatgaagattcagattgttaaacctgtatcaatctactgatccagggcttgatacagtttaaacatgtcgattaccgaatctttaattttgggacctgacaaggtgtgtgggtgggcgcctagagcggccatcccgctccccccccccccccgagccggccctgactacatgggccttaacaggccacatggcatcttatcatgatttctgggcttgatggtgacgaaaatggacgtcatagactgtatgacgacagaaggatcatcactagattaatgacgaaaagataagcattctttatataacgccattagagacgcatgataggtgataatatatatatatatatatatatatatatatatatatatatatatatatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatctaaacatataattagttaggtatgtaataatggattgtgaaataaagttaaatttgagttgttttgttgctaggtataggtatgaatcgaatacttataactaggtatatactcacaatttaaaaattttgaaaaatttgggcgaatttatgtatttcataccatggtgcccgggcaccatggtgccccatatgagtgtcctatatatatatatatatatatatatatatatatatagtaaatttgtttggtgctccatggtgcccgggcaccattgttgaaattgagtatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatagattgtgaaataaagttaaatttgagttgttttgttgctaggtataggtatgaatcgaatacttataactaggtatatactcacaatttaaaaattttgaaaaatttgggcaaatttgtgtatttcataccatggtgcccgggcaccatggtgccccatatgagtgtcctatatatatatatatatatatatatatatatatatatatatatatatatatatatatgcctgcactttcatacacccaggtgtatgtacacccttttattaatggatgatccattagcattcaatttagctgtgaaaaaaattaataatattaatttccaaatgactgcatgcatgtggcatagctgcacaccggattgggtgcaaatttgaacaagatcgtgggcatgcatttggtttcaaatttgataacgtaccttagatatccccaccttttctagtatgcaacagtatatactgttttttaagccgcagtatatatactctttgaagcgatgagcagtactatatactagttttttgtgtattagcggtacataataaggagtaccttacatttttgttgtagcagtgaatatttctttttttaattagcagccgtatatactgatgcggacatcactacttcggatacacacaacaatcctccaacggtcattcaaggaccgataacaagagctcgtgcgcgacaattaaatttagagctgagttcgttcctatgttcttctttgtatgaattcgagaatagaggggaacaatggaggggacaaggagacacttggagaaggacttagagccatggaggaccattggggacgtccaagtcaaggtggaggcccaaaccaagtcgacgtctggtgcaattcggagtctaggaccagtctgcactaaaacgggcgcccaggtcgtatacgtgttcgaattggggcgttctttatatggatggaaagctaagaagatatcctttccaatggttttggtcccacgtccaaattctttctgagtcaacgggaattgaccgaacaacttaacgtccagaatctgtcccggtgctgcgtcaccgtatttgggcctttggcccgtgtatcgtattggaacccattagggttgcgtcgagaggggtttgcacgaccctaaactatatatatcagtacccgccgtcatctttaggtttttgggttttgcttagattaatctgtcaagaacagtttcgccgctagattggtttgtaagaccccaactcgtgagcttaatcattcatctgcaattttggttgtttttctatcttgttcttgtttgtgttcttcgattggcaaacagggattagccttctcggcgaggtcatccgcattttgacacgggtgataaccagaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgtcttccgctgtttctcgtttgtctttttgtgtgctgggccttcgctgcccgtgtaataaattaactatttacgcttccgcttgttaaactctgaattgtatcaacttttggtgtaccttgcctcctgggacaaggattaatgcacgcacgtaaggaacgcccgttgggttatttccggtcgtgacagcaacagtatatactgttttttaagccgcagtatatatactctttgaagtgatgagcagtactatatactagttttttttattagcagtacgtaataaggagtcccttatatttttgttgtagcagtgaatacttctttttttaattagcagccgtatatacttactccagaactaacgagtatatatatactgattatgtctttttattggtacgcgcagtatatactactgcaacgagcgaatgagtatatactgttctttctcagaatgagtatatactgatttttttttggaacgagtatatatactgacttttctcggagtggtatatacttttttcttctccaatcggtatgaacagctactcggagtggtatatacttatttcttctacaatcggtatgaactgctctttggtcagtgtatatatactacattcctcattgaaggagtatatactgcttcttttttttatcagtatatacatttgttattaattgagtatatattgtatgcactacttgttctgtcagtatactgcatatactaattgtcatgtttggtcggtatactgcatcgtcctcgctaaaggaggttatactgcctttttgtttgatcggtaaatactacgtatactacttttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcatacagatctcggttaacaacgatgggatcacgccgaccgcacgccggagagaggtggacaagaatgggtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatctgcaacctagaaaaagcaaatcaagaaaatcggaagaaggaaggacttgcctgcagcatagtcgatgttccagttccggacgacgctcaacgtcatcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcggatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatatatatatatatatatatatatatatatatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcacccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaagcagaacttgatatggggaccagaacaaaaatgttctgctcttgtttctgctggggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatattagaaaaactattctacacccggggtatagaatagctattctatacctccctcccaccaacccacctcctctccccccaagggcccaaaacccacctcccacctcggtcaaaggccagtcaaaggtccctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaatgtgtaattgtcgtgcagtaatacttttacttttgtgcagacttttgtgcagtgacaagtgtataattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgcattttgaagtttaatcctccacatgcagtaacacgataacatcatggtggaaacggttttaaaaaataatacatatcttatgacatattgcttttcaaagattgacattttgaactttagccctccacatgcagtaactgaatgtgtaatttacagtaataggggtttatacatgcagtaacatggttttaccaaatgtataaaattattcaaaatactcctacatcaatcagaccttgctcaaagccacctacaaactttatctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatatggttagcatgtgaggctttaactcatatatttttatttcaattcctagtttatgtagtaatactattcaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttacaccatgatgctagaaaaaaaatgcttatcaaaagtacatccatcatgactatatttcaattatatttgagcgttgttactgcacgtaaaacacagtgttactagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatatggaatacatatatatatatatatgcatatgtataaatacatatacatgcatgtatagtacaattcatttgctcactagctagctatgacttcgacgccggcgttatgtcaaaagaagaaagaccgacgttataaattgtcgatccgtcgtagtagaattcaccctcgggattaaggacttcttcgttgatgaatctcatcagttgttcttgaatagccgtgatagaatccttgtgtgggagattgtccctcatgtgaatacactatcattcgaaaaataatgacatatgaatatatgaaattaataaacaacaaatcgatacgcaatgaaattttgaatggtttatatatacgtacatcgagctcttgtgtggtgtagatttgggttgataggaagtgggcatactcgcatacgtagtagccgcacaggttagttccctggtcatgctttgcacactacatgagaaaggacaagagatttaatatacacttatattaactgtaactagtaatcatatataattagcatatgcatgatttaaaattgttaaaaattctaattatcatatgtaaataccacatgcatgaaaattgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactctgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgtcgctatcaagccagatggtcccctcgccaggtaggcaagttgttggctaatcgtctcgttacccatgagatgttgtcgcagccacacgggcaatgtatcaatgtgatgccgtataatccatgcatcagacttaccgatgtttctggcgggaactagagccaagtgctcctcgatgtaaggagccaccaatgaagattgttgcagaaccgtgaaatgggctttacggaataaattgttgtctaccgtcattgctgcgttccttccgagagtcccctttccccatagtctcccttcatggcgtgattcaggcaccccgattgggcgaaggtcttcgataaattctacgcagaattcaatgacctcctctgttccataccccttggcgatgcttgcctatggatgagcacggttacgaacatacttcttcaaaacgcccatgtacctctcgaaaaaaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccaaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgttttccactgcgatgtttnnnnnnnnnnnnnnnnnnnnnnnnnnnnnnnnnnnnn

SEQ ID NO: 35197 - DNA, 9721 bp, Oryza sativa
  unsure (1)..(9721): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacttctctgtgtttacaaagtacaacaataacaacacttcttacgaaaatctcgactaaactcgaaaccctaacttttctctaaactcaactctctcaaaatcgatatcggaaggctacacctaccctctctatttatatccgaggtaagcaacctaaaaccacgaatcaacgttgtacaagaagtcctaatcccctagaaaaccttcccatacaaaaaaacgaaccttacaaactccaactgtaccaaatatagactccctccaatttcgaccctgcatccattacgcacacaatatctctatcatataccatataaaatcttcaccaaccacgtgcattgatctttagtctaagcatcccgcatgatatcctgatcttcctgacgtcatcttctcctgagttgactttggatccatcatcgacactaccctcccgaggcatcaagattcacctacacatgcatcaactaagaaaccatattcgatcacaagttctcaccaacttgactcatggtagcacacacataatatccatctagaattcataaacaataattatccacaaatacccaaataaataacccgaaactgaaaccgacaaaacgtcggccggtcagaccgcgccaccgcagactggccggtctgaccgctgtaagttcaagtgccttaatttggtttcggtgattaatgacaaatctaattatatgagactaacgtttttatgagcctttctttgactagtcttatttggatatgaaagtaaaaatgatgggaggtatgtattaaacttcacatattctaacttggtctctcttgtggatccaaaatatagtgtgagctctctcattgatcctgattgattatgtgcgtatgtgttcctttatatccatatgtatgtacacttgagggggagcttattctatattttgtttattataagatttctatcttgatttgaaaacatctttcatctcatctctctatttgtttatatcgggttattatccatcaccaaagagagaaaagattgaatgatcttggattaaacaattcgtataattgttacgttggtgatagatgataaaccgatgtttatgggattaacctctcttttgcataagttgtctactaggtcatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttacttgagtcttatcttatttagtctcatttacattgagaacatggagatcatgaaggtatatgttttatgttggtctacattattactacatatgccttctctttatgtgtataggataaaccccaattggtcattctctaattatgcatacacttgcatctcttgtatttatttgtatgcatatatttagggggagcaaatcctatacatttattgtgcatgttctagatccatgttgttcacctattatttatatcggatctttgcacttgagcttgcatacgagtatatgacacttgtgatgttaatgaaaactcaacgaacatatctatatctttcatatgcaaccggttggtcatcaagtgaaggatgacaaccgatttgttgagactaatgttctcctttgagatgtgaaaaggaataggtcccactacaatgaggctaatgaatgacaccatgggttaatggtcaccaagccaaggacatcgtcatgttggcaagaatgaagtcaaacttgtgatgagaataaagtcttgacaaaggatggtaaagacctcggcataaatatggttcaactggatggtcacaagtgttgatcttggctcaagcattaaccccaagttggatggcgcaaggcaaaggtataatggagctaagaatgttttcttagtcttttcccggtcttggtgtttggtgtagaccggatttgctagatagacgccgtactatcaagaggggtctatgaagcgagaatgtggatgatcttgcgccatattagttcatatgcatgtaggtgcatttggtgggcttgtctagccaagtgtggtgagtattctcaagtcctaaacaaagagagatgtgggcaaatcctataggtttgggtagcctcatgtggttatgtccggtggagtatcctttggagtgtgagccctttttccctgagaaaagttgtgtttcttggatggattgttcatgggttggatagccctttgaataagctttccatagagtccaagaacgccaaattccgagacccgtgtcaagaaatatcgccgttttactaacggttggttgtgctgaaaagtgacctgcggtctgaccgtgggccttaggacggtttgaccaggcctgttagccggtctgaccggcgtgataaggccggtctgaccggcttcaatggtctgttgcactggtctggtttatggtggcgatacagagccaccagagccgcaaccggtcagtccgagccgatgacggtctgaccgagccgtggacggtctgaccggcctctacactgcggtcagaccgaccaagttgagtgggctcaatgattgccctgtaacggctagttttctagccgttacaaagtagtccggtctgaccggcctcacaacagcggtctgatcggcggagcacagagttggggatttcggttccaacggctagttttggtggttgggggtatatatacccactccccagcagcaagggcgaggttttggcactccattacattatcttgaacccttgcaagagctctcacacccttgggcacttagtttatctagtgaggtgttagagagtgagttaagccaatccaagtgcattgtttcattgttatagctagtgtggtacttgatcatccgcggcaagcatcctagacttgttactcttggaggttgccgcctcctagacggcttgtggaggtgttgcccggtgacctctccgaggagattgtggaggaggcctggcgccagttgtgagtggtttggagttcaccaccttcggagtgaaggaagaactaccctagtgatcgaggctttggtagtcctctccgtgggccggctcccgccttgccccctttgacgaagggggcgtgcgatggcttcgtggttgagcggtggagttgggctcgcctcaacggggattaggaaaccggcaagtttccgaacctcggtgaaaattccttgtctcttgtctcctttattttgtgcaaatttactttgagcaagtttacatactagagtttatttgtgctattatcaccctaagcttgcaaacctcaacataggctagtttctttgtgcatttacttgagactagttgatttaggttttgaattgtgcaaaaccattttgatttacgcttccacatacgaaactcggttttagccaaaagtttgaaaaaccgcctattcacccccctctagtcagcctccttatcctacaaccgctcgccatactccggtctgatcggcctaccctagccggtctaaccgcaaccatcagacatgtccatgttcatcacttgataacattattcatcatcactcctatctgactggtatacatgccctggtccccccggtctgaccggtgcaaaaaaaaatcaattatcccacatgccaattaatcaagatatgatagtctaatattctagaggtttctataggggtaagatgtgtttgtgtttttataactatgagtgtacgcatattatgaacgtctgcatttgtttcgtgtttataagaaatattaaagaagcttcgccgattattctctggaattaatcactgccatgaaactgcgagacaatagctgacgaaccatcccgtgcaaatgccacaaacgcgggccactggatttccatcgacgcaaaaccaacagcatcgcgacgtaccgtccatcccaacggacgctgccatgtgggccccacttgtcatcgcctggtagcgctccccctccacgtataaaaagttttgcacacccaacctctcttcgccccttcttccatctccatcgtcttcgtcctcttccgatacctcacctcaccatacagctgctttctctctctctctccatccacccgaagcagaatccccaaaacaacagcgagagaaaaaaaattcacgcggcgaagccaaaattttttgttgatttcgatttggacataaaccctagctccaatctccccatcgccgcgtcggccccgaacccgtgcgcccccccatcgctcgctgaatcgaagggcgcctaccagtcgattcccccaagacgaggtaatccgctcgaccccctcgagagagagagagcctgggagagaaatcggtgttgttttctgctgaatcgatcgggttggcgggcgatttagggttttgggaagggtggctcgccgccctctccgaaggggactagcctgcgcgtctcgatctcgcggggagctagggttttgtgatccgagtgcgaggagggactggtgtcgccctggttctgatgagaattggcagtggaatgctcagattggctgccggcgacgacgagaggagcagctcccttggcagcggcggcggaggaggcgccagattcaccgcccccaaggtccgcacgcgcgataagggcgcgctcgtggccctctgattcgaggagggttgctggtgcgtagacgtggagccttctctgaggagagtgggagatgacgaggatcttcgtgcagcgcggggctgccggctcctcgtccagctccagccgctcggggtcacagacactgcagcagcagcagcaactgcaggcgacatcagcggttgcccgggaggaggagctgccgccgcagcctcatcagcatccatcggagctcacggcttcagacaatataactgaccatctagtggaggatgctgataacagcagtaatagtaataagccattggggctagatgatcccacatcagagagttcaagctctgcagaggagagggctgttatggagaaacctcccaaagacgactccagtgtgatcgatcctgctttcttggtggaggaattaacaggcctccagttttctgatcagtttgagcaggaaaatctagtgcagtcaggtattggtccatcacagattgctggtgcagcatcacacccaccacctccaccagctccaccagccccaccaccgaaaccatcgtctggtaataatgggttaaggagaatggggtctggaagctcaaacaatgcacggattggatcttcaagaaggccagttgcttggccaccagtggcagttcggtcatctgcttcgggttcccgaccttcttcacctagatcacttgctgatagtgaagggtataatagtgcagatgagcagggcccctgttacgcctctaattattatgattcggtatgatctcttgtctgcttctattttatatgaaaactttaatatcgtatttcctatatcagctttgccatttgtcaatgattgcatggcatgaagatgatgtctaggatgtggagataatgtcatagatcctttggaagtttggatcctttgtagttgcatgatacaataacattattccttttatcgttaatggtaggtttgtcacattcgcaaacaggcacctttttgtttttgacaacaactaatgtagtttatatttcctcaggaaagggagcgcatgtttgaacatgacctaagacgagtgagaggatttgaaatcaataagatggctgaagatgggaattgtctgtttagagcagttgcagatcaagtttatggtgatccagaagcttatgacatggctaggcagatgtgtgttgattacatggtatgtttattgttacatctatatcctttgccattaatccataaactagattcacaagcttggaggcagtgttctaacatgttaatctgttgcattcaaccttgccccttatttgttcactattggcagggctaggcagatgcgtgttgattatatggtatgttgtgtcgttgcatctgagtagtaacaccgtatattatatgtattccgtccctaggttcaattcataagccaacattaatatttggttaatatttctcattctctaccctgtcgcataatttatctcactattttatactaagttattggctctgtaagatcttggataagtttggggaagcaatatgggtagatggtggaacattactagtttgagacagcctgcagtttcgtctactgttagttagggttgaaacatagttgcaacttgcttctcctttgctggtcagggtagatattggtttctgctgttctgtttccttagaggtagcactcagctagttatacaggaattaaaatttaataatgaacttaccaagggaaaagtgctgtctgttctaccttttgacttacatattttgtgaaatgacatattaaacaattatatcgtgtgcaacaaatgtgaagccatgcctagttcattgttaatgaagcatttgattcaagttcaagtccagactcaactgtatcgtttatcgttgaactgataaacttcttggcaaggatctatttgtttgcagcatgattttcttcaccgtcttttgcccagtcatctactttcacagtttcacatggaaaaaaagagagaagttttgagggatgctcctgtctttatgccagcaggacctttttctttcctagtgttctgttttggtttctgtattttttttaatgcatctcctgtctactatgcaatcaccaggacattgcttttctagtgtctttttctgtatatttcacgcatttgggagttttctttaagaagttgaaagcatttggaagaacataccaatttgagtttgcagcatggtattaggcatgcattgaaatcgtaattactccctgtcgtctgagttacttgacacattagcaccatgtgcatagaacaaggagtataattcaaatttctgatgtgattttgattgtatacacatctcatccacaataaatcactgttcctgaaaggggcattctgtattctggaatatattgcctcgaaagcccgaagtaatccccagtttcctgaaacctgaatacctgatctattttagactatgaggtaacagtgacttcccctttgaccaagtggctgatatgctcattattgttatcaattcttccaggaaagggaacgtgatcatttctcgcagttcatgacggaaggttttacatcatattgtaggagaaaaagaagagataaggtatgctattcaatagatcctggctgtttaggatatattccaactgcttgctgcttttccttacactgagtgtcttcgaaccgttgtgctgtgcttgtgaacatcctcgtattttttttttgaaaatgttatgaaactaatgtttttcagtcagctgacttgtcttttattttaatctactatagagcatgtgcgcccctggaaagcatgtttttcagctgtttgaatcttgttttgcagatcttaatgaacgtctgcatttaatttttttaaccatttatgcttccacacaacagctgtgcattttccctgactttcagaatttcttttttttattaaaaataatgctatcatgtagatactgagcgcttgtttttcaacttcaaaataaaattaggacttaggacaaggaaaaatttagaaccttaccttcttccactgcaaataatttatgttgacatgcttgattctcaaggtatatgggaacaatatggagatccaggcatttgctgagatgtacaatcgtccgattcacatatattcctatagtacaggtaactgtaacacatatgttgctataggattttaacccttctctgtagttgcataaactctttcatagtctcatattgtttgctcttactgcagagcccattaacatttttcaaggaagctacaatacagatgtccctccaattaggctaagttaccatcatggtaatcattacaattcggtggttgatcctcgtgggctgacagtaggggcaggcctgggatttagttcccttagaggggtatgtcttggtccatggttatcattgcccttatagcctattctacagttgagtgtttgccaactggtattctttgttaataaatgaacttcatttcctttctgtacagacaaataacgttgacagggatcaggtgaaggctgcaataaaagcacagcaagatcagcagattgagaatgtaagtactggtaattgttttcaaggggtacttgccatctcaacatctgcacaaattaatcaggtttaccttgaattgttagagtataaaccgaaatatacttaattcttttcttgccggcaacatcaggcacttctggctgaaggacgactatactctgatttggagttgacagagaaggaaatagagcggatggtgatggaggcctcacgagcagagtatctaaagcagcagcaacaacaacttaacttcagagagtcatcaacatcaggggcagagccatcttcttctgctgcgagtaagcccaccattcttggcattggactacctggtagaccacatacagaaactttgataggtttgctgaaaccatcatgatttcctattctgcagttagtgggtcttctcggtcagctgggactgccgatagagttggcgaggagtgcttcgttctcccggacaccgtgctaacccgcagcatgcagctcctcctggcaatgggcttcaactacatccaggtcatggaagcctatagcatatttggcgaggacgtcgactcaatgatctactaccttgtggagatgggaggcaccggagcctctgcaggtggtagcaatcgcaggaaaggaaaagctgctgagtgatctgtgtacctttcaccggctatgacgaatcgaaataaaaatagttatgcataagccacaggagagggatggcaagactcgtggattaaatgagctgaaatgtcaatatactttccactgtatggagtgataacaaaataaaattcacttcttccatatgtggcctggcgttttcatggctgtcggcacttgtccacagatgtctacacggaaaaccctaaaacattgtactacctccgtcctatattacttgcttttttgagttttttaagtttttgtttgtcaatgtttgatcattcgtcttattcaaatttttttggaattattatttattttgtttgtcatttgctttattatcaaaagtactttacatatgacttatctttttttatatttacactaatttttcaaataaaatgagtttttgtttgtcaatgtttaatcattcgtcttattcaattttttttggaattattatttattttgtttgtcatttgctttattatcaaaattactttacatatgacttatttttttttatatttgcactaatttttcaaataaaacg

SEQ ID NO: 35198 - DNA, 10259 bp, Oryza sativa
  unsure (1)..(10259): unsure at all n locations
aagttgtggacgttgagggattaacgcatgagttctagcagtatgccagtattacctgcaggctccggtctcagctagatgccataactgaaagtatttattatagctaaataacacaagatttggagggagagatgtccctctaaacagccggacgtcataactgaaagtatttatagttaattaacactgggttttgtagatttagagggagagatgtcacttcaaacattttttaaaaataaattatgaacatgttggagattgaatacagaataaaaccacacacccattgtcattgcactattaagtgtatctcaaagttgtacgcacggagagtggcgtaattctaataaccagatttatttgcacttaacagtatatttgtagttttacgcacggagagtggcgtaattctaataaccaaatttatttgcacttgacagcagaagttttgtaggtatttttgtcaagccatccatgagatttcatttgaacgaagtaattctaagtcatgagatcatctattaaaacttctcaattcaagtttctcaatataatgctcgtgtttctgaatgcctcataagatttctcaatatagtggttcataagttctctcaatgttgtgcgtgatgtaataccgatataaatagttttgcttgatctactgaatcacaaaaccatttgccatttttagcattttccatttgtattctatacagtgaacacattcctcgagcctgagcctgaatttgaacgcagcagcgcttttccaaaaaataaataaataaataaataaataaataaataaattgaacgcagcagtgccaatcaacactactgaatctgaaccgaatgaattcacaccggttacactataaaatacaagtacatttcttttaccattaccgttgctacaaacaaacaccacaataaattcagacaaaattttctgacacactttgcaaaatcggcagcctcttggcagcacacatctttcttgcaagaaagatccaacatttcagccaacgagtaatcccatcaagaagaaaacaacagtttctgaattagaatgcaatatcgaggaaatggtggttgaaacactgaaactgataaaaacacaatcactagaaccaaagccagacatcgtttgatcatgtctttttgtatcgaaaaaatattattactatttatctatttgtaaccgtatggatcatgtcattttatatgccacagatatactttgaatctttttttctaccatattttggtatagaccaaaatacccaatccacacatggaggaggagatgcatttgtaagcgacaatgtaacgttataatgcacgtgtgacaagagcaacatttctcatatgaaaagtgacaatgtaatgtcataacgtgtaacaagagcaacatttctcatatgaaaagtgacaatgcgattatgcgacgtcataatacatgtgtaagttgctatttacagagatacacactaaaatgtggttgaattggacaagatagcacgatgatagacacaacggcactcccaccgatgatgaagaggagaaggtaggcccgagattcagtgtatagtgatcagggactagatgattgccctagtcagctccggatcgatgtgcggtctcaaaggtcgatcatggacgagtgctgctaatagaaacaatgacaacgagtatcacatttggattcggattccatggagtatttggattcgaatgagcttttctccgtatcatgatgactcaacatgttgtgagaaattgtttccttagaaattttattttggaaatagaagtgcatacacgcaatttgagaaattcctaagcaattgttcctacccaccaataacggaacaacatgtgcaactctgcaattcttccatgattatcataattggaaaagacaaccgcgtacaatataacgtaattataaatagaccttccaatgaaaaaaagttgaaagaaatactacttgaaaaacaatacgattgtactatctccgtcccataataagtgtagccatgagtttccgcgtctaactttgatcgtccgtcttatttaaattttttttataatcagcatttttgttgttatgagatgataaaacatgaatagtactttacttgtgacttatgtttttaaattttttcaaaaaattttcaaataagacgaacggtcaaagttgggcgcggaaaactatgactgcacttattttgggacggaggaagtacatcgacagttttagcagatagaacaatatatacgacggatatttattgaagtaaatatttgattctagagacaagggagctgtgttaaaaaaagtagaacttacacaaacggcataattggatcaagacgactagtaacccatatagctaactacaataatgaaagcaatgagagcatactcatgacatgtgaaaaacaggccaaaaccagttccacgatacttggccaccatccctaaatattcgcggtgcaaccccgctaggagaacgaaccggatggtcaagatggcgaaccggatgaggcggcgacgacacccccggcaaaacgcagtgctatcattgttttcttcttgaatcttattcccgcctgccaccaaatctgtcttcgcttcagccttggagccggagccggaatctgcaccaccgtcctcctggagctcatggatggattgcttggagtgctccatgagttatttttcctgaaatctctcaatgctgtgaaagggataagcgaataattataaacgattgtattcttttcaaaaaaataaacaaataagcgattgtatgatatttttcactggttgctgattgcaggaggtggttctcaggtgcgatacttatagtagattaatcgaagaaacgggagtcagcatcggaagtagcttaggttcggttcggttctgtttaggactcgcgtcgcgcgccgagtttggccgctgaacgatttggccctggatgcgctgctcatcgtcatctacctgggatccacggattcacccatcgctgaagatactggagaaccccgcgccctccgtgtctacgcgtcgtggcgaagtcctgtcgatgtcgttgctccttgctcggttcgtgacctccgccgctgccattgctagatcgcgacggcctccatgtcctgtgcggcgaaaaggaagcggatgcccaggaagtgcgagtaggcgcgcacgaaggcggagaatccgatcccgacgtcttgtcctggccggcgacgacgagcggttgcggaagtcggcgaggtcgaaagggacgcggcagatcgaggcgccccgcgcgtggggcgagggtgaggtcggaccgcaaccgcaagccgtgcgcgagcacgaggcgctcccctccgcgcgggcggcggtgttgaaggtcagcacctgcttctccaactgctcggctcggccatgcgggtcgcctcggcgtcgcggctctcctcccccactcatgcacgctcgactcgttcatagccggcggctggtcctcgacgttgtagatctcgtcctcctcgtacaccgcggacacgttgcacgggatcagcctgtcaatgaacattgaacaccattgttactgtgcatgaatttcagtgcggtttaacaagatgaaagcaatcaagcgcacaaaagaaacatctcggagaaattcagagttcagggaatgatatgaatttatttttacatccaccggaatggattactatgatgaattattggtcacagttttcttttgtcggaactgttaagcttaagtatataatagagtaaattgcatcggtggtacacgaacttgttaggtgaatgtaatctagtacatgaacatgtaaaatgctcgttttggtacacgaacttatattgcacgtgcgaacgatcagtcttggaaaagtactaaagattgtgagctacagcataatcagtacagatatgaacaaaaaaaaagaactattttgatgatcaaacaagttgatcagcatgacaacatgtcataattctaatggatactacaagtttatgtgctgaaacaattggtttcaaatcacatactcatacggtatgttctaaggtgtggttacagaagctatactgtcaaaaattgatgatcctaaataaactcctaacgtgatccaaaactcagactattcttaatcaaggctcagtagcgtccccgttaatccaatgcattgtgctcaataaagctaagcaaacatttagctagattcaaaaacatttcgtcagaataacatgaaacagaaaatcaaactttctgatcgtgcctatttccctattcgtccacttcatcatagcgaaatcgatgaactaacccagcgcacaattctaaagaattctcaacggtttggcgttagaagtgttcatggattaatttgcaagcagcagaagataaggttgccatgaattcctctgcacatacaactaattcagtgaatgcaaatatctagctagagaatcgtgtgaagtacatgaatgatcagattcgctgcaccaaaaccataaaacacgcgtgaattcacatgaggatgaaattaaatcttgcaacaaaaaactcgatcataataagagatcctacatcgctggccggtctgactgccacataacccacagtctaaccagccacacccggccggtaaacaacaaccgttatttcacaaaaccaatcatctattatactccgaaatctcataacaagaaactaatctttcacacatataatatcacaaaccaccaatattattaacacataaaatctaagtcactacttcattttacatacgtagacgaagagcttgctgaagatggtggcgaagaatgagaaccacataagtaggcggtgcaggatccatgaaaatattgcttgcctcgctttcttactttttttttttgaccggactcttactcttactccaacgatgcagatgtgcaaggggatacaaggaggggtttgtggctatttgcataaaggcagttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacgagacacagccccacgacacgtttccgtacgccgacatgccaccacgacataccggaaagaggccgtgacaggacccttcgcataaccccctctagccaagcacaccacacctcaggtttcaccctcgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatctcgcgaaccggtccttaactgccatgggtgcgaccagcaaaaccatgcacccatagcccaccattcagtcgcattttagttgaataattacgaccatgaagcatggccagatgtctcgagcacgcagctcactctgatactaaaaaggtctaatactgtaattatcccatcaactgagctagtggtaattaagcatggctaagcatatagttctagctaagtcatcaaagtaacacaagctaggcgatttattacccatggttgacaaaggacagatatcaagtaaacatggcacaagcgagcagataggtaaaaccctgaccccatgtgattagcaaaacatgcatatttatttgcaaacagtaaaacatttgtaaattgggatcaacatgctcaaagggaatgtgtgacttgccttgcttcttcaaacaatcttccgaactcctatccttgcgaccgtgatcttccgaaacgacggattctacacgtaggcacgcaaaacgaggaaaaaatctaataaaaaccaaggaaacagtatataaaaagtaaacaaacatgtagagctcaattttagatgaattttgcaagttgaatggctcaattcggagttcgaatgaattagatatgaattttagaagttttgagccatttatatgaatttctagaattattcacgaattattgcgcaattattatttatttttacaaaggaaaaggacctcgctgacgtcagcaaggggcggccggcgccgacatgcgggccccacacgtcagcgagtcaaagggggagggcgcacggtggacatggtccacacgtggcctcgggtgcgcctccaccacgtggacggcccagatcgacctgagccgatcgggcggccgaggggagcggcagccaggggcacaggcgcggcacgaagccggcccggccgagccaaggcgcggcggcggcggcatgcggccaccggcggcagcagccggcgacgtggaacggcggcgggcggccggaggacagcggcgcgcacggggacggcgacgcaccccaagaggcggagatcggcaagaaagggggacgggaaaaaaaaaggaagggaggagaggtcctcaccggaagcggcggccggcgcggaggaagatgacggcgacgacgattgcccgatggcggcttgcgaggacggagggcggacggggtcgcccttgaccttcagaaggagaagagggagttcgggaggggaggaccgatgcggggtgaccggtaacgacggccgaccgcgacaatatgagaaggatctcaccgacgaccgaggaaggaggagctccaacgaatttccggcaaagaggggcggcgaccgaggtcctcctcgtccttgcggagctgagggaggcaacggcgcgggtcagcgtcgaccgaagcggcggcgcgacgcggctggagtcgncgncgncgncggaaaaaggtggttcgcgtggctacggcgctacggaggtggagagggnaaatggagcggtggccgagcttgcccgggcgncggcaaagctgncggtgncgncggcgcagcgcgaagacggcggtggtggctgaggcacgcggctggagaacgctggcgagcggcggcaatggggaccggcgtggggagagcggggaaaagcgcagggagctcgggatggagtgggaaacgaaagaggggagcacgagggtgctttatatagggctcggggatggagatcgtgcccgggagaggcgggatcggctggcgacgtggggtggcgaagtggagctcgggatggcaacggttttcgcagggcgtgggggaaacggcgcggacgtgggcggcgaccgcgtccacgcatgcgcgggagagggaaccacgcgaggaaggcggcgacgtggggagcacggggtggccatggcggcggttggggcgacgggaggttggggaagaagatgacaggtggggcctcgggtcccacctgtcggggagagagagaagggaaaacgggcgagggaggtaaagcagacttgagggagagagagagccgagcgggccgagggaggaggctggcccgagagggagagaaaaggggcgcgcaggccgtgggagggaaggaagacttgggccgaaaagggcccaaagagaggaaggaggattttatttgttttctttttattttaattgatgcaatgatctttgtgctattaaaactatttctcaagctccgaaaattcacggaaaattccggagagtacattagggcacaaagaatattacaaaatattcccggccaataatttttaaaggaaattttaatttcctctataattcacttgattaagttgatttaacttttatttaatttctagaaaatgtattattaattgatttttattcccgaacgaaaatcagggcgttacactgaacaaggttggtttagtgatcaggttttggatgatctacaggggaaaacatagatgcaatcagattttccagaaaagagtaatcagagggagggaaagcagatagtcattgaggggggacagattggaaatgttgatctcaagtacagtggtgaaccaagcacagaggttcctaagggggggtctattgatgcctgacatgatggtggtggaagacaagataaagtgttcacaaatattaagagacaaagaattggcttttaagttacagtatgaagattcaactatgatacagctgaatgtttgtgaatcaaagaaatcctcaagtgaagaaggggaggtgcttggtcaggtggacaagatacagtcttctcaggaacagttatttggaggagggcagataaatgatcagatagacagcatatctagaaaagttgcagaggggatcctagaattggagatggatgaggaggataaggagaaagtttctttgaaagacagtgaagattatatggattctcaggaatcagaaggaagttttggccaagagattagatatagacttgactgaagatgtgacaggaagtcaagaataggagatgaggaggaacaaaagaccgaaggacaaggaggacaagaaaccttatgagatggccattgaaagaaaagaagcccaaaatgcttttatcaacaaaggtcagaaccagatcccttcctttatacatgattcaaatttgtctttagttgacatggctagtattctaggggtaaatcttggttgtgctgtggatgatgtagaatccaatgtgcatttgattaaagagttggacttggctagaattaacctctttatgaaagagggacaaaactctgattgccattttgatgatgtgtccaatagggagataaatcctgtgatacttgaacttaatgattctaaaaattccggagaggaggttgatgactttgaggaaattgagtttatgctcaagcaaatacaatcttcagctagaaaaatgaaacaaaaaaagggaaaccttgagattttcaaggtcactcctaaacttaagaaaaggaaaaagaaaccaaaagaattatgaaaaggcatattctggaatattagaggcatggggaacccgaaaaaatagatcatttgcaggacctaattagggattcaaatgtagactttgtgggaattcttgaaactataaagcatgatttctctgctggcttacttcatagcttaagtggacaaaaaaaaattaaatgggaatggctactctcatgtggcaggtcaggggggattctagtgggtgtaaacatatacaagttatcatttgtaaatgttactatggagaattttcatatcaggttaaagttgtagaatatttgagacaaaaaaacatgggatctgttagtaatatatggggctgctcaaccagagcataaggctgtcttcctagctgaattggctaaggagttccaaaaatctaagggaccctttgtggctggtggagactttaacattctgaggaaagaaagtgagagaaacaaaagttgggggttataataagtggaccttcctctttaatgcaataattaagcagaacaatttgagggaggttcaaatgggaggaagacaatttacttggtgtaataaccaagataacccaactttagaaaaattggatagagtgttcatcaacaatgaatgggaatttgtttaccctctcacctctgttcaatctttggtaagagccttctctgatcacaatcccatgttgttggacactagggaattagttaaaaaaaagagtatgctcagatttgaatttagttggtttatgagagaggatctagggactttggtgcaggaagcttggaacaaatccttttcaggtaatagcattgaaaaatggcaaaagagacttagctatctaaggaggaaattaaaaggtttgaataagaattggtaaggagaatataggaggagaaaaactgaaattttgaacaaaattgatgcaattgacttaaaagctgaaaatgttggcttgagttgtagagatagagaagatagaagagcctggaattgcagctgaaattcactattagggaggaaaaaacgaagtggttccagaggagcaaagaaagggaaatcatggagggagattgtaatacctaatattaccatgccaaagctaatgtaggaagaggaaaattctgattcactctttatctcaataggaaggtatcattacctgggcaagccg

SEQ ID NO: 35199 - DNA, 51460 bp, Oryza sativa
ccccttactaccccttcctcctccccttcttctcttcctactacaccataaatatttgaattcaaattcaaatttgaaacgggtatgtaaactttttgcttataaactttgggtctataaactaatatttgaattcaaattcaaatttgaaacgggtatgtaaacttttgacctataaactttgggtctataaactaatatttgaatttaaattcaaatttgaaacaggtatgtaaactttttacttataaactttgggtctataaattaatatttgaattcaaattcaaatttgaaacgggtatataaacttttgacttataaactttgggtctataaactttaggtgtataaactttagatgtatagaaatactatatacagaaaatatttgaattcaaattcaaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaacttgaggtgtataaactttaggtgcataaatttactaaaataagaaagtaatgcggtgtcaaaaaaggaaaccaggtggagggaaagagggggagggggggcgaattgatcgctacccccatcaccaggcgagcgatcgcccattagcatttccgcttgacaagcaccgtactggccttcgcgagctcgcactactgcagcaccctacctcctcacaattgtggaaccaactgctgctgcttggaggaggaagagaggggaggagggaagaaggaagaaatggctgacatgtgagccacattattttttcccttttttttaaaaaaaaaaaagattgtaatagtaatgccacgaagattgcgtgctgcgggaaagtcgtcatgggaggtcgattcggccgccgcgacggctgaacgagaaggccagtgaagatgcaccattttcgctagcggtggcaaaccatgagcgaagatacattttcactggcggataacataatggagccgccaacaaagatagttatcgttggcggttgccttataacagtcaccagtgaaaatgatcttcgctggcgcacttaagctacatggcccgccagcaaaaatgcactttaccagttgcttgctgacacgtgacccgcttatgaagatatttaattattttttaggaaaaaattgaaactatttttagtttgttcacgtacttaagaatcacacatagaggatatattcaatcgagcaatcgatgataaatgttttcttattgttgcttgcaacatctattgataattaatagggttaattggaaccatgtcattataaatttcattgtttggaaaaatgtcattaatgttcatctatttggtattatactattccaatttcacaggtataagagatatgctactacgtacccctcactgtatttctaacattttaggaccaaattacccctttatttttcttcttccttcccctctcttctctctttcagccgacgaactgtaatgacctcatgctcgaggagatggattctaatcatttgggcaaatatccacccgtttattacatgccaattaaatggttattaaaaaaaaagacaagatggatcaatatgtaatatacatcatgtaaagccttatcttatgtcatacacttgtcatacataggtaatgacactaaaaaaatgagttcaataggagcacccaacaaaatataccattgaacaaaacttcagcacgacaaaaacaagaaggttaagatcacggtctgacagtgtatcagcactattaacgtatccacaatttatactcattatcatgcctcaaaactgaacggcaactatccaacactgatccttgggttctttcgttgttacagtatgaaaattgaacccatcatattcacccaacaaaaagaagcattcagcttcagtgcacaaatccaaggataaaagcttaagacaaaaaacgtacagcagctgccaacttctgttcacatctgttggaacagtctcaagcatcaccatgaacaaaaacacggtccttatcatcaagaactaggaagaaacagcttttctttcttcatcatcagtgatcggtagtttcgtaggcacgtcaaagcttgcctttagcgtgcgaagtctttactctgtgctgattaatgcctggagcaggggatgccctgattctgcaattgaggtgcccgcaccattagatcctggatgccctgatctacaacagcaatgcctgcagctgcaagaccaaccaactgttagcagccaattacacatggaaaatatgacgggatggatgatgtcaatgaccaaccaactgtcaatgatttctaaggcaattctgaaaatattataactagtttggtgtgtttacagtcctgggagccaatactggagctgctactagcatgagttcaggaacaaggtaacttgtgcaggctagaactatagtaattgacatcagcagcatggctccaatgtgcaccaattcggcgtcacattggtcaacccattttctgggggtgcctaacagggcgaaactaactagaatcaggctctaattcagtagtaatcccatagattggataaactactaagtaaaaactggcttgacctatgtatcttttggtctagtcttggtaaaattgaattggtttctgttgttgttgagtccatttggacccctggtacctgtgcacctatttcaggctggctggctggccatgtgtcacacaggtctttttggttaattcatttgaagattttgcctaagacttgctgcatactaagatacctgccgggcatttgaaatttggtaacccacttcattgtcctgtacatatacaaaggcttctgttcgctgctagtactaccttagctgaccagaagttaggaatcaacgatgcatttatatgtgtgtttagttcacgtcaaaattgtaagtttggtttaaattggaacgatgtgacgaaaaagttggaagtttatatgtgtaggaaagttttgatgtgatggaaaagttggaagtttgaaaaaaaaagtttggaagtaaactcggcctaacctgcatttgctgttttggttgaaataagattcagagaagattcgttggtaccattaaagagaggaccaattttccagttgctcactaggtgatttcaaccagaagctccggtcgaagccccatgttcataagaccatgctagcaaaaagataaaattagtaaaacaaagcagatgttcaaatatcgctgggataatataccactctcaaacgccaaatagaccgttcttagcaccagcagaggtggggaagcgcgcataataccaatgcctcactcaagatgtgacaggcaagccccactgctatatgaagagctaaggggctgtgtggttttcgagacttattttaaggtcctgtcacatcgaatgtttgaacactaatttagagtattaaatatacactaattataaaatccatttcataatattggactaattcgcgagacgaatcttttgagtctaattacgccataattttgacagtgtgatgctacagtaaacttttgataattatggattaattaggcttaaaaaattcgtctcgcggattagctctcatttatgaaattagtttttttattagtctatgtttaatactctaaattaacgtccaaacatccgatgtgacatgggctaaaaaatttttagcaccatctaaacacccccacacaagcataaacaggagaggggttccatgttccatcaacagtgaaggtaaagaatactggcttgccaatggtatagcagaagggaacatctttgggatctggagaggtgggcatcactgccaatatttagaatcacaaatgtaagttacttctagattagacaaaaagaatgaaaaacttaacgtaagaatcagtaacagtatactatatgtaggtgcagcacgtgctcttattagggaacttgctgcctatggagtcccgaaagccagaacaacaacaacgaacacgaggaagagctcctcaagggggatcccatgggatcattttgtaacctagtttgtaaaaactctgggttttttttctctcttctcctaatatgaaataggcagagctcctgattttacccctaaaaaaacacgaggaagagcatcagatagaacgccttacggacaaaaacaacacaagggtcattcttgtgctgtcgacatacatagcatcctcttgcttattgtaatgaatcccatgtctttctagccaatccttctccatacctcagatgctatctgcatttaagtgatcaaattttcaatatggcaacatatttcaaagatatttggaacaacttaatagcacagatcgtatgcttcaatatgggtaaatggattggcataatataacttctttttaaactgaaactggcataatatgaccataatgatggaaaaaccatgtcaccgcctcaccggtcttgacttcctaggaagttgggacgcttgtgtcgggaggggtttgcatcgatacctcaaatcaaacgcatcactaggcggtcatgtcagcctgcaggggattccctggtcggattgaggcgtggcgaggacggcgctagaggtggctgccggcgaagcgctcctaattgaacctagagcagcactgctagctactaagcttcgtagcaagttggattataggcttaaacaaacaatcggcagcaaaaaaactccgatcgggtcaatcggcgccactgttaaaccctacctattgactattcccgccgaaggcaccggggtgggggggaggagcatgcgaaggccatgacgagatagatacttacaaagggacggtgcaccaggtcaccaaccaattctgtcgacggagtcgggggcgatcgccgcggcggcggcgagttggggaggagaggcggccatggagcttcgcgtggtgagttgggtgactggtggtaccaagaaaaaacgtgcaataaaaaccaccaattaattgaaaacccatgaaaactatatctaaatttctctaagttcatgaaaaaaaaatgcagagatggttatagttttgaaattattttacacaaaatcttaaatccgatctccaagaggaaaaaaagggacaaattccatgtgaatattaccctgatactattcatccttttttttacactcaaacgaagttaaatttagacttgatatttagacataatgtattttatgactatacctatatctaatatttttttaaaaaacttttatgtttgattttcataggttttatttgatggtttttacttaatatgactcaagtatgaattatttaccagtagaactacgtagattggggtaatatgttgtttttcaaggggcgaaaacgactcagaaatggatggaaaccacctttaccgctttcgttttcaaatctttttaagaatcacaataaaaaaaatcctgaattcaaaaatggaatcgaatattatcggatacggaaacagagctaatacaaaatgacgcggatatgggaacggaaatatatcggaatataaaaatccctctaagtgagcttccaagtgtttttttttctaaaacaatagataaaatccaaaattttagcaactaacatcccagatcacttcgtcacaaaaccgagtaaagtttgtacttactgccacaaagtgaggtgcatatcttgatctctcattgtggcaatcacaataggaagtgcagaataatgcatcacataacacaatcactcacagagtgaaagtcacatttaaattgtagtatgtcttctgctcaggtccaaatcccccaaaaccacgaattccgcgtggaccgcgtcgaggaaaaaaccgaactttcctagtgtcccctccacactctcatcgcgtgcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactacggtggaagaaaaatacacgcgagttctctgctcgatttgtacactgatgaagagaaggccacattttgtcctctctttttcctaaccgcagccgccgatcaccggagcaccacggcggcgacgaagctcagcacggccatggcgctggcggcggagcagcacaggtcgatgagcgcctcgcgtcgcgccttgctctccttcctccccttcctgctcttcacgaactcgtcatacctcctcttcgcctcgtcccgttctctccccccgcctatcctctgttcctccattgccgcagcgaggaggcggaggcttcgctcgccgctcgccgcggcgccgtcggcgtcctgcacggcgaggctgacctcgctgatgttgccggccccctcggagcaggtcacggtggtctcgaacttgcacccgcccagcaccaccgggaacctcaccagcgtctcgccggtgtaccagtgccggtccaccgccacggcgcgccggctggacacgttcaccgctcggccgcgggcagggtcgacgaccacccagctcagctccagctccgccggagacagcgccggctccgccgccggcttctttgcactccacggcctccacccggaacggcgagccgaggaaccacggcgacgacgcgggcgtcttcacgacacgggagagcaggggcgcccccctgtagtagacgtccaccgccgagacgagctccgacgggaggggacctccgccgccgccgccgagctccccggcgtccgggcgcgggaacgggaacgcgtcggcgaagagccggcgcggcgggaccacggacagcagccgcgggtgcccccccatggacggccactccgcgaggcagagcgcgcgccacgtctccgggtccgcggcgagcgcccggagccccgccgtggcgcagctcgccgccgcaagcgaccgcccgtccagccgccgcagcgcgcgcgccagcacgtcggcgtgcaggtcctctatcgtagtagtcgccaccattttctcttcttctctccctggcgccatcaccctctctctcctcttttgtacgatgaaccggtgataactactgcgcctccgccgtggtccggcttttatatagcactcctccttgtgtgccctactagtagtaagcgcggtgaactctggtcaaaaccacagccgtcctggctgcgacgtggtccagtacctgtacagtgcgttggtgtgtttcacaattttctttcgttttaacccgcatgccggtgtggccgtgtgggcgcggcttgcagtgcagggcgccggcgtggcagccgacgagaaggggtcggtggcgcgtgccagggccgcgctggcgcccgtggtacggcgcgacgcggctcgcctcggcgtatcatctcaggccgcgaacgcgtggcgcgccgtgtctcctccgtgccacgccgcggcgcgtctacctgactcttgagtcggtacgcgtcgtgcgatcggctggttggtcgggcgcaaccgcaaacgcaagcgagacgtgccgttcgttgcacttgacgtgacagagaaccaaaagaaaaacaggttttgtttccctgtgcctttcacggcgaccggtttttctggcttgatggcaaagcaaatctgttgtgcaccggtgtaccgtgtgtccgtgtatctgattcttaattgcgtttagaaggatatcgttttcctcgcgggggggagaaggccgtcgaacgatcggcacggcatctgcataccgctgagatgctgacgatgggggcggctcaccggcattaatgtcctgggagagtgagatcgagggctactggacgtgttacgtgtacgacggcttggcctgcgtacgtacagctaccgtgtgctgctgcgctgttgctcttgcagatttctcgtcaagaaaggcgcattgatacagggatatgtacgtccgtgtgtgtcgttcctatcctctcgcggtgacacgataagcctctcctaataattctttttagcacacgagctttctcctgatcttgcgattttctgcatgatctctcgttcggtgttcggtgaagcaatcaaaatgagaaacaaatgtggtaactttctgcttactactctatccatctcataatataagaaattttagagttatgcacagttattaagatggaggtagatggaaaaagtgaatgatggaggtttgtgattggttggaaagagaatgctggtgaagaagttgttatattttagaacaaattcaaagagaagttattgtattttgagacggaatgagtagtttagatgcacagcaatgctacgctgttgttctgtgattgtgcttcagctggggaaagcagagcaatagtattcagagtttagaactgtttatatgcataatgcaattttctcgcgctccatttttgaagttcctcagctttcaaagcctgggcgatcagtctgagcatgtcggtagagtcgcggtcatgattgccagagcaattaaactgaagattaaataaagtcatattggagtagattcagattggccccgcaataagataatcatatatatcctttgatttcttttctcataatggtttctgaagccttggctcggccggccgtcatgggttgcctgaactagcatcagggtttcggggcccaaatcctcatatggtcatatataactgcatgacgttgcaatatgtatggcaaggatctattttacatgggtaaatttgtttattaccgctgtaaaaatcacgagctaaaaaatacatgctactccctttatcccataatataagacgcggtcaaaattgacacggtctccaaaactaatctttaacctataattttccatgtactataaggttcctagccacaaaactataaccatatgaaagtaaatttaaatatcaatctgatataatttttaacaaataaaatttattttatactccattcgtccctaaatatttgatgtcgttgacttttttaaacatgtttgactgttcgtcttattcaaaaacttttctgaaatatgtaaaactatatgtatacataaaagtatatttaacaatgaatcaaatgataggaaaagaattaataattacttaaaatttttaaataagacgaatgaccacccatgtttaaaaaaaccaatgacgtcaaacatttagagatgaagggagtattatactaagtgttagtaaaatattttaaatgctaaatctttaaatacgtgtgcgtcttatattataggatggagggagtacgtcattagtatgtagatccagagatccagcctttatatgtcatgatcatgttacaatgttatgttacaactcgagtatctttaagatggtactaagttatccgattttacattagtataatgttttgagttaccatgtttttaagagaaaagatagttttaccaaagatttggatgctactatggtattacttccttcatctcagaataagtttgttttccatctatttgtcttacagagacgccatctttttcagcgatcattgcattagagtattgggagacaaacgtattgagatttgctaaagtggagaataattatattggagtttgctaaagtaagaacattctttttttttcctttgtattggcatgggtagaaatgggctaaaaatgaagtcttagtgatggagatagtacacgggaactgtctaaagatttcagattgcagatttcaggcttcaggcttcttttgtttgagaccaaaattaaccaatcaaaaaataaatgttgatattgccaaattatttggcttagggcttgttcactttatagtcacttttaaccttaccaaaatttggttatactaaattttaacacatttttacattaccaaatttttagtgctagatatgttttgtttgaagccttatcaagttttgatggaatttttacgagtggaaacttataaaactacgggcctgttaactttgggcctgttcactttggcattgccaaaattttggtaggatttcttatatagttaccaaaatttgacagtaaactaaatgtagccactttttttggcaactttaccaaaatttggtaaggttgaaaatggcatcaaagtgaatagaccctttgatgccgaaaaaaaaccttaccaaattttggcaatgttgtcaaaattttgacaacttgccaaaattttggtaggatttcttatatagttactaaaatttagcagcaaactaaatgtagccacttttttgttaactttaccaaaatttggtaaagttgaaaatagcatcaaagtgaacaggccctaccaaaggttggtagggtaacattaataagaatatgtataatttgttgccttacaaaaatttgataataccaaaattagtagggttaaaagtgacacaaaagtaaacaagcccttaccaatcaaaagcctagtcaattttccccaaaaaattagtaattaccattgtaaaaaagaaaaatggtaagatcacaaatggtaaagaaccatataagccctaattagagctaaagaatgcagctcaggaacatgtggcagtgatctcggcacaaggcatgtttcggagtaaaaacagattcttcaaaaaaataacttcatacagacagaaattcaacattttcagtctaaaaaataagaagatatttggagggagaaatgtcccttcaaacatttttttaagaaaaaattatgagcatgttaggatcaaacacaaaatcttggagttgaaattacataccccttaccgctccactgcactgtcaagtgcatctcagcattttagtctcacagagaaccttctgttgtgttctagactgagataattattttggttaatccaattaatcattatctcgagttacaacattttttctctctagagaaacatctccattttctcatcgtctcccggtttaactgcattattatatacttcctccgtttcttaatgtaaatcattctaccatttcacatttatattgatgttaatgaatctagacatatatatctatctagatttattaacatcaatataaatatgaaaaatgttaaaatgacttaccctataaaatggagggtgtaaaacggagagagaagctgttttctgcgcagcttgtttatgactcgcgcatattccttgtggacaattagtcattgaactaggacaagtctagaagtggaatcgtggaaagcttcgattaggtaaagaaaatgaatgtaggaacttcatctggaccaaatgccacatttgacatccaagttaagattccccatgttgtctcatgcgcgctcgcaagcctctcctttgcatgtcgccgtgtcttcagcggtcaagccgccttcatcgatcctctatttgcacgttgtgcagtactgaattatactataattctgattcagtacaggtgaagagtttttttaaaaaaaaactgaaaacagcactagagtgtcttttcattgaatagggcgtacaggtgaagagttagaagagtgctttggcagcacctccagcctcaagcttgtgatcccgtattctgagttaattccatgacctaaactcaaaccattcggctcttcctcttgtgtagtatatatctgttgacctgctgctgtcctggaaggtttgcttgcttttgtcaccatcttttcgtttctagcggtattgcatcgattgatccatctaatccagcatgttacccagggaaaaacttggctcgaatcagcggccgcgcgtgcgtacgtgctctttggtgcgatcggatctgataagagtcctggactctggacgtgtcttgttaggaaggaatcccgtcgacgaaggctgtttggtcggcgtcgctctcgatctcacgggctcactgtacgtagtacgatgcagagcagttcatctcatggcttcgtttgactgacaacgggcgatgatcggttatcctgtaagacactctccgccagaagctgtgtacgggatgggaaaactgaactgatcgctgatgtatcaggatcagtcgatcagaagttcaggacagatcggacgccgcgatcggtggcgcgtggaatcgacggagaaaattttggttggatgtcggtacgccccaaagttccagttaaacacttccacaccctcttgctctgtggctccgtgcttcagcgaccttcccatggtacgacggccaatgaaccgagctactcgtctactcctttgctagaatgctagcttctttccccgcttcaaaataaaccaatataaataataataggatataacctaggataataatctggatatcgttatcttagatcctctagattgttttttattatacattctaaaatatacttcctcgatcccaaaataagcgcatcaatttttgtgtccaactttaatcgtccgtcttatttaattttttttatgattagtatttctattgttgttaaattataaaacatgagtaatactttatgcgtgaattatgtttttagtttttttaaaaaaaattaaataagacaacgattaaaattagacacagaaattcatagttgcgcttattttggaactgagggagtagcaattttgcacacgattggacacattcaaataccatgaatatggataaggatgtatcctaagccgagtttagttccaaacttttttttcaaacttccaactttatcatcacatcaaaactttcttacacacaaactttcaacttttccgtcgcatcgttctaattttaaccaaactttcaattttagcgtaaactaaacacacccctagtatcatgaattagatagatatctattcatattcagatttatagtattataataagaccaattcagtactaagttgctttttttaagatggagtgagtatctcattagtcgcttgacgcatagttataaatgaacagttggtgtacttaatgcgaaatttgttaggaagcaagtgcaagctgattgcaatcagggagcaaagacatcgcgatgaaccattcagtaatactccgtccgtctcatcataatatagtgatttaagataagatgtgatattttatactacaataaattttgtcttaggttgctatatactatatccatctcaaaatatgtacatccgtggatatctgtgtccaacgtttgaccattcgtcttatttagaaaaataaaaaaaattagtcacacataaagtactattcatgtattatcatctaataacaataaaaatactaatcataaaaaatattaaataaaacaaatagtcaaacattgaatgaacaatgcaaaacattatttattttgggacggagggagtatattatgaaaagtaaccacgctagtgtgtatggtagccgcggaatgggctggccttcgggagttcgggatctttacggattggaataagtgcactttaggtctctctattcgtcgctcagtccgattttcgtccctgaactgtaaaaccgggtacaacccatcccccaacttacgaaaaccggacaaacgaggtccctcggcagtatggagggcagttttggccgacgtggcgtctatgtggctaatttgacttgatcttcatctgacgtgatattgacatggcgctgacgtggcaattcgatccagaaaaatattaaaccccgtggcacccacatgtcagtttgacacacaaattaataaaaaatagtggggcccacgtgagccccacatatcattctcacccttctcttcttcctcctccctccctctccctctccctctccctcccctctcgtggaggagttcagggccgcgcatgtgggcgcggtgccgggagctgcacgaccgagtcgtggcgtccgcgtccccttccctgctgcggcagcccgcgctgcggtccctcctctgcctcgttgccgtcgagctgcagctcctcaaactcctaaacgacaccactaatcaatggatagctagctagaggaagagctcaactgcatgtctgccactctgcatgcttatggttcatggtgtttatggttgggggttgaagccagcttgaacacatgtgtagtacttcggtcaactacattggtagagagtataattggactgagctgcgttggatggatgtgaagaagagcgagacggcacgaggcaagtagcaggtgatgaggctgcaaaatgagaaggaacatgagcaagtgacgacgacacagtcgtgcagcttccggcacctcgcccgcgtgagctccagttcgtcggagtcgggcggcgccgtggccccgaactcctccacgagcccccgcgcggggtccgcgccgctgccgtggaggaggaggaggaggaggagaccacggcggccggctgtgccagtgggagagggggaagaggaggccggcgagcaggttgccgccgagttgcagccgcacacgggcgggaacttagcgccgcaccccgccaacgacgaggttcccgccgttcgcttggctccaccgccccgccggcttcgggcgccgccactgcgcccgcgcgtccgcccgccgctgccccactccgccccgtcggctttgcgccggcgtccgcctgccggccgccccccactccgttcagtcgttgtccccggcgccgctgctatgtggggtgagatggggagaaagaagaggtggggtgagaatgacatgtggggcccagtggcccacgtgggctccaccattttttattaatttgtgtgtgaaactgacatgtgggtcccatagtgtttaatatttttccagatcgaattgccacgtcagatgaagactgagtcaaattagccacataggcgtcacgtcggccaaaaccgctctccataccgccgagggatctcatttgtccggtttttgaaagttgggggacgggtcgtacccggttttgtggttcaggacaaaaatcggactgagcgacaaataggggacctgaagtgaacttattccttacggatttgcgtctcccgcccgctgggttaagaacttacgacgagccgctgtttctgatcgtgtgcaacggtgaattggtaaagtctgctgtctgcagcgaagcccggtatcatgccttgtgaggtgaacgaactaggcgggccggtggctcatcacatccacacaagttatctacctgttcaccactttacctcgttaaacagctccagttcaccaattgcatagtctagagtctagacctcgatcacattccaaggtagtagcacgaaaacagagtacctgatctggaaaaacatagtgccggccatcgcctaccaaagtatgatttgcgggtacactactacgtgcagttaaacttgtcgaaacaaagatttcggtaatacgaaaaagggtggctatcaagctagaaaagtggatgggtttagagacacaggttcaggccatctcaatgagaagtaataccctactcctgtccggggattaatccaccgagtatattattgatcgtatgatctgggagaaaagttatgtcccaagagatactcggacccctctttatatagggagaggagtccgtattacaaggtatagcctatattcctaacggaataggcaaataaagataaaatacagtcgtaaccgactagaatcccgagtatttccttgatatacaagttaaggaatgtaacccgagtcccttaaagatattctacctatatatggcattccatatccagtcggatatacatgccgtgtaaatatggggtatccataatctccacaaaactgccatagtcttctactgacgaaattaagtttgcctcggtaggaactactagctgagtactcagcatactggacggcagaaacagccgtggcactggccttatccactcatatccaagtggagtctcccaataggccgctgcacgggcgacgaatctatttcatccgctgcaagtgatccacatcacgcgagcccccacaacgatccgcgcccgctcatcccctcccgccacgtccgcaaccgcagccaccaccacaaaataaggcctaacctacgctgccacaaaccacggagacaacacacgcagctcgccgaccagagacagagagagaccatctgctagcttagctgccatggccgcctccaccgtctccggcctcgccggcgccaccctcgcccgccggccggccttctccaccggtgcgtgcgtcacagtcacaatcatcttctcacgcgctataaccgtgtgtttaatttgatcttggaatgctcgatttttttgtgcaggcttcacgacgggcgcccgggtgtcggcgaggaacccgctgctgacgaggaacctggagaggaacggcaggatcacctgcatgacgtaagtagcagtagtaggatcacctgcaagaagaattctgagagcagcaagcgtacgtggcgtgagattctgacggtgcgtacgtggtgttgtgtgttgggcctgcaggtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggtcagtacctctatcttcttcaggcacgcagtatagtactcctatataattagtagcaaaagcgttcagtggctacgtgtctaattgttcatgtgggttttgtgattaatttgcaggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttcagattatagccaaaataaacctagacatagacttattcaaaaattttggcaatattgtcaaaattttggcaggattttttatgtatttaccaaatttaacaacaaactaaacatagacatttctttggcaactttactcaaaaatagtatggttgaaaatgacatcaatctgaatagccctaaatcaggctggcctgggtcaaatacaagaaacataaccggtgagctattcttgaacgaacgtaattcaggatacaacatattgttttgattctacataatttataagttgaatttccaaaactcaatcaaaccatcaatcttcaaatatttcaattggatatatgaaaaccatgtgtagattttcttttaaaaaaatcgtaaacatgtacaaaaaaattctgaatttttacattagttgctcgtttgctactgggctagctagcagtctagcaccacaccaacatggctaggcccaagcccaactcgtgatccagtcatccatagtcgactcgactttgggttcgagcgatcgaaactcggtaacccaggcgaggcgaatccaaatgcgaccacccgctggccggcctccccgctcgccgccgccgccgccgcatgaccaccgccgtcctccggccatccccaccggtcgccaccctcctcggccgctgccgcaccgcgcgctgcctcgcccagctccacgcccgcatcgtccgcctcggcctccacaaccaccacgcgctcctcgcccgtttcgccgccgcctgcgacgccctctcctgcccctccgtcgccgcctccctcctttccgtcgccgtcccggtacgcctgcggaacgccgtgctcgcctccctcgcccgccacgccccgttgcgggacgcgctcgcgcagttcaacctcctccgcgggggcgcgtcccgcccggacgccttctccttccctcccctcctctgcgcctgcgcgcgcgcctcctccctccccaccggcgcttccttgcacgccgcggccatccgcctcggagtcgacgccgacctcttcgtccgcacggcgctcatccagttctatgggaggtgcggcgccgctgccgccgcccgggctctgttcgattcactgacaaaccccagcgaggtctcttggacggccattgtcactgcctatgtcaactctggtgatattttgactgccagggagttgttcgaccaaattccacaccgaaatgtggtgcattggaatgccatggttgatgggtatgtgaagtgcggtgacttggagggtgcaaggaagctgtttgatgaaatgcctgagagaactcctgcagcgtacacatcattgattggcgggtatttaaatgcagggaacatgggagctgcgagaacattgtttgataagctagaggaccgtgatttgttcgcatggtcaacaatgatatcagggtgtgcacagaacggttaccctggagaggctttgaggatttttaacgagttccaaaagcaagaaatatgtccagatgagcttgttattgttggtttgatgtcagcatgctcccaacttggtaacatcacattggcaagatggattgaaggttacatcatgatttatccaatagacatgaacaatgtccatgtgatggcgggtctcattaacatgaatgcaaagtgtggcaacatggagagagctactcttttgtttgaatctatgtcagttcgagatgttttttcatattgttcaatgatgcaaggtcattgcctccatggttcagctagcaaggctgtagagcttttttctcagatgctcttggagggcatcaccccagataacgccgcgttcacagttgttttgacagcttgcagtcatgctggcctagttgaagaagggaaaaggtactttgatatgatgaagaatgagtatatgattgtaccatctggtgaccactatgcttgccttgtcagtcttctcggacgttttgggatgctgagagatgcatatgagcttatcaagtcaatgcctggagaacctcatccaggagcatggggtgcattgctggggggatgcaagtttcattgtgacattgagcttggaaaaattgctgcaaagaagctctttgaaattgaaccggaaaatgctggaaattatgtctcgttgtcaaacatttatgctaacattgaccgatggggaaatgtttctgaaactagagctgagatgacaggaagagggataacgaaaattgcaggctgtaccttggttttgcagtagcatggttgagatgagtgagggatttattttgccatatgtttactggccctactggaaagttcagtgaacatctttctgaatgagaggaaaaaccatgtgtgctgtaatgctgtgcatgttgactcatgatggttatgagatcaatagaaaccaagagtttacactcaacctgagaatgcctacaataaatctggcttcatgacataaatgatgtgcttgttaacaagctgtatgggagttaataagaggaacgggaccatcttaagtagactgttctcttcggagtgctttgaattctttctgccgttgataccttatgagaaccagaggattccgtgacactggtttgataccatccacttctgttgctgagtctcatccactttttcaattgttgatgagacgactcccggtgagtgctcgcttggtcattcctaatcttctttactacctatcttagttattgttcatcaattcgagcttttttataatgtgatttctactgaactactacccatcatgcaaactaggatggttacatgggggaaaaggttgctgattatttgccttggcaggatcagtatgtgatgtggtatcctgatattggttgtcattaatcagaaaaaacaagtatatagctcttcaggtatgtccttaggattcctattatatcttggtttccatgtgtggcttgagcttcaatgccctcactaagtatgttcaaatactcagataattgtatccagaagtttcattttgaaacaaaggcagaagctctgccttaattcattgatatagaagaggcaaataacaactgtatatccagaagttgtggagtgcaaaattttggagttttgagcatcgtgcctcggctatacttcctgaaggtgagaactacagggttcaattagacttgctaactgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcgatgctttcagattcctccatttggaatttggtttgcaaatgtggtaactggtaaggtagtaacatgtgctcctattaaattgtgtcccctcatcctagtcttaaacaaaagtgattagacttgttgttgagtggcgtcaagtggaccaccttctgcaggccttgttgctgtttcatctgcatagtgcctgtcacctgtgtggctgtgtgtgtttttgtggcccagcgtcatatcactgagaaatgtttgagctgaaagttttctgactgtacaacgctatgctaaatatacacatgtatcagacaatgaattcgctaacgatactgcacgaagtgtcttctataaaatgcaatgtcgatggtaggctggtagttatcagcttgcagtctcggacaggcactaccgccactatgttgcactatatcatctttcttcctgaatcttcaaatcaaatatagccagatttatctaagatctgtgcatggtgatgtagtgggatcattggcaagtcatgatgtttagtattttctgattataaaaaggatatcagtacacccatagatacatgataatacctgtgctcgaaggtttggtgtttgcatgtgctctcctaggtatatagacctcatctaatcacctagcctgttggagaacctctaccataggtattgcacgatccttattattttggtgtgtgaatctattaggctccgtttatggcagacaaacttatcttcatgtcgatttaattattaataacttgcccacgcattctgctgcaccagtgctcttccaggtcaatgagcttgttattaatgaaatcatgcgttgattcaaacatctccctatagcatttgtattagtagcactagggagtaacgacagtttgggcaatatataaacaatgccattaaattctcgggctatctggttggtccatgttagattcttagtgggatgtgtgaattgcagcactatgtctccgtgtgggcatgcgcacgagtgtatgtgcatgtcgtatcacatgtctaacaccacggtgcacgaactgaatcctggaacgttgtcccgttgaagttatcagcaattggagaggggaagctaattttgtcctgcttcttctttgtcagggataacaaagaggttatttgagcaagtacccgctgtgctgcgagtaagattcgagttatcagcggttgtttaggttggatctcaaagaatcaacatactggtgagtgttcatacaagttcacccttctggttgattaaatcatatgaccaattgttttgtgctagagcaaaccaacattgctttgcttaatgttttcatcaaatgtcaacttttttgcatttgtatattgcatggatacttctcagtatatcttctaaactttcaaactcagaagatattgcatagagataaatagtgagtatataagataaagctagaattgtacgaacaattaaatggaaataaataagatttagacttgtccttagagttgacattaggtctggactttgttgtcatgataattatggtggtattattagattttagtttttctttattgaagacatctatgaagctaatggttgtatttcaaaccatttgggttagtagttatggtttttcttacaatgtgtcagcttcttgcaatagtttagtcacaagttcgtaccatcattaaaatggagtaatcccttcacttaagcgaagattaatgcgatgccctgcactttgaatccactatcttttaaccaaagttaaacaaatcctattgcttaatgcatggttagttgcacacgcccgtgcgtgtgagcggagattaggtgtttgactcactgctgcagcgttaatgcgcaggatctttttaattaggattagaatatgatatttggcctaaacttatataaaagtgggtgttacaggaggccgtgtggcacttaacccccacggcgctgtgtggttaaaatattgaggagatgttcccttcgtgggcgggatgatctattgtctattctctcgatgcaagcaatgaaggcatggaaaaataactgccgacggccaactaggattgtgaagattttttttcctttttatttaagaactgtgaagatctttcattctgtgttttctatcgttcataaaacctgtagggtatgtgtccgttggaagttgcgatcgtctgtttcaaatatttgaacttagcttaaatttgaggtgtaattatcaatgaaacttgttcatggatgtctagctgttgaagtttatttgtatgaatgaaaccgcagttgaaataaaacttccttttttttttcaggaagtatcctaacatctcaaaattctgtctaccctttgattcttgcattttgtccatgtttatccattgcacaacctacagaacaatgaagttgtttactaaaactgctgctggtgacatcattttcgaaagcagctgttccttatggtggattttacaagtaatccatcacaaataaatgatttggaatagactctgaaatgcgaatttaactactgatttcaactatgattgatattgtgaaacataacaccgttatagtattatgaaaatgtattttaagacagatttgaacataccattttcatatatccttctaaatttataattatttaaaagagagtagtggtggtgttgggtttaccataagtccatcaccaactcctaaaactatgacatgtgaaacacatatgtccattctcaaaaccaaatataagtaatgataagtcaattgagtcagtttaaaattttttacagctatataaaacatctaatttcattccagaattaaactctaaattcaaaatagctttcttttttcaatgcgccgatgtgattttctatattctgtaacaacgcactggtattttgctagtattcctgcacattaattacacaagtgtatatactttgactatggatgtttaacctcacccattttcgactgcgtctccacatgtaatatttatagacactagaatttaaacctaagatagattcatatacccaacccgctactacaacccactactacaccgcaccacatcctcaactgcacactactacaccgcaccacatcctcaactgcacatgtaatatactgtacgcagtggtggatccagaaaaaaaatagtagtagggtctgagcaaactagataatgttacagtcccccctcctatctatatatggtaaaaaattttagtggggtcttcgtgggggctcgagaccccgccacccctatgctggatccgcccctgactggacgatgttgtcaaacgaatattgtaaagtgtacaaacttacttatcaaaagtgtactccctgtgtgtttctgaatataactatcttttagaattcaaattttgtgtacaaatataagcatttcttagagtcctactctcactactcagtctaatatctcccaattttatcttcaaccatcatcccacttccaagttccaactatccattgctttatttacagacactatagtttttatctccaatcttaatatgtactttctctgtcccaagatgtagacttttcacataacgtttaacaagtcatcttattaaaaaaaatataaatatcatttattttgttgtgtgttttatcataaaagaaactataatattaacttatacatttacatatttatactaaatttttaaataaggcaaataacaaacattataaaaaaaatcgatgacatcatatattggacagagggtacaataagcaatgtaaaaagtgcttatatttggaaactgatggaataggtagtcacgctgacaagtgacatggactagccatataagatccacttaataatacggcctaattaagccattagcatccgacatactcccatcacctctatccaattcaaacatctaagcgcgacacctcgcaagtcttcactaagcgagtggcatatcagcatcatctgatcatcagcaccacaaatactatatcagtagcacaaatatcagggcctccttcaggacgttcactgaaattcaactaactcccacgaaattcctataaaattcatgcgttccaaaagagctatcatagtattcatcaatacatacctcaaaataagacaagcaacaagagagtccactagaacagcagctggagtttaaaaagtaattaaattgtgaattttgccaataacttggtaccttatgcgaaatcgcaatatatccaactattttgcattggagctcattgcctttgcaaccacaacaagaaggcgcgagaaaactcagtggagattatttttcactcataatctctaattaagctccttagatgccaccatggaattaaagaagagcacatgggtttggcccccatacaccgactaatggcaatatatacgtgcaaagatacatttatataccatatcctgtactaagcaataacctagtggcacagttatgagctcgcatttgggtcaaccttgccttcatagttgccttcaactccgagactttacctgcaattttagacgcatcatcgatgaatcatgatgaatggtggtgaaatattataaaatcaggtaaactgaactcaaacctttgatcccgaggccgatagcgttggctctggatcccaaaaccatccattactgcttctatttgcccaaaacgggagcattaatgctagaattagtcctaactgaggcaaattattttctctacaggtggctatctcttaaccttgatgagtagcagcattgaccaaacccaatgcaacacacaaaccaaaacaactttaagtgagttgtatgtcatcatcattaatcaaggtgggatatgtaagcaatctcggggattacattagtgggttgatactagtatgactttacaaagtttaacccttttcttaattgtaaggtgattaagtcacacaatcaggatgcaacatctccataacactaacaagtcaactaacgaatttaatatctgctctcggcatttaaacactgcaagctggaaacaagaaaaaccccaacggagctgagatttcaaagtgctgctcttatgtgcatcaaacaaagtggcattaatgtattacttatctcgtcgtcattgtatcaagatgcgcaccagaagcaacgcatcggtgcgtgcaagaacataggtgttgcgttgcaccatttaaagacctaattgcataaggtgcactagcagcatatctattcaagaaacctatttattcgattaacataaccatggctcaacattcaagttctctcttctctccttttttttttgacagcaatgctgggcatttgagatggtgtgcccaataaattccattcaaggccacattgaagtagtgaaatgaattggaggtcagtcaaatttctataatctttagaagcaatcaaaaaggacaaatagttgatgagtttcaactttcaactccacacctaaaaataataaataattgtcataattacccaataagtccagctaacttgcttacatggccactacaaagttgtaaaatctactggaggtaattaagtcactagcaaacttttggcacaattaaactagacatgcctatcatgggttacaattttcaaccaggctcactgttgggagattgccacagtcatctagcatgtggctaaagaaaactaccgccgaagtaagaaaaaaaaagagaagattcatcactggaaattttcttctttcagataaatgaaaaaaaaacatttctttgccttgtgtatatgaccaaccataaagcctctcacctcgcacttctctcccacccaacacagattattcaacccctaccatgccactctccagccatgaataccttggtaataaaatgcgtccttccttagcctctagtacatgaagtagtagtagtactgctatactcttaatgctgcattaaagaaaaccaattgacctccccctcaccctcacccatctcatccccctataaatacttgccatctcttctccgtccaaccacaccacccagcaagaagaccccgagcaattctacccgctcggagctcctcccctttcatcgtctccaatcaccatcatctgcacgtctcaccggccctacgcaacagtaagttccttcgccatcgccatgtcttctcctacctctaagcttcatatgacagtcgtgcaaaagtttccatttgaccaaccggctaacgaacgtttttatgggggtgtaggcaagtgggttacctctcgatcgggatgagccgcagcaacaagaagagctctaggggcatcgacctgaagctgaacctctcgctgccggcgagaggggactcgtcgtccaggagggcgatggccgccgacgaggagtcgtcgccgagctcgtgcctgtcgtcggagaacgagcacggcctgcagtggtccaacagcccggaggcgacgtccatggtgctcgccgcctgccctcgctgcttcatctacgtcatgctcccgcaggatgatccgcggtgcccgcagtgcaagagccccgtgatccttgacttcctgcagcaggacaacggcaacaacaacgccaacagcaatagcagcaggaagaccaggagagggtgaagttaaacaaaagggggggcaattctccgtttggcagaagatcaacatcaatcaagaaaaagaaaagcgtctatatgaagtcctaggtccagtaattctcttttgttttgcctattcccccagtgtaaccatgatatattccttactaaaattgtgagactagcatgaaaatccatgtgctggtggcataattttgatacatcatggatacactggggactatatccatccccctctcctggcttccttctttagtggttctaaatgaagaagttttgcttagacataggaccagacttctcatctttgttttgtttttgtttcctttccgagatgaaaagaaaacatttaccctgaaaatgttgagatgattattgttctgaatcacatgatggctttctatcaagctcatgaattctgactcgctgtgctgtttcattagacaaggtaatctagtcgagcatagaaaatggggaaaaaatcacagcaagaacagtcaatcacataaatgggatgtttacgagtctgtcatcacaggttagctgaactaaccaattggtactgctgctcccacgttgcaacataatgaggtcgccttccatggacactctactatctctgaaaaagacattatgtaattgaaaaaggtatgcaattttcaaattaggacgagatatagtatttgaaattgttgaaaaaaacgctgttgatgatgccatgcaatgaatagcgattaattttggcatccgtcattcttatctcttcataatatacatccatctgaaatacgtgctgtgtgacgcagcaacctaccttaattgcttctctagtcaactttgccaagctgatatatttatgttcacttgataaagacatctcagattaagtccagatcttcataatcacacatagagaccagccattctacaagttgattcaaatcatatcagaagggcagagagcaataacaaataaagatggaaaaaaaatgtgcatgaaaaattagatgtcccttggtccctgttgactggtaacggcaaacttgtcaattttattcatcaatcaacgaaaacaacagtgtctctagctgtattctagtattttaatgacaagacaactgaaaaggaatggcccagccaataaaatacaaaactgaatggcaaaaagattaagaaaaggtaactagaactaaattgcaggccgaatatattatgacttagcctaaaaaaaatgtggctaaccgatataattgatatatttgtgagattacttgcactcgccttgtcctgaacaactagaggacacatcatttaaacataaatactcctgcaacataaggacatagctaattgcaaagaattgcaataccagtcaggaacccaacaatgcaaaacagacaaagaaagcattacccatggttctccacttttgtggaactaagttcatggtccaaaaatagagtaggcaagagaaacatgagatcgaagacaaatgaggcttgagggggtcactaaaaacagagataaactgcatttgtacacttgtgttgagttcatggatctcctgaactccatagaaaatcagcattcagtatgcagaaaacgcaagaactggtatattgatccaaaaatgctaaatcgagtgcaaattacgaagctcaacaaagtctttttttttctttcatgctgatgcacttttgtctttcggtgcattcttataaaaggaagaacaagcagaatatagattccatcctaataccagtaacagggatgagcatgactgctacataagcatagagaagaccagaaatgaaccaatgagcattcattctgttgctctgttctaataaactttattagcttcctattgtgggacatcatcaggacaacaccttcaacactgtaaattggcggaaaattcttctgaatcatggagctagcaaaagtgagttatgacatcaccaccaattgtgctcaacttgtgcaatgcacacaaccgaaaaagtggggaaaaacattatgagtgcccatgaatattcgtaaggcccatacattgaattggatgaatgaatagactcaacattaccacattacgaatatgaagagtccgaatatcaatgattgaagttgtgtcgctgtatgcaatacagcataaacattccatctccaaacatctcaaagctagacacaacaaaatcaagtttcacaacttacagttcctggttggataagaatgaatctttcagatgaccgaagaaacctgcagcaatccaccatccatccagcaggatctatggtataacgcatcaaaattggttaaacgggcatacgaaagcgactccaaaacgtcgaatccaacaaaacccccagatattaccgggcaccctcttttctactacctaaagctaaaactaaaagcaactcagcattgacccccaaatcaaaattttaggtgaaaaaaaaaacctgccctaaattaccgcctcggatcggagaccaaataacacggcgctaatccggaatcgcccgggactcctggagcaagcccatccgcagaagaatggctactagatggagttgcttgctcgaattacctagttagaagaagccgagaagacgagcacttccgcttcgattcgtcttttgattttcgaagcgaaaaccccaggaataaagtcgattttacggtttccgccctagggctttcctttcaggttttgcagagctcatcatgggcttttgattgggccgggccttgtgagcaatagcccaactaatagagctaataaatcacgtttttccgcaatatgtactatgtcaatatgataaatgatcctgcgtttaattttgctttttgtcgctgctaagaacatatagccatatttttttatgactagcaaatatgcccgtgcgttgcaacgggtgaaaaaatgtaatgataatatacatttttcatgcataaccatgttgatgacaatcaaaatattagaaaattggaatatcataaatataatagcccaacctcgatgatggcaactttacgatatttgctttaccaaaaataattggattattcatatgacaacattcatataatctaaaatatttttttaatttcattattgcaaataatcaaaatcctatactgcctcacatggtcaagtctacacaaaatagagtcaccgtgcactcttctctaaataacaattaaaatatgtttattttctaatattatttccatataatataacaaaacaaaagccgtgtaggagatggaaaaaaaatcgatggatcctatttgaccaagcgttcatcaatttagcatttttttttctgacagttttttcctcgtatgattttttttatagacgatggaaatatttttttctcgcatgtttttttacaaactactaaaacctttttttctagcgcgtttctttttgcgcttttttttttacatttttttcctcatgcgtttttttaaactgtttttgttttctcgcgcattttttcttttttaatatacgatggaaacttctctttttagttagattagattagattagatttgagatagagaagagatatatatatggaaaactaaacgacgaatagaaattagacttttttgccgcgctttttccgtcctttttttttctcgtgcgtttttttacgaactgtttttttcgctactttcttatagagtcggacctttctagatgtttttttgggtttttttttattttttaccgatttttttttgtttttcactttacaggaatcagacttttttccctgttgtgggaatcggatctacgtttcttttttgtttttttttgccaggaaatggaccttttttttgtttttcctgttttaggtgggaatcggatctgtttttttaatctacatttcttttttttcgccagttatcggatttttttttgctttttcccgttttaggtgggaatcggatctatattttttgccagggaatcggattttttaggttgttttttcgctgttttttttatattgacggacggtggaaacaagttaaattttttaagagaaaaaaaagtagtctgaacataactaggtagaaatatttttcttagcaagtctattgatgctgcttgcacatataaaatcttattgctcctatatatattggtgattcaagatttttaagttgaacgtgtgattccaaaacatgacgtccgaacaaaaatatttttatatgaacgatattcccactggtcataaatatttaagtttaggatgaaacttggttacattttaaactttgaccattagtaacttctcaaattattagtttaaaagaaaaggcaaaaaattgtttagatttatcttgaaaagtactatataaacttataagattttagaaacttactatgatataaaactgatggttattttttaaaaaaaattgatcagatcatgtcttaaatgtcaaatattcatttattttccaaggacaaacataaactgaagtttttttaagaaaaacgaaacgaaagatcaaaatgcaccgaagttataaactaacttatattcttgaaagagttgagaatgctaaaacgccttgcacttgtacagcaaggccttctgttgaatcctttgaacaatcaccaaatcctctgccattcctctatatttgtactatcgccgtgtttaggtttcaaagttgttctttaaacttccaactttttcatcacatcaaaacttttctacacacacaaacttctaacttttccgtcacatcatttcaattttaaccaaacttctaatttttgtgtgaaagcctatattcaaaagaagcatatgcaggagtcacagggactgaaggagtatataggagtcgaaaggagagagtgtgtatggcagtattgtcctcttccggccaatccacacacctatcagcgacctgtcaactcgtagcacattcacacgtggcagatcaaatgacacgtcaacttcgcagcaataccatcgttcccggaaaataacaaaatgtaatcatagacaatatctcacagtgaagaaaatgattctcgacaggatcagttagctacagggcaagcaggtcgtctcactctccctgcaacatgtgaaggttcgccatgaaaaaacaatcaagctatcattgacatgcaaaagacaggaaagagaaaaaaaacaatcgctcacaaacctacagctacaaccaccgttgatttgtttaagtcacacctgtcgggttaagttcttcgtgtacatttctcacggtgatcaatcacgcagctccctatgtatatgtatgacaagttcagtgttcatccaggccaaagagtagataattaggcagttatttgatggtgatcatgcacgcatgcctcctgtttcgatcatggattggctctaaattccagccactgtcttgagcgattaaacatttctcgaaggtgatgatcaatgggaatcccagggtgatacattgatgctactagaattagtatgctgtcaagtgtccacgcaagaaacaagcaaggagtcaacttcgcatgtgctgatggagaattactgaatcagttgctaatttactctgttcttccgtagaaattctagctgcagtggagaaatggtaatttggtatagaaccaaaagttgctgttacatatgtcaagagatgtctgaatcttctgctccccatgctccaaatctgcttcccataactatgtgcagcataaaagggaaccacctgctctttgtccttttgcgttaagtaaattcaggcattctgctgatgcctgatgcatcttcttcgacatgagaggttaatgatcaaaatgccaacaaaagtctcaattattagctctgttttttttactcttttaataagatgccatcgatccaacaacacacgcattataaggctctttgctcctgaccctccataacatgaacaagaactacacaatcaagaagaagagcagtcgctacaagagaacaagaagatggcttccaaacacaaccaagaacctggaagaaattaaggattaaagcaagatggccatgtaggccatttttattgtcggtttataatttgcctcagcctttctttcccccttttttttaaggggacagatcattaggccctgaaaagtgcaggcactgcctccctttaagcactaacactttaggtcaacctttattagcctttaggatccactttttgttgaaacaagttgatgcatattccaaccttttcttgtcctaaggtacaggagaacctgataggggacatcatgtcacattagggggaattcatagccattggcccctctattttgtttctgtttggacacaagttatctctcaaagttttgttctcttgtcaaaggataatcttaaatttgcataacctaacattgccacatgtgggcgttggataactggcaaactacaagttttatttataatctactattcaatgatagaaaaaaaggatgatccagatcaaccgaatggtagaacaataatgccaacatatgcgcttcattgtagtacgttggactctcaatttagaccatcgaatgcacgatctgacggtggtctacgccccatgaagctagcttctccacgtgcagttctccatctttcacacgacacgaaacttactcggaatcgaaaacaaatactcttccatgtattttaagttctaaccaaggcacgaacagacaaaggcttttccttctcaaaagatgcaacggtcgatgcttaattaagcaatcaagcttaagcgttcggtcttgagaacggtgacacgctcgcgcgcgtggaggttaagctcgtctcgaggggagttaagcttaagccaccaaaaactgcagcaacccaagaaactcgcatggttatttgcgaatgatagtacaggacagggagtgtggcaactatgcgttgtttatttaaatcagcagagagagagagagagagagagagagattcttgttttttcatatgacatgtttcaaatttgtcacattgcccaacccatgattgtctgtgatcccttctcactcctccctcactcaccaggtgatttgaaacccatccagttttgatcaacagaaagatacatccatgctgcacttccagctcgtcttctttcttcagatgaatgtttttctggctgcaagtcttggccataccagggtctttgcagtctcccagagcagagcagaaaaacataaatgtgacatcttacaacctgctacctcgcattcaatagcttgcagattgtgccaggcacatctactagtatagattttctttttttttatctctattttcaaaaatccggcagggaacagtgactgttcagaatgaaagtgaggttcagaaagtgatttgatcagtttccaattaaaaaaaaaagagaggatactgcgagcaaaattcggaagagatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttctatatataactgaagattaaattgcaacgttaggtggaagccatgcttttggcaagttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgttttcttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattgtttataactttttttcttccatggttgatcacagatgaaaattatataaagtatataaagtgatgtcgtgtagctatatgcatgttatttatactattatcatatataactcccacagcaactcgcggggtttcattttgaagtggagtactattttcccatttcatccaaccattgcatttattgctactaggcatgacctttccattcaattaaactcacatggaaattacttcgaaagtaatttcacctcaacacttaactttgctaaccaatctagagtctactccttatatttgtagatggaaggagtatcatcagtgatgatgagtagaaacactcctttcaagtaaatattacagtactattttttagccttttaatggtcatgataataccattttttttctactctctctatccacaaaagttacacatattacttttgacaccaagaccaataagaaattaaatcacattggatgttaatcaaagagcgaatataaacatgcaactaataagtatttagatgactccttgagttttaatgaagcatgtaatttatctcttcatttaaatcttgaatatataaagactataaataggaacaatttatttagaaaaacttaaatgtaaaatatgtgtaacttttatggatggagaaagtaactttcacagaaggtgcagtaagcaggtacagggaccatcactcctcagtcaaataaaaaagaactaaaattgatgctgagaaaatgaagcaaatagtggatgggggagtgaaaggccaagtttagttccaaaatttttcttcaaactttcaactttttcatcgtatccaaacttttctacacacacaaacttttaacttttctgtcacatcgttttaatttcaactaaacttctaattttaacgtgaactaaacacacccaaagacacaccacatcaaatcttgtgctagtcattggccaatagaccattcaatggcggtattcaattcctctactgaaaccctctccaaccctctcgtaaatgtgctgcaacctcctctttctcttctccctctctataaaacacaagcgaaaataaacgccacgccacgccaccgtcttcgtcaaacacggcggcgcaatgccttccctgaaccctccccacctccactttggaaagctcaagaagcgggcgcgcgccgtggccgccggcggcggacgccagccggctgctgccatggccaaaaaggggctcgttggtatcctgtacaagctccgcgacgtgcaccatcgcgcgccgccgacgccgacgtcgccctcgtcgtcgtcgtccccgcactgccacggccggcatcagctctgctacccgccggcgccgtcgtcgtggccgtggccgtcgtgccggcacccgcgcaccagctcgttcaggtggcccccggcgccgcagcaggggcaggcggacgacgacgccggcggcggcggcggctccgtgtaccgcaccgtgaacactgtctacgacacgtcgtcgctggagcacttcaacccgcggcgctcctccctggacgaggcgtcgtcctgcattgctgaccggagcttcttcgccgtggagtcggaggtggaggtggaggaggagaaggagaaggagaaggagctgcagctgcgtgagacggccgtcgtgcgcggcgtccgctcggagcggctctttttcgagcccgccggcgcggagttcttgcccaagcaggtaatgcggcgcacgtcgcgcactacgattaagacgcgcgacgacgcgagagcaatcgatcttgttataacacgagagaggatttcaggaaatggcgcgaggcaagaacgacgacgaggcgacagccatggacgtcgtcgctcgcaagaacgacgacgtcgacgaggcgacgccgatgaccacgccgcagaccggcaagaacgaagcggaagcggcggaggccgccgcgctgaagggcggcgcggtggtgctgacggtggagtcggaggacccctacggcgacttcaggtcgtcgatggcggacatggtggcggcgcacgggctgcgggactgggagggcctggaggagctcctggcgtggtacctcaagctgaacgccaagggcgtccatggcgtcatcgtgggggccttcatcgacatgctcgtgagcctcgcgtcctcgccgatcccgtcgcagtcgccctcgtcgtcgtgcatcaccttcgaggactactcgtcggcgaccatggaggaggagagctaattaagctgttctcgaggaagacgacgaccacgttttgtttttctttagcctcatcaagagatgacaatctctttttctctttttttgggtgctaattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattttaatccaagagattgcaatgttatcaagctgtcacgtactctaccctgcggcaagtattagtaattattttggtcacattgacagggggctgtgtgtttagttcttttcaaacttccaaaaattctgttacatcaaatgtttatgtctttggacacatgcatagaacattaaatgcaaacgaaaaaaaccaattacacagtttatatgtaaattgcgagacgaatcttttgagtctaattacgccataatttgacaatgtgatgttacagtaaatatttgctaatgacgaattaattaggcttaataaatttgtctcgcagtttacagacggaatctgtaatttattttgttattagtctacgtttaatacttcaaatgtgtgtctatatattttaaaaaaatttggacagggaactaaacacggctagggtcaagaaggcactatttgaccactaattcccattttctacataataacataatatgttgataaatatcagattttaaaaaacgcacactacataattttataacgaatgtaggaatgctattgtcgtgcagccaagctagacacggtttatatactatggtcaaacctaaaaagctgttaaaccacatttaattttcgagatgttttacaatggtttttaatgaaagtagaattaagttagaccgtttattttttttctaattcaacagatcatatatatttatactaccatctctatgtagaattttttttactgctactagaactcatatatcaacgactgagataattttattggtgattatactggtagtaaaatgctatagtagaaaccgcttcaaagattctggtattttggctgaaattattggtgtttagttggaagttccttccaaataccagttgatgaaagttggatttctgttcagtttgagtaaaaacatgttgaaatttgcctcgaaattctacaagaaaatgtctgtttcatgagaaatgtttggccttggattcttatctaggatatccacacattaatccacgcacatattgcaagcatgatacttccattttcgcgagcatagtcagtacaaacactactaggactgtttaagttttgtccatgaataagccttacccacagtcctccacgatcataagtccctttcagtgttttcgacttgaatgcgtcgagtaataacacagtgggtccatgaatttatcagtgcttatcatgaagcttaactcttacggaacaggacagactagtaatatcagctaggccccggcagagtccttttaaatctactactaaatgactacttactctaatcaagcctcatgttcagcagtcttcaggagttaccaggacagtctaatcaagggacaagagtttttcactgcctggagtagagactgcaaatttggtcggtaaagtttatgtaaaatggagtagtaactgggttatgaaccttgcagaattcagaagccatttgtgccatttgtaggttagatcaagcagaaacatagtggaactgagtgccatatcttatcttagcttagacaacactcgtagtagtagctcctaaggctagcttaagctttgtccctaaccaccttgtgaaacttaatttatgatgcttaaaggttcaagcattccaagttgttcttttaccctgcaacactgcaagtttgcagcttctagactgctcgctgagacatgttcgttcaatcccagtaaactgtaggctcacaacgagcgatctttgcgtctctattcttaggtcagattgacatccaacgctggatcatgcaacgcatggataccaccaaacaggaacacattgtgcaatgcagagcacttgatcgatgagacgtactactccagagtccagacagatttaagatcgaacagggtattaattacttctgcaattctgcatcctcttcactgctactcctacgtccgggacagcgatcgatcgatcgatcatgcatgcggctgatgcatcacatctcgccaacatgcagatgcaaacacatcaggcgtagcccaaccaaccggcaactacaagcatcgcatgcatgccaatccatctgatcactgatgatttacatggttcgcgtatctttgggatcacaggcttcgactgttttttcgcagcatcttcagtgggtgccgttttttctgtagttcagagatgataagcacagtaaacaggatgtgccgtgttcctgttcaagagatccgggcatgttttgcgctagtggagtggatgatgattgtgatgcacaacatctttgactatgaattgcagatttgcaggttggtgatgcgtgatgtacatacatgtggttgtggacggcataaattggaacttctctgttgtggatttgtatgatcagtcttgtcttgtggaatcatatgctttgtgttttgtttgaaagttgtgttgttattggaaagttgatctccctggtatttctcttttagattttgtttaagagagtcagagtgaaagaaagttaagactcaccgttttctttctttctttctttctttccttttgtttgactgaagacaaaccttcttttttaactgaagactcaccggtttgttctttcttggtttgcctatagtgcgatcttcaacactgaaaataaatcatttcttcactagctggagagataaaatgaacttgctccttcttctctatccatagtaaaattcaatccttaaatatgaagtgctaatagtaaatatacagatggagctgaaacatgtagtgcatttctgacggaggtttctgaagatcgctctaaggagtaaggagtgcatcatcgatttcaggccaaattgccaaggcatgctcgttccaacaatgttttgaccgtttttattttcagatcaacgaaaattgtgccggatttgtcacgttgttcattagcctcgcttctcacgaacctgacggaagtttcagtgacagggggcaattatctaagcctcccgagcccagcgccgagatcaaattgactaactagttaatttcccctgcttccttagcagagacggtcagacttgccaaacccaatgcacaatgcaagctgcaatattgcaacacacgagtcacaagatgttacagcatagttgaaactctcatcaggatttttagagctaaaagatatctagtggttcctgctgcaactttgacagggttaagttaagaagataggagcaagtagtagtttggatttgctaatttagtcgcctgatgcagcacatacttgcaaactctgcaatcgttagagatctgaggaaagaaaaaacaatgcattatactccggttctccttaaatctacaacaaatcgataactccgtagatttttttttgacagttttagtgctgctctctgtctccggattattactgtggattattttatttatctattctttactattataaaaattgaagatatttttgccggtattttggtacgtcatccgtgtatgaattgatttttaagtttgtttgcttttggaaatacatatatgtatttcagccggtttttaagatcgttcactttcggtaatacagagggaatcacataagaattttgttaaaaaaaactcatatgctaacttgacattatcggacttctaactgtagttcatgattttatatatatatatatatatatatatccaagcgaactcccacagtaaatttcatcttaactaaaccatataataataatacgattaaaatagactttacccattgcaacgcacaagcattttttctggttataaaataaattaaatatgttgaaaaataaatttaatatatatagcttagaacatatcatctaagtaatacagtagaagattgtgttttaagaaaacatatttttagagatgatgaacaagtaatttgcaacggcattaatctagggaaatgatatctaagcgaaaaaaaataaatagcattaattgtttgttgtagctatagcggacttctaccactaccactataaggtaggggatcaaagatagtctattagatcttagcggtcgctatagcttagtgactgttatagcagtaaactattagctttgttgggttgttactgtacttaaactacgttctctatctatggataagagaatttaacgccatgtgcctttttatcatattcattaatatgttatttataaattttatgctatgaaatgtataggtaactagatatgctaaatttttaaattttaagtgaattttgacactagtattaatatataatctaaatgtatagtaatttttaaaattccgctattggaacttagcgcctagaaggctacaatagcaccctttatcagcaaccatctactcatacattaatccgtgaccatttgctattctatatttattaccttaggtgtaagcatatttatatttgtgtatattagtttatgcatcttctatttaaataaaatatcctatgctagctttttttttcctttggaaacttattccgatactagtattttgttgaatccaagctaggtagaattattgagatgcacaaccaacaagccaaaacagaggacattcggagtatcagcccaataattatcatctcaccgtcaccttttagcaggtttagtgtcacatctcctcccagataaaaccaaactaaccctaaattattgatcctaacaaagctcacttttttttaggctttattgctactagtatattcgcaaatcgcttgctcgatccagttcatcacgagtccttaattcggtgggccccactcgtcattgaccatcaaacgcaaccggacaagggcaaagccgtaattaccccctcccaaaaccgccacgcgagatacctaccgccagagagcggcggagaagcagccgagcatagcagtctgaaccctccaccgaagatgatgtctatggcattagctatattgtcacttttaacttatttggcactatattaattaagagagagagtgaaggaaggaagaaactgggtctcatgcaagacacagcttcaacacgagaatatatgcactagacactatcaatttttgtattagaagagaatagtgtcttcataatagatgaagaataaatatgattggtagagaagagaaatgatgtatttattaatggtccactttaagaaaccatgggttgtagagtgtagtttctattgtgatgtcttattgacatggcaccatagacactacttatatatactatgggttgggattgccctaaccacctgatttgccttgtcctcagctaaccaccttgggcaagtaagcgagcaagtcagaaagccaccgaacagagcaaggtcacttcacgccattaccttcttctctccaagaactcgagtagattgggcaggagattaagatcctggccagcttcgtctccaagaattcgacgctctggttcaggatgtcggtggaattcctgacgaaagcgctcacgtgagtgtgccccccctcttcccgctcgccaattctcccaattctggtggggatttccggtgccgcctcgccggcgccatggcccatgtgctatggagattattgattcatctgcttgattgttgggtgggtgcagggcgctgttcgggtatgctatgccggcgttggagtgcttcaaggcgatcgagcagcggcctggtcggacggaccatctccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaaccgaaatgagggagaagactcggtcggcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctctgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctg

SEQ ID NO: 35200 - DNA, 11460 bp, Oryza sativa
caccgccggggtcgcgcctctgcgagcgccggcgtccacagccgccggccgcccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcctatgcatcgccgcgtcccctcgccggatccgcttccaggggcgtcggatccgccgcgcccttgccgtcgccggccgccggagccccccaccgtcgcgcgccgctccgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgccttccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtgcaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaaccgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatgggggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgctcttagtggtgtccaagtgttgaaatatttttaggagctgtttttgaaaatgactctactcgggacagagagtcccacccggaggttctgtccggaacttcctggcgccgaggtgaggttgaaaattttcctaagtgttgcccggaagttcctggcacccaggtccggaacctcctggcaaccctccagttcaaatatgtgagtaacggctagatgacgtcacctaaccgttatatatagccaactcgaccccagctcattctttggccattccactttagttcttgtgttccctagcttgttctagcctctcccaatgtgattttgcttcctccacccaaatcttgtgcacttattgagtgagagagtgaatttgagggtggtggtgaggattggagaaggttttgaaggctaggatgacttgagcacttggtgtatctcgttgggctatcacttgaagcttgttactcttggagggtgacctcctagacggttaggtgtcgcccgcaagtttccaacaaggttgtggattgacccgggcaagtttgtgagagcgttattccacctccgaaagaaaacagaggtgaggtttaagaggtcgtcttggtagagcaagcctcacttgtggtgttcttttggtgtttaagttggggatcttagtggtcacttgaaaccaaagagaagtacctaggggtgttggcttgaagaccggagacctcttcctaggccttttcttggcgaggcaaggtgttaatcaagacccggctctttggagctcctcaacagagacataggattctcggtggagaatccgaacttcgggaaacaaatcatttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttaggcttccttgtgatttaatttacttgttgtgaggtgcttgaaatagcaattcacaactgcccggaagttccttggaagaaagagaggaagttgagcaagaatgaggatcttgctcataagttcttcaaatccaccaaagagggacactttgcctcaagttgtccttgcaagattgatgatgaagccacacttccaagaaagacatcaagaatcaacaaaaggaagtgctacggttgcaatgagaaggggcatgaaatcggattttgtccgcacaagaaggatgatcattgcaatcaatcaagcaagaggcaaaccggtaacaagcaagtcaagaagcaagataaaagcaaaactcaactttcctacaattgccgggtaaagagacatattggtaaaaattgtcccattggtaacattcctaagccaaacctctcatttcatcacaatttgcttaggaaggccaaaaatggcacttgtgccactagggtgattagttcgctacatgctagcacaaaggccatttgggtgccgaaatctcttgtgactaacttccatggacccaacattatttggtgaggcaaggtgttaatcaagacccggctctttggagctcctcaacggagatataggattctcggtggagaatccgaacttcgggaaacaaatcgtttgtctcctctcactctctttatctttgtgattgtgatgcttatctctttatttgcctagttgttctatcatgtctcccattgtatgatcacttgtgctatcttgtgtatcttcatgtgtattactcttgtttgagacatgttgtacctctctatagtttaggcttccttgtgatttaatttacttgttgtgaggtgtttgaaatagcaatttacaactgcccggaagttcctaggaagaaccccggaagttccgggcagctttctctgcttgtgagaaaaagctgccaggaagttccggaccttttgccaagaagttctgggccctgattttaaccgctacgatttgaagtaaattttaggtgcgcctattcacctcccctctaggcgacatcaaggccctttcggtaagcaactattgtatgattggctattagagcaaggttaatagtatagccaactactagctcaaattcatctatagccaatctaatagctaatttatacaatagttgcttactatactattagtatatggtcctacttgtcatacacacattgcgtcttggagtccgtgctgcagctggctacatctctctcatcttttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaaccatgtggaggtctgaaaatatgaaaacgaccttgcagggtggcaccgtggcatgtgtggaggtagcactgtggcagcggcaactacctgtgctgtgcatctctctgactctgtgtggtggcgaagatttggaaaggcagcaggaagaatcttgcaagatcattgggtcccgttcttttctctaagcaaaagttgaaaagattttcgtggcacgctttttatatgaaagttaaaccgtatacttcgtacaaaaattttatatatgaaagttgttttaaaatatcatataaatctagttttcaagtttgtaataattaaaactcaatcatacgttaataccaccttattttgcatataaaacttaatttttatttttatttttatcttcagaagaaaaaaaacaccatctaaaaatcgagcgtccagaacctcttattaaaaaaaggggacgaaacagagggttaaaaaaaaaagcttatcaggcctattagcagtggcagcagggatgaaaaagggatgcttacaagaaacagtagcatctttcatctcttctgaaacgacggattgtcaggaccatatttatcaatttagctatttagtaaaaatagcaatatgatgttaaatagaaaattaaaaatttataaataggtagaaccagaaacggtaaaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaagagaactcgattgaatcatggcccaaggcccaaagcccagtcgacgcacataaaatccaatctctcccggttgacggaccgatccccagtggaaaaagtctttgactgcttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaataaaaacaaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcgacttggtcggcagtggggaaggcggtggagagcgcctcccatgtcgctctcggatggtgcgcgaggtaatgggagatgcgctgaggcgtcgtggcggcggcgacaacgatagcgcacgggggaggaactcaccgcccgtccgcgcgcgggggagtggctcgccggccgtccgcgcgcaggggaggtgctctccggccgttggcgcatggggaaggcgctcgctggccgtccgcgcatggggaggggctcgccaacc

SEQ ID NO: 35201 - DNA, 18368 bp, Oryza sativa
cactccccacagccgctccggccggggtgaagagaaacgctgggggagagaggaaagaaggaaggaggaagaagggaagccgggaaggagctagaggaaggatgacatgtgggtctcacatatcaatggatcccacaatataattttttgtgtgagtgacatgtaggtcctaccttttttttatttttattctaatgccacataagcgccacgtagaacaaagacttggtcaataccgccacgtaggcgccacgtcagctaaaatcaccgagggatataatttgcaccggttttgatagttggaggagtcaatttacctggttttgtggttaaaggatatgaatcatactcggagctatagttgagggagtcaaagtatatttttccatcccaattgtcccacccacctgatactaccatcacgcgacgcgacgccccacggccggcggcggcgcgaatcgcctaccgcccgctgcacaggggcactagacacacatgggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaactagtactcgctaaactagtcgagatctctttttctctaccgctgcgcaacaacatttgattgaaccatcttacgatgctttttctcaggctcatgcagccatgcttggatgcttgcgttgttgagacttgagagcacggcacgtatgcgaacttgatcaggtaggtcgtcacaaacgcggcgcgcgtcgacgagaggccgagacaaccacccacccactagcgcgcgcaccgagcgagctatctctccgctcggtctcggtcgatcgccgcgcgcgcgcgtggccgagcttgcacggcgccattggccgacgcgagccggtgaggcgatagtgctcgctccaccactctccccgaccatcatgggggtgtcacctcacctgctacgcctgtatatatataaagcaccagcagccatgaagcccatcaacgaaaaactacgtgacagcgtgacacagggggtagttaattactagttattcgcagtgcgtgcgtgtgtgtgtgtgagcgatcgattgatcgagatcgacatggcggtgatcaggggtgtcgtggtggtggtgctcgcgctggtggtggtggcggcggcggcggcggacggtgcaggggagtgcggggcgacccccccggacaagatggcgctgaagctggcgccgtgcgcgtcggcggccaaggaccccaagtcgacgccgtcgagcgggtgctgcacggcggtgcacaccatcgggaagcagagccccaagtgcctctgcgccgtcatgctgtccagcacgaccaggaacgccgggatcaagcccgaggtcgccatcaccatccccaagcgctgcaacatcgccgaccgccccgtcggctacaagtgcggaggtaagctgagatcgggagcagcaaagaaaacggtgttagtcattaacgcatggtaattaagtattaattaaaaaaacttaaaaaatagtaacagtttttataaaaaatcacatcatttaataatttgaaaaggaggaatagagttgaaaaaaaaaagggaagaagacagcctaatcaacatgtcaaactgtcaactcttgccacgaacaatctatgattatttcatcattttcagttggttggcgctaacaatctaacatgatcgattccttctcaattctctttcacagattacactctgccatgagcaacaaagagtactgcatgcagtgccggtgccgtgtctgtcatccgcttaatttatcgagtttatgtcgtgttacttactaaagctgtatgctgttgtgcgttcgtgcagtttagtgtcagtgtcaaacaccaaataaaagggttccatcttccgtgggacttcgtgatttcagtccgtagagttgtttctccaagtccaggatagtgtgtacttgatcatattatctcggagggatgcagagacgctcccctgaattctctgaataatagtacaacttggtttgttcatcgattcacacttttagttcaaaaaacttgctatacatttttacatcttgtatgctcgcttatgccttatgcccgcagaggagaaacagaggaaacatgcaactagtaacagtgaagaaattcagaggttgtgtgctctgcttaaacgaaaccaaatcctctcacattagtgtacagcgcgcacatggtcactgatatatgagactcatcatttatggacccatatatcagccaccatgcctctctgatttaacgtcagaagatctctccatagacccacatgtaagaggcgcactctcacatgtaagaggcgcacttctctctctgactatattagaggagcatcatcgacggttgtgcatgctgctcgcctgcaggctgatactagtgcttgcaagcttagcaaggggcgcagccacggtactagcctactaggtacgttcacacgtgtgatccttgttatgagccaacgatcgctccaattgacaacgtcggatgtgcgccacatgcacaatgagccaatgattttacccgaatcacaatattgaacatacacaacatcggatgtgcgttagacgcatccatgtgagccaacgattttcactctattagagcacgagaaattgagtgtttcttatcaaaaatcgtttttttttcaaaggtttttatcggagccgagagtgcctacctccgagccgagagtgcccgccctttctgtcaagtaggctactttttccggaacgcacacttttttttaggtttcataaaagcatatttaggtccacacgtgaaagaacctcatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttcacgcacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaatatgttttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctggccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctcttcttctacctcgcgctcgctcgcttccctcgtaaaccatccgcgcgcgtggtccttccatggcggccggggctctcctcctcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgcaggcagctatatttgtcgagttggagagcaaatcgatcgtgagcgcaatcgaatttgccgcaggtgttcagctccaaggaaggggaggaggaggaggggaagacgaggaagtcgaggacggagcaggcgaaggagctcctggccaagtacggcggcgcgtacctggcgacctcgatcacgctctcgctcatctccttcacgctctgctacctcctcgtcagcgccggcgtcgacgtgcaggacctcctcggcaaggtgagctgtcttcctgctctgctcgcacgggctgcggcggctcaccggccggcggcggtggctcacgtggctcccctgctttttgccgcaggttgggatcgcgacgggggagacgggagggaaggtggggacgttcgcgctggcctacgcggcgcacaaggcggcgtcgccgatcaggttcccgccgacggtggcgctgacgccggtggtggccagctggattgggaggatcaagaaggggggcgactgatccatcaagtatactttgatctttgaatgcgtgaattcgttttgatcttggctcgttcgtactgaatcatgacaagtatatatactagtggtatgtgaatcatgtatgtaagcttagatgttcaagtagagggctacccagtaaatctgctgctacttttgtacaaacacatgctaaaacagtataatgatctagtgtatcccgaattaaactactactagcagaaatgggtgttgtgcagattcaaacactcattaagttattaatcataggtacacagccagaacattcagaagcctttttttaaaacattttctgcatgaaacttgcatagaacaatggttgctcatatgctgtacaccctagtcgaactatttacagactgaccctaccaagtagcttaagctgggagaaagaacctgagtgagctataaaaataacacaacgaagcaacgcctctatgtacaatcatatcgatcaccattggaacaggagggtaatcaaatcataagtggagtgataagcaaatatgttttcagatccataccgccaatccagaaaaaaatggctatctgactatctcagtatgtacatcttcacgctgcgcctgcacttcctgttctctgggaaaggatgcagactcccatggaaaccaccggaggaattaagtcataccgaataacctcaatcgacaccagtagatctggtctagcagtaaaccttactggttatccatggttgaagcccacgcctgtaggttcactggctgcagcagacggctggttgagtgcacatggggtgtcacttatttcttcagctaagaagtcgttggtgtcaatctgatcccactgcatttctgctggttatcatgttaaagtacttcaaagttcaatgcacagtgcaacttgtaagctcttatagtatatgagaaaaaaaaaacccaatgactatatttcatcaaggatacatgctgttgtccacatatgagtaatgctgatatcatcatcggtgagaagccagtaatcagcatcagtctgcaaaggtgtagaaggatatcatgggttagagtctaccacataagtaatttgtctattattgagtgctatagcagtgtaagataactgaactataagaatgagcttgtaattttttgttattggttccagaaatttagctgtttattattttaaacaagaattatgtcaagcacatgatcagcaatttaagatatttttgcacttctgctatactaaatcgtccatatgtgaagttctgtaacattgagctttcaactaaagctgctgactaaaaatcaagatactaggggagttcaaaattatgcagctagtgcagcatcaaaattttcaaatgtgtgaattgggatgctgtttttagctcaatgacatgatcatgagttctgccaccctgcacaggaatttatttttataaaacgcaaaatccatataattctaatttaaattgcataaaaatgttttagaacataacttacatcaacatctgaaggagtaatcttcttcatccttccaaaagcacgtgaagcattaagctccggagtttcctggatatcctgctgaacattcaacggcatggtctgcttgctgctatgtccagcttctgttgctatggagggaggctctacaacacttgcatgccttggaggtgttgcagtttcacctagctcctccattttcttatattgactgataatatagtaagggtgttcatcagataatttcttttgaggcaaaagcttcaagagaagaatgaagtgttacctaaccaagtaaatatctattgggcccattgtactccttaataatattctatatctccgttggagataatcaccagcctgcttatggaaagaaaaaaaatgaaataattaatactccctccatttcatattataagtcactttgagtttatcctaacttacgcaaacttgaaaatgtttgacttaggacaaacccaaagtgacttacaatatgaaatggagggagtagcagttgatcatcaagtattgtttatatggagaagtcatttagtgtttattacctcgtcaggatctggaacttcaactgtagtaccacgaggtccttttattgcgattaatgcttcattctgcagaatgagaaaagccaaataagttacatcaaaattttaattcagcacagcccccataattttatgttaaacaaaattagatcaataacaatattgccttccttaataacatagacaaacctgaaagcagggcagtcccttgatgtcatcttcagtaacaaatagccacctaaaaacaggaacaaaaaatatagctcagtacatgattgcacagtataagcatattacaatttgcaacaggtaaattgtcacgagtttaactttccaccaggctttgccaatacttccattttgcaccggttctagagaagatatgttgcagaaaacaccagctttgacgctgcagtcttgacgaatggtggaaatttgtgcatgataagtctatgatgtcagatggttgactggtggttgatctagatcaagtagaagcaagcagggaggatgatggttgtaaggtgtaatgggatatggtgaaaggattcacaaaacccagtgcaaagtgaaacttgggtcaattcactcggtgcaaagtgaaaattattaaaaaaaaatggcatgctagcatgcccaacaaacaggaacatcactacctatggttgctttcgtcttcagttaactcctccatcttttcccgtatttcactgcaacaaataatcaggaacataagaaattactgtcgataattttcagattttggaacctccaaaagctaccaaccttatacttctatctaaagcttgctcctggatgtaaaggttttcaacttcggtctgcaagaacactgaaggcagcttagactcagaacttcttttacaaacattcagataaatttgccatgagtatatagattttaacatgattgcgtaaatgagaaaagtagaccggcaggtaccttgagacatgaaatatcactatcaaggttagttcctgagtcatccgaacccctgtgatgccatgaggttagcatctcacaccataaatacaagcatacaagggaaacagaagataaagattacctccaacggattctgttcttaagcttcttttctatcaaacctgttccttccagtacatttgttatgtcatatatgcgccgtttccgaacctgtttttgttggaaaccatatataaacctgtagcaaaactaacgaaaagaaatgactgttaaaatgagagagagggggggggtttacccatacatctaatatctttgcagcatcattcaaatctagaatgccatcttgagtctgcttgagcaaattaatgaattttctggtcaatagtcctgaacaaacatcacatgaatagctgtcagttaaaaagagagtaaactgtatcaaatgagatgatgtgactacatttataaagcaccaaaaattcataatggtacatttaacatttagatttccacaattgaaagttctaggtgagggactgctatgatcacctaatgaattgtcatagcgagaactggcaggagtggatggatttccaggtgaacctgcagatacaaatgtgtgtgcattgcattagtcacaggaaacaagtataaagaaaacagaacaaagctgtgataaacaaatactgttaacttaattaatgtcactgatgaggaagtttctacttgccagcattggatataggcgtctgaggtccagctttattgaatttagccattgatttggttgtcctagaagtttttccagaaactggggtcataagtgggctgccaactccttcagtaaacccagggctagtcatcatacgttcacttgactcagcagcctcactttctccacatggagtttttcttttcagctatgcacataaagggggatcatgcattcgtaaaatgggcaatagtattatgtagtggtcaactcaagcgaattgaaaacttaacaagttaacacatgaatcataataagctagataaaaataaatagcaacacctacattacaatctcatgatccaagaaaacacttgcaagggtacaagcaatggcaggcataggtgtataactgctttggtgaaatgattggtggtcattgaatttggaagataactatcagcaatatccatttcataatcctgtgaaatgatatgtgtttctgcaccagcacacctgtttgccgctacaaccgccttgtgcatttccacatggaggagagtatttccccaatgtgatccatgaggacccccaataactaacatactctcaatcacgagtaaataaaactgcttcctagcaaatgcactgaagatgactagatgaacacaacttctagcagaatacgcatttcagacgtcattcagatacattgtcctccaatttagaatcatgacagaagcatctttccgaattgctgacattatcttccaagctgctagcgactaaggtaaaacagcagtggacacatctacatgtcctagaaagtaccaaatcctattatagtaccatcatactatccaagccgacggaatgcaattttcaagtttcaagtgggtggcttggataagtgaagagctattacccagtaacccaaaacaaaaatataccagaagacagacatttcacaaagccttccactttggcgtcaataccacatgactgaatagatagattcatagacagtagtaattctaatcttcccccaaagtatttggcgactgtaacaagccgcccacgaattcacccaaatccacatgttaatctacaccaacacccccaaataaaataactggaaatgccgtttaattgaaccgccatgtcaccttgtaccgccaaatagctgccgcacaaaacctcagaaacccgcacagaaaccatccccgagaaggaaaaaaaacaaaaactagccaatcaattggtgcacacagtaaaaaaacctcttcggtaataagctcaaaaacggcaactcacgggtgtcctcctgatgacaatcccctcctcgatctcgccgccccgggacgccgccgcgaagcggtggtaatcgccgggggccgccgcgaagggcgcccgcgccagcggcggcggcagcggcacgaaccgctgccgcaccgaccgcacgatgtgctgcgccgccggcggacggcctcctcccgacgacatgcctccgatccgcgagaagcgcccaatcgggcgggcgcgccgcgatcaccacccccggacgcgtccgacggagctagggtcccggcaaggcgggcggcgacaaggcggggaggtggggggagtggggcggcggggttaaggcgaaaagcgcgaggttgtgcgagcgagaatgcgaggaggaaacgagggtggggggaagggagggaaatttttagccgcgttcgcgagtcgagtcgcggacgtgtaggggggaagatgtggatggatgtggatgtggactggaagaccggaactggaagggaaggcagcggggaggggcgcgggtttgagacacggcttcttcatggaggggctgcgtgcaaaatatcgcgggcgtggtagttggtgttatcctacgcccgcggctttgttgttggcggtctaggctgcgttaggaggaaatttcaccatcccccatgtaaaataaaacgattccgtataaacatacacacgcacatctaagtgctgttttgggagcttaaacatgtactccatctgtttcactaagtcattctagtattcccataaaaaaattcattaacatcaatataaatatgaaaaatactaaaatgacttgcattatgaaacggaggaaatatttggttctagaattagatgtatttggttctaaaactagatgggatgggatgatttttcacacgtatgtttggttcataggataggatcattctttgtttggttgaaaagatgagggagtgatgggatggacgctatttgtggctaccgtcaacccacgtccgatcccaataggcgcggcctagcaactcggcgagcgagcaagcggagtagggacggcgcggccgacgactcgacaagcgaacgagcgagcaggcagaaggaggagcagcggcgaccaacaggcggacagacgagcgagaaggcggcggaggcgaggcggcagccgcttctcgcggagcagaggtggtggcggatcgcggaggacgccagccgctcgtggaggagaggcggtgggtcgcagaggggtggtcgccgcacgtggaggagaccgatgaggcacagctgcggccgctgctcgcgaaggagatggagaagccgaggctgcggtccccgctcacggaggagaggcagctgctgctcacagaggagaggcgacggaggcgaggttgcggctgtcgctcgcagaggagaggcggtagccgctcgcgtaggagacggaggagcggcaacgggtcgtgaaggtggcggcgtctggtcatggcggagtgccgccggtcgcgaaggtggcagcaggtgtgaacaacgatggcggatgcagaggcaagttgacgccgtgtgctacatccaagtgggatgagttcgtccggccgattttgccggatggcttggtcccaaatttgagaggaatattcatctatatggatcaacccaacccactcgaacctcaaccaaacactcctaaaaagtgggttcatcacatcccgtccttgcaaccaaacaccatcgattataagaagcggctggtatgtagtcagcttttgagaatctgaaaaagtcaggcttcccagcttctggcctctagtttattttggattctacaactacatcttctcagaatttgtaccaaaagttgtattgtttagggggcttctgattttgggagaaactgcaacagctagaagcttccccaaataggtccttagtatctttggaaaaattggccaggtatattttgagattagtgaagtcattagaaaactagaccgacatatcttgaaattgatgaagtcatcacaagcatctcgctatcgacggatacgtatatacctatcatataagcactcgtataaaatctataatttgaacccgtgtgaattatttcaaccacaagaaacctaactaattgagctacgttcacttcgccacaaaaataattattttgtgtatatattagtgtcacagcaaattattgtacaatttcaataattataaaaaaggtgactgcaaatatcaaatttatgtgcaattctgcataatagtgcaaacaaaagatgatctctataggttcatcattttatcatgcatgatgccgatcacgcatccacagttccacactacacaccactgttcactaagctgtaagtgggttccaacgtctcgtagatggcaccttgaattcctaaattagattcatccaggattgatttctgtttagacttgtagtattaggccatttccaacccaatgactaggatgatgtccatagcattaaataagctgtcacataggatgaaaaatgatgtggtaagtaaataaatgaggaaagagaaggaaactatgtcttgcatgagacatggtttttacacaaacatccaagacattatgtgagataagtagcattaaatttaagtatgaaatagtggtgtttgcattggaagagtagtgtctagtactaatttcttaatgatgtggagtttatgaaaactacgtctagtattttgggttgagaatagccttaatatatatcatataccgttgtagatttgttttttacgtgacaatgagtaccggacagacatgcgacaattagttgatacaatcgatctggtcaaacaacagaatcgagcatcccgtagagtccccaacagaggttggggggggggggggggtttaaacaccgcctccggtttataggacaccagtgcgccaccgcccgtaggtgacgtgcataggacgctccgaccgctgcctccaattaaacttgtttcaccgactcatcgctgcccccgctaggttcagcattcagagaacacccatcttcgtcttcgtcgagggcacctaggagtctaggaccaggcgaagcaaagatatcgatggcgccgccaccggcgttagagagagcaatccggattccggccgacggcgagcgtcaagtcctgcccgaaccaattcaccgactccatcggccgtacatgcaaggaggacttgaatgggccgcatttacgccgcagcacagctccggctgacatcaatcaaatgaggaataagttcactatcgtccctcaactttacattgagtgtgtatgatgtctctaatctccaataccagaaatgtctaacccctcatctgttcaaaatcatactaagtaagtctctcgacagtatggatgtctggttttgttgacgcggcatcctagtcagaaaaaaagtttaaaaataagtgggggccacatgtcagccctatcatccttattctcttttttttctagcctgggagagaggggaagccagcccgacgccggtggggaaatagccggccggcgtggcaatggaagggggcggcgggaacgcccgacggaagaggggggagagacggccggcctcgtcagtgggagcagccaccgtcccaccggccatggccatcaccggcggcgggagggttgctgctcggcttgcggtgctcgttagaggagtcggcaagatatgcggtagtattgagtcaaggcgacaccgcaatgacaagcgcccgccgcgatagggagatgctaccgttggtcgcgcacgccgtctcggtcaatcagtccttgtaggtggggcgccgtggcggcttttggtcgcctatttcactttcttttgcctctcccccctctccccccagtcatgttggccacctcttctcccgccggcgttgggctacctccccctatctcctaggttggggaaaaaaagagaagaaggatgatggggctgacatgtaggcctaacgtatttcttttaatttttgttgctaaataggatgccacgtcaactaaatcaggcattcgtactgtcgagggatttactttgcatggtattgaacagttgaggggttaacatatctagtattggggattggggatgtagcctcgatgtaaagttgagggatgacaagtgaacttattcctatcatttatcctcacgtcctataaaatgcaacctaggttgagcttctgttggggccaagaagtagtaggatccaaacctctcgaatccatggatcgtcaaagcatcagaatccccaacaaaaaaaagccgagctggaccgaaccacccaatccacgtggcactggctgtggccactgagagggcggcacgtcacccgtttaaacatcttcctccatttcgcaaacgttaccagatcctctgacgtagaatggttctacgtcagaggaaagtctgagactagattcccgttcgtcttgcatcctaaggcagcatctgttccagccttcgttgtttgatctggaggtgatgtctaacccgctccattcggcccattagtataccaaggagaaaaacaacaccgcaatagctaatcgactctgtcgtcggcgatgcgagaatgaacaaaaagagcagaggtcagaaaaaagcatgaggaactgcagtggaggaggggacggaatcaataacgttcagatggatatccaacttacgctacggttccacccgctcccgccatcccgcgcctggggagatgacgagagcggcgtgcggtcaggtcgatggccatggccgacgagcgacagcgtttctcttccaccttcactcgagtagctagttcccaactccctccaccctgatttccacacgcacgcttcctaaactgttaaacggtgtgtttttttcacaaggtttatatacaaaagctacttaaattagtaaatattaaattaatcataagaaaatgtttcactctatttttcgtgcggagggaacataatgcctcgctctattttccgtgcggagaaaatatgttccgtactcaagagaacaaacgcagtcttctgcaaatgggctgaaaggagcagtctggacctcgtctctaggccgaacgacgagggctgaaacagattgcggcaccaaatcagcgcccgcccgcgcccacc

SEQ ID NO: 35202 - DNA, 3646 bp, Oryza sativa
  unsure (1)..(3646): unsure at all n locations
cccccccccccccccccccaaggcccaaacccccgcccgcctcgacctcgacaagccacggccatggcgtgcgccttctccgtctcctctgccgcggcgcctctcgcctccccgaaggtgcccgtctccgcgccgtcgcagccgtccctgccgttcccccgctcccttctccgccgggaagtccctgcgcctctccgccgccgccgcctcgagatcggctagggcccgcagcttcgtcgcccgggccggaggcgaggttcggcgcgatttgatgtttgatttttttggggtggtattggtgcctctgtgagagttgggattgacgcgcgcccgcgtgtgtgcgtgcgcagggggacctgccgttggtcgggaacaaggcgccggacttcgaggcggaggccatgttcgaccaggggttcatcaaggtatggcggtaatccggtaaccacatgcacagctacattgcgccacgcacgcacgcgcggcagtgttattcgacataggggattaattggcccaggaaaaaatggggcctatttgattggcagtgtaattcaccgtgagatttgataatttaacactcttttcaatgggtttcgataaattgacatcctagcccactttcattcactcatatggtcccacatgtcatcctcacaaatgtcaattaaagtaattgggcaacgaaaaaagtgtgaaattatcaaattttttttacattcatcataggggattaattggcttgggccaggccaaaagaaaaaaaaagtggtctattcgattggtagtctagattagatgttaagtccatatccacggctgtttaatgtagaagctgtatggttgatcgtgcttccaattgatatcttcgttggtcgtgtccttcactccttctgtatatgcaggtcaggtcaagctgtctgagtatattggggaaaaaatatgtggttctgttcttctaccccctggacttcacgttcgtctgtccaacagatgcgttgaccttgtcgtgctctgtcatggaaatgccttttttttcagttttttttcattcctaaagtctaaatgcatgtttgtaagctctgcagagatcactgctttcagcgacagatatgaggagtttgagaagataaatactgaagttctcggtgtttcgattgacagtgtggtatgctaacttttacccgcatgactttagatgttgttacggtgtcgttacctggtctgttgctctattgagaatttcgtatttccattccatctggacatgtagcttttctcttgacaatatttgtggtttcttgaatgccttaaggttgtgatcaatattttagctttcctctttatgtgatcaatattctatttgttcttaacgtctgaatatagagcattagatgaacccttgcattaggccataagttttaacataagattgccacgtgttgaactttcattctgtattataatgaaatgtgtggtgtttgttatgccttatggaaatattgaatggaagtaaaaaccgatgctctctaatatttagacaatagcgttataaacattcaattcagttattttgaaacaactttgagaaatgagactgatgtaacgtcttaatactctggtttgcttctgccaagangattcattgcatactcaaatatntatcncaaattatatccagtaaaagtattgattttgctactattacagtgagtagtttgtagccagtagtggtactgtaatttattttttactatcctctctttctgcttctgcataaagcatttcattttttttatcttataggtatcattcactgttactctgtcgactataaatatttaataagtggccccaccctatgcttcataagtgtcgcatactaatttggctttgaaatatcttttgtttgcagttttcccatcttgcatggattcagacagataggaaatccggtggtcttggtgatctaaataccaactgatttccgatgtcaccaaatcaactagcatagtggcccgcgcagattgcgcggctagcatcattatatttttttctcttataatagcatatatgttttctcaatgtattattaaaatatattaaaataacaacataattttgtgtgtgttcatgagagcgaacttccaatattcctttgaattttagttatttgtaaattgtatttctatatgtactctaaattctactttaattttattagttttattctgaattttaaattcttatatggattctatactcttcttctaatattccttattttaattcctaatttatattatttggaaattttatttctatatatggattctaaacttatctttcaatattttttaattctgaattttaattatttttaaattatatttctatatggactctatattcttcatccaatatatatttttttatttcgaatttttttatttctaaattgtatttctagatggactctaacctctatatttaatttttcttattttttaattccgaatttccattagttctattgtataccgacatggactctagtcttaccttcctatattccttatttttaattccgaatttcagctattattaaaattgtatttctatatggactctgttttttctttttcttagattaatgtgagaatttctagaccatgagagcgaacgtggaggcttctttttctattcctttaataatataatagatttcaaagtcttttggtgtactaatccctgatcaggtatacttcagttatgactgcctgttggctatatatacaatatatgtctttcttctggatatttacttgtttgtattcaaagtcttttgtcatgtattccttgttcttaatctcataagagctcatactttctgctgtcaggggattgctctgagaggattattcatcattgacaaggagggtgtgattcagcattctaccattaacaaccttgctattggccgtagcgtggatgagacgcttaggacccttcaggtagaatagcaagataataaaattgcatctgcaaacatgcatttcttttcaatatacatggcatcttggcagttttttcgtcttgaatttaccatagtctagtgtctataacatcaaaaattgctcaactagttataactgtgagtgacaaagtcagataggaaaattttttgcaaatatgcaagttcgtaatttgttttcctatggtgacaggccctacagtatgtccaagaaaacccggatgaggtttgcccagctggatggaaacctggggagaagtcaatgaagcctgaccccaaggacagcaaggagtactttgcttctatttagacattttatttacattcatggtcaagttttgccatagcctttgttgggtcacacattgctcttatgatcgaaattgcagttatgtggacacattgactttctgcaaataaagttttgttgtgtttcattttggatttgttctgctcccatttaaaaaggaaaattcaaccattgaaaaataatcttatttgattctagtcaccttttttaagaaatgctagttaaggttttatgcaagaagttacttaaaagctgtgtaatgtttaataaaatgttattggctcttttgtacctggaagcgt

SEQ ID NO: 35203 - DNA, 7636 bp, Oryza sativa
actcttactgtaagtatcacctacttttttttcccttcccactgttattgtatcttttgcatgttgaatacatatgtctgatctatgttctaacttttcaaaataaacttttgctcatgcgcaattgcttctttttagcaggaagtcatgagaaaacaaagttaggtaaattaacaaaatggaaccccagcacagagtggacagcacagggctggaagcaatcatcttcaccggatttctgccgctccaaaccatctgaatatggtttaagagtactcctttcccctaactttatgaatgacttctttttttttcttaataataaacatgatattcctcctgttcttatctcaataagctgatcaatggcactgtggcacatatttaatctcatataaaaagaataaatcaagataatagtagcactagtactgcatatcctaagccacgcttataattacactggcagaaccacaagcactttttcttcaccttggaggcccctggagtggtagtgtagtgctcctgccgcagcttctgtgctgcacccattaccagtgcgccagggatattaaaattgggaagcttttctgcagataatgccactcatgcactttttagcatcccctcttgctccactttaaaaagctgcttgcagcaacacaatgcttagggttagtttaattcctgggcataccacaactcctttgccatgtacagatctaatacagcagcctaactgccttatgtaactagagaaagaaaaagaaaaggaaagaaaggatcaaaagaagagtatgcagtgattacggtttcttttctgctttcctctttgggttttcttttgcggtattttgctcctctctgttccggggtcgatcctcaaactgtgtatatactttcctccttgaagcgctccttttggggcaatggctttgtgatgattagggcttggccttttcctccccttttgggccatatgtgaccaaagctttatttgactgaccacttaccactgcctcggattagtttgaacagaccatgctttgcatatgtagcgtgtaacacattgataccagaatcctataaagaaggtgaaagtttatctgtgcagaaactatataagagtttcgaagtagtcagtaatcactactagtcgctatatattggttttgtgaaaactcaacgacatcaatgcgaggcccagttctgattgttgtgaagaggcacatacaccattgcacttcactagctcgtacaagatgattgagaaatgaatggggatctgttgggaaggcttgagggggaagtcatttttgatactttgtttttgctggctgtttaatcgaccccttttccctgttcgtatccccataaaaaactatgttcttgcacgacttttgatgcaaatgcacgcagtaatgaccggtcaatgatgctgtaaacgtgcttttaactacatactttggcttttgcctgacagttaattctgcttgtagtaacactgcagtacaacagaatatttgagcggcgcttatatatgtcaataatcatgcaattaataatgatgcaaatatattcatgttgatcttgatcagtgctatctttgccatatattagtagtaaacatttgttctgttcactcgtagattcggcacattggcactgaaccttcagcagttgcctaaacttaattagtgaatgtttcaatttttgtgtctagtaatgtagtctgctttttagggaacaagaatgctgaaaagccccggctttgctgaacagcatgtggctgttttatgcattactgctcctagtaattgtgagcgattctaatctttccatgcatacacacatacagtctacagagagcatatgggcaataaggggacgctttattccatatactttgagtctagagagaaagaggccgtacacagttcccgattcttttagggcacaaagatctctctctctcagaaaagaaaaccaatttaaatgggccctcttaaaagatgagaggtcactgcaggccacatcagatcgtatcgatcacataaagcatcatatgttgtatcgtcatcattgcaacatcagccccatttccctgttagtaatgtgatcaatcgtatcagtatacgacgagcagtgaacaggtataaaagtatgtatgtacttccttcatgatgaatatattgattgccctctcttaaaacaaaggctatgcggacgtactatacctgtgctacattatatgcatcttttcaatttgatgtattttcagctagtggctgtttagttagatgcatgggtcctagacagacgtgcttctatatatgtacatgtgtgatagaacaaaactgtacatatgtactcaattcattatgttgcttggggtaaatttagttctcatctagatacctacgccaataattcggtttaccaacaattatcccataccattgtttctttcattctcatcattttctcatgaatttcttgtgcatgtatccttatcattttatcatgaataccacttgtcacatatgtccaatcggggaataatgaagttgtggtatgaagtataaatttagatattatactgatgggtaagggaagagaatacactgagataggtaacctgtcccacctgaacaatgtatgagaaaaggagaaataacctgcaaaagataagtggcaaaagctgttacttgtagttttgctatggatcgttcctttcgttttgttttatttttgcactaataggtttggtgggagatgtattggtgtttacatatggtgacatgcatggagccatggagaggtagggaaggcataaattctatcaggtaagagttgcagcaaaggtttgtctcttattactaaatatagtatcccaaagtatatatggattcttcaatttgccattttactatctagttgcataaagattagaaaggaagattccacaactatatattatagtgacaactcaccaaacatggttgtgagttaattgtgctgcatgtcatgatatttttccctgagaaaatggagaccctctgaaataatgaaaaaaatttcaggggttatgacattatgtttaccttatattcacactttactgcgcttactttgttacatggaacaattattcttgaaaaatatcattactaaggcaccttgtctgctccaatgaccaatgcacacttgtcatttcaccaaatccttctagatcaggttctaaattttatggtcgcccggcttttgcgcactttgatgcaggaacgcatagaatttagctcaggtcattctttagaggcagctgatcatatacagaagactagtcacaaagatactgtgcacaatccatatgatctcctagctagctaccctctgcatgagaatgtgagaacgccttgcttgaaacttgagacttgagagagatagaggggaaagctggggggcctttgtatctgctttgtcagcacatgcattctacctagccaactttttctttcccaccacaaaatccactttggaccctaaaaattatagcccaaagagaaagaaaaaacaactatgcagccctccctaacaagaaaagcacaaatccacacaccataatctcctccttccttcaacctctgtaccttctcaccccccctctagctactcaaaagatgaacattcaccaacatataaagcagcactgcatcctcccaccacttgcaggttgcagctgaagcagcagtgacctccgtcccccttctatatctgcacatctcattccttctcctttttcttctcctcacacactaccgttgccacatcaaatcgatagattactagattagctaggttcttgtagtatacgtagctagctaggtggtgtggtgtacgtgtgagagatgagggccggggggtgcacggtgcagcaggcgctgacggcggaggcggccgccgtggtgaagcaggcggtgacccttgcgcggcggaggggcaacgcgcaggtgacgccgctgcacgtggcgagcgcgatgctggcgccgccgggggggctcctccgcgcggcgtgcctccggtcgcactcccacccgctgcagtgcaaggccctggagctctgcttcaacgtggcgctcaaccgcctcccggcctccgccgccgtcgcctcgtcgccgctgctcggcggccacgggcacggccaccacggccactactacccgccgtcgctctccaacgcgctcgtcgcggcgttcaagcgggcgcaggcgcaccagcggcgcgggtccgtggagacccagcagcagccggtgctcgccgtgaagatcgagctggagcagctcgtcgtctccatcctcgacgaccccagcgtcagccgcgtcatgcgggaggccggcttctccagcacccaggtcaaggccaacgtggagcaggcgtgcagcaccaccacggccaccagcgcgccaccgaaccaaaaccctaaccctagctgcaccggcgccgcagccaccgccaccgccaccaccagcccggctcatcctccggagatcaaagccaaactgccactgctcgacatgctggcgcgcgacgaggacatcgccgcggtgctcgactgccttgccccggcagcggctggcggccggggcggcggcggcagcaggaggagggtcgtcgtcgtcgccgagagcacggccgccgcggaggccacggcgcgcgccgccgtggacagggtcaggagaggggaggcgaagcagcacgacgcgctgcgtggcgcgcaggtggtcagcctccgcgtgtcgtcgttccgcgacatgccgagggaggaggcggagcggcggctcgccgagctccggtgcctcgtgaagagccgcggcgcgcgggtgctcctcgtcgtcgaggacctcaagtgggcggccgacttctgggccgccgcgcacgccggcgccaggagggtcggcagcggcggcggcggcggctactactgctctgtcgagcacgtcgtcaccgaggtgcgcgccctggcgtcgtgcgacggcggcatctggctcgtcgggttcgggacgtaccagacgtacatgaagtgcagggcggggcatccgtcgctggagagcatgtgggggctccagacgctcgccgtccccgccggcagcctcgcgctgagcctcacctgcgccttcgacgacaggtaaaaaatcatccgatcgatctaaaaaaagtttgttaagttctcgcggcgcagcgtgtcacgtcaggtgaacgaatcatgcacccgcgccggccttgcagaaacgaaatgcctctggtctctgtgatctgaccccttcgttactgagcaatcagtaagcatcagtagttcagtaccatgcgggtgaaagcttttgcatcttttgcgtgctttctgggcaaaagctttaggtcaatctatagctcctcatcagcttcacattctctttttctaatatcgcattatttgaacattcacgagagcatgatatatcgacaatacaatttcagaggtacagcggctgacaaagatgatcagtttagctgatcttgtggagacatgtcgatcggtgaggtgacagtgtgtgcaggaatctaatttccgttttgttattctttctgcagcgcgctgggcgcagtcaatcagtccatgaaagcgagccctcacaccaccgatgggaaccgcccggcgccgtcttgcgggccgcttttgggcggcagccacctcctctccagatgctgcggcggcgactgctccgccgcgacgacgacgcacgagcacgacaccaaggcgtcgttgccccgctccttcgtgtcgtcgtcgagcctcccttcttggctccagcattgccgcgaccagcagctgcaggtgccactcgatcgaatgctaatctttttatcttaattaatcggtcaatcattgctgattttttttttgtcttctcgtgataggagtcgacacatttcgcggatcttggcaagacatggggatccatctgcggcaagccgtctcagcggatgacgctgcatttctcggcgccggtgtcgccggcgtcctccatctcctcctacgagcacggccacggccaccagcagcagcagcaccagcctcaccactcgtggcttctcgccgacctcgacgccaagcacccatggaagcccaagcgcgaggacgacgacgacgagaaggccaagtcgcacgacgactgctccggcgcctccaatggctcggtggaggtggagtgccgttccaggttcaaggagctcaacgccgagaacctgaagctcctgtgcgccgcgctggagaaggaggtgccgtggcagaaggagatcgtcccggaggtggcgagcgccgtcctccagtgcaggtccgggatcgccaagcggcgggacaggtcgaggtcgacggaggcgaaggaggagacgtggctcttcttcctcggaggcgacgggcacggcaaggagagggtggcgagggagctcgccggcctcgtcttcgggtcacgcaagagcttcctctccgtcaagctcggcgcctcctcctcctcgccgtccgagtcgggctccaccgaggatcaccaccggagcaagcggccgcggacgacgacgacgtcgtcggcgagcgaggcctacctcgagcggctctacgacgccgtctcggagaacccgcaccgcgtcatcctcatcgaggacgtcgagcagggcgaccatcgctggcaggtgggcgtcaaggaggccatcgacagaggggttctccggagccaggccggcgacgaggtcggcgtgggcgacgccatcatcatcctgagctgcgagagcttcgaggcgaggtctagagctggctcgccgctgatgaacaagaagatgaaggtggagaaagaggaagccaacacaagtgatcatgatcacaaattagaaatcgaatcaggcgccccctcttcttgcttcgatttgaaccttgacatggagagcgatcaagcagcagatgagctcagctccggtgatgtctgtctgctcacggcggtcgaccgggtgctgctcttcagaaggcaggatgaaatgtaacactagtgtacatgaaggatccatgtttatcagctagggtagctagctcattgctcgtctaattagattttcctttcatttgttttgatggttttttttgtttctagtattaactttggctttagaggatcatggcattggtgcggttggacaatggcatattatgagcttcgttaagatggagctctgttatatatttgtggtggtggtgatcaaatatattttcatctacacagcggtttggataatgggtataactatattttgaacatgtgtgctgaattcactgtttgaggcgacaaaggttctgagaagcatatccaactgaaaaggcttgtgaatattcaactagtgagaattaatatgaagacgctagaagttatatatcgaacttggagctttcatattttggattttgcagctgctgagttgggaaactattttcatcccccgaggggatatcccctcgttgtttgcatatcacccaaatagttatgaaaaaaatcgaaaaaatttgagaagatgtattaaatgtgatatatcactctacaaacatacaagtttaaat

SEQ ID NO: 35204 - DNA, 1983 bp, Oryza sativa
  unsure (1)..(1983): unsure at all n locations
tctcctctaaagttaggtggtatattggtttcacgccttctcaaattttggtactccctccgtttcaaaatatttgacactgttgacttttcagtacgtgtttgaccattcgtcttatttaaattttaagtaattatttattcttttcatatcatttgattcattgttaaatatactttcatgtacacatatagttttacatatttcacaaacttttttgaataagacgaacggtcaaacatgtgctaaaaagtcaacggtgtcaaacattttgaaatggagggagtataattttacgatgagtcaaaagttttatagcaacaaaactaaatactctctccttcctaaattgagcatcatatatgtttatgcaccaagactaagaataatttcaatcacatcaatcatgacaccatgcacatattctcccacaattaatacatcgattaaaacgccatgccaattactccctctgtcccaaaaaactaacttctagagtttgaattttgtcccataaaaaaacaacttctaccatactacctaccctcagcacgtaaaatgagaagttttatcccttcaataccctttaactacatatcactcttactacttttttcaataatgaagggcattttagttattctccatatccactaatttcacctcgggatgctaggaatgtatttttttttgggacggagggagtataccttagcatgcgtacattctcccatactgtattaattatattctgatgaaatctatgtccacgcggttatatgatgataaatttgagaaattttaaatttcattatatgatgatcaatttgggaagagggagtaataagattggatcgggaccagtgtgtttggtttgtcagtggatccaccaaatttaataaagtggtgggctgtattggctctaccgtctaccacgaggccactggtaccacatccatggaccatcatgcatgggccatgaaaatctatggcccattttcccccgcgcttctccgttcttcggcccacataaacacactggcggcccgcgcgcacggcgcaccgcgagccctcgcaaagcaaagcatggcctcgctcgctcgctcgcccgcgcctccagcgattgtcgtcgagacgtctcgccgtctcgcgatgaagcgaaaggctttttgtccgctgcgcggctgcgcgcgggcgtcggtttcagccgcggtgtcgccgcgcgcgccgcggccggccggtgtgtcggtgcgcggccggatttttccggctcataaaaccccggggttggctatcagctacgtcgtcgtcgccgaggcgatgattgatgtcgggtgtcacgattgatcagcctcagctatagttctcccatcgactctgcagtgtcatcactcgtcagctctcctctcctcctgcccgtttgatgtaagtgtaagtacgtactcggggacgaccgtgacgcgctgccgaatgccactcccaactcccgctagctaggtacgttggtgggtcactctccatccgccctagcgcacttcatttcatttcatttcctctgccttctcttcgctttcgttggatcatctcgtctgtactatactgtacggcgtgagaaaattgcccacgtacgtacctgtatctcatgaagactcttgctctcgtaatttatggtactcgcacaaagtttgaatgaacggcatgtgtctccgttgaaacgcgaacaggtacgctagtgtcgttgtggggatggaaggcaggcagggcaaatactctgtttttttatacattgttgattcttcaaaaggcatgcaaaaacgatcgatcgactgtattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35205 - DNA, 598 bp, Oryza sativa
actgacaaatgagaaatatgataattcaataccgaaaccagctagaacaaatagaaagttatttcttaaccaatccagggaagataacctcaggcagaaactggtaaaatcaattttctcgatggggtatgagaaacatatgaatcaacaatttcagtttcaggagtcagtactttaaaatatgaagtcaaattcaacaggatcatttaaaagttttccggttctttggatttctcagtgaggaaaagacatctctttttgacatatcaggaagttgtgagcatcatgtttgtacattatttccataccaagattagcacggttgatgatatccgccgagtattaataatacacccttggctatcaactacggaatgattgaaattgttgaatgaaattacacattcttataaataagggttggcacataaatatagcatggtgaacccccagttcactacacttttaggatattttttaaatttatgttctatagcaaagctatgctttgcatgaaaaactctagttttatcagctattatcttggctgcagtggtcactagtttagttcttcaaccattataacaatgtacgacac

SEQ ID NO: 35206 - DNA, 778 bp, Oryza sativa
gaattttagattttttttgcataattcaaattatcagacagcatgaaaatagtgtcatttgcatattgcaagatggccaccttttcattaccactgacagtcagaccttcagtcagattgttgtttttagctctctgtattaacgtagtgagtgcttcagctgccaaattgaatagcagaggggagagagggtcaccctgtctcagcccattatgattattaaagtaaggacctatctcatcattgactctcactgctacttttcctcctttaattactctcatgatccaatcacacaacatatcaggaaagccttttgcttcaagcattctatatataaacacccagtcctctttgtcataggccttctcaaaatctaccttaaaaatgatcccactttgctttttttgtgtgaagtattcaacacctcatgtagaatcacaatcccttccatgataaacctatttttgagaaaagcattctggttctttgaaatgatagaagccataaccctatccaatctattcatcaacacttttgtaatgattttgaaactaacattcagcaaacatattggtctaaatttttgtatttgagcagcgtctttagtaattatgacataatttagtctctcaatgtctagcacacctctatggaagtcattaaccagatccagtaaatcaccttttattaaatcccaaaatttaatataaaaatcaccaaggaaaccatcaggaccaggagccttattctgttttagctcaaaaactacctgttt

SEQ ID NO: 35207 - DNA, 746 bp, Oryza sativa
ttggctcatgtgtgtgcaggtgatcgcagtcaatcttagtcaacggcggatcgggactagactcagggaggagttgaggtccagaacgatcaagaatgctgggtgacaagattggacgcaaggttgcacacggtgggcggacaccgtgtgaggaggtctttacaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcagggaaggccgaaccaacccggcctaagcacgttgctgactcaagatggtgaaggccaggccgagcaggccctagacatgacgacggcccagctcggctcggcaaatgcacaggtgtgtgcatgcgcgcgcggaagcgggagatcgtacggcacctggaggcgtggcggccttctgttcgtcaaggaagcgaccgggtcccacgcggtttttcgcatggcgcgcgcgggaacatggttttcgcgagcgcgcgcagaagcggctcggtgggaggaacggcgacgtgacgtgtagcgcccgttccgtcgtggcacctagcgggaaaattatctcttaaaaaccctaattgcgaaatttgtttct

SEQ ID NO: 35208 - DNA, 691 bp, Oryza sativa
cacagtaaccttggaccttctcctgaagagaacaactgcaaaaaatgaaaggatcaacaataccacaactgaataagcgacgacggcagcgattccagctgcactctttttcttccctgcaaacaccaaacatgaacttcaattggggaaaccttgatttcactgtaacttctgttatttttttttcttcaggaaaaatgaagaacagagtaggtcatactccatacctgctccaggctctagagatagaaccggagcctcggctgctggtggtggtggcgccgacagctgcagcatcgcccggcctccgtagaacggccgcacatttccccaatcaagctgttgacgcttgtcggcgtctgatattgataaaaaaacatgttgagagtgaatgatcagcttgatgttattgaactttgcagagaaaatggtgaagatatttagctaaaattgagtggattagtaagtttggtggtaccaaagaggatctgatcgaggctgcggttgggaacaaactcatagacgagaagcctctcctcttgctccaggcagacaccgacaagcctgacaagattcttgtgctggagctttgcaaccaatgcgagctcgttcttcagctctcccactccttgtgctgaactcttcgataatctcttcactgctatttcatcgccatcaggcagagtaccct

SEQ ID NO: 35209 - DNA, 245 bp, Oryza sativa
cccccccccccccccctcttggccctcctctccctcctcgccgtgctcgatcgatgatatcctagttggtaggcccatcttacagcccatgaaaattaatcggaaggcccatttgacagaacagcccatacgagtaatgggccacttttgatcggaggaggatatttctgaggtgaaaaaaaaagaggaaaaagtacaccagaggtccctcatcttgtcatcgattacaaaatcgtcctctaacc

SEQ ID NO: 35210 - DNA, 648 bp, Oryza sativa
cctgccaccgtcgaccgttcgattgattggcacgtcgtccgcgaggaagagtcatgtaaggtattggtttgtattaatttgttcatttccgattcaattttatttactttgcacgaagtagatggcgattgcccgtatccggtggaccgatatggaggttcgtgtgtttcttaagagctgcttgaaggagatggcagcgttcaccatcacctccaactcccccaagccgcaggcatggcagaacctaatacacaagatgtacaccaagtgcaagaataaggtgaacaaggctcaattggagtacatttgggggcagtgtaaaaagcggtacaacaggtgggtgtggctagaatcgcatgcaagcgggctgggtcgtgatccccatacatcagccattgttgccgatgatgagtggtgggaaagcaagaatgcggtacgtacacttgaccataaatattttgaaccaacaattttgcctacaattggtattatctgaaatttagtacatgcatgcaattatgaatacagttttgtaaggtgtaataatttttttgttcaaattgtgtgtgccaacaaatgactagctgcagtaaaatgcaaggattgtgatcacatatgtttcatagttgttactgtcatgtcgttttt

SEQ ID NO: 35211 - DNA, 7852 bp, Oryza sativa
  unsure (1)..(7852): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcatgttggaacatatgtactgtccttttttcccgcattctttttctctttttcttcttttctgaagtacctgtctgtattggacccttgcagcttactgtctcctagatcatttctactcttttctgtgtggtgatttttctttgagggaaggccacagggcccagctttttatcgaaagcagaagtcctacatagtttttacgtaacactggggttaccggttttcagacataagcacaggctctcaggcaaaataacagaaaggagtgtggtgagtggtgatttttaataatcttaataattggaatattgctttccctaccttttctagtttgtgagagagagagagtgtgtgtaacaagagcacgtacaagggtacatcgaggatagcatagattggtaaactaacaagttaaaaaataaacgagaatattaggggatgacctaatatcaaataattagaaggagtgaggcttcgaacccaggtcgtttagtccaccaccttgtggagctagccggaagaccctggatgtttctctaaaactaacaagttatgcaatagttcaactatgaatgctggcttcctctcatgtttacccttttcaattttcccaattacctgatacataccgtgataaaaattatcagaacttcaactattatgttccttctctaagttcgaatgtgtataagccagaaattcagaatgacataaagaaagttatatacttctttcaattatgtccttactaagttattactgtccaatcgcaaatgcatctaaaaaaagttactgccacacggctaagcttccttaaaatcattgtaatttgacatttcattctcctggccgcctaaagagcataattaaccatgtgaacatcccctgcaatgaaaccatgcaaatttagcatttaccttcagcagcagttttggaagctatttatgtgttatagtccacaattgtcgtgcaattgaattttgtagtgtgatctaaccaaatattccatttccaaattattgtgttttccatcccttgcactacaaaagatggtgataatgttctcctttaaaatactcccagcaacaagaatgcttcaaaatctttcagcaagtgaaacagattattcgtgagattattgtcacggttatatattttattataaagatatattaaatatttttagaaatgcacttagcaaactccataaaaaacctattattggacaagacataatctaataaaatggcatgtcacatctaatgctatattatttttttaatagagggagtagcttaggaggtgcttagatcatgggtgaaaatattatgccgtgtcacatctaatatacggacacacatttgaagtaacaaaacaaattgcatgatccgtctgtaaactggagacgaatttattaagcctaattaatctgtaattagcaaatatttaatgtagcatcacattgacaaatcatagagcatttaggcttaaaatattcatctcgcaatttacacgtaatctgtgtaattagttttttttctatatttaatactttatgtatgtgtccaaatattcgatgtgatagggtgaaaaaatttgccagagaatctaaacatggccttaaaaaacattgtacgcaatgcaacaaaaagtattttcaggaaatgtgttttgaagacgtggagtgcacagtccaagatagtaatggcttaaggggtcgcgatatcatatattatggttaggatacgaatcagatttggccagtagctaagggagtcaaaagaacttaggccatgtttagttcgcgaacgaaaatttttggtgtgaaacatgggatatacggacacgcatttgaagtattaaacatagtctaataacaaaacaaattacagattccacttgaaactacgagacgaatttattaagcctaattaatccatcattagcaaatgtttacttagcacaatgttatcaaattatggcgtaattagacttaaaagatttagtaattagacttaaaaagatttatctcataatttacacgcaatatgtataattggtttttttctacatttagtgcctgtttagtttcaaatttttttttcccaaaaacatcacatcgaatctttagacacatgcatgaagtattaaatatcgataaaaataaaaactaattgcacatttaagggggaatttacgagatgaatcttttgagcctaattagtccatgattagtcataagtgctatagtaacccacatgtgctaatgacggattaattaggctcaaaagattcgtctcgtggtttccaggcgagttatgaaattagttttttcattcatatccgaaaaacccttctgacatccggtcaaacgtctgatgtgatacccaaaaatttttatttcgcgaactaaacggagccttaatactccatgcatgtatcaaatatttgatgtgacagccgtgaactaaacggacccttattttccaatttggaaccaatatcccggcagacactgaattggaggcatctaggggtttcgtcgccttcgccttcgccgccgccgccgccgcttctatctcttcttctccgtgaccggcgcacatcgcagcaggatagccggcgcaatggttggccttaaccggtgagggtgctaggtttgccgtcctggtgtcccgtccgacgagctccacgggtcagccgaggccgagcggcaagtcacgcgcgcggcggcatcgcttccctgccttgatcggtaggttcctgatctacacatttagtcctcagattagttcgtttcgtaggtggattaacgaacccaatgatgccgatttgttaccagatttttctttcttcgccatttcgatgttttgctcaatttaatccccatctgctcacctgctcgatctgctcttgccgcggtcaatccctcttcacgcggttgcaggctgacgacttcctctcctccacccacccccgatggaggagaaccttcccaacaagcggcgcaacccggcggccagtctcaccgacgagctcatcgtcgaggtcctccgccgcctccccgtccgctccgtgtgccagttcaagtgcgtgagcaagtcctggctgaaagaccaagaacagctatagagggggtgtgaatatagcaattcaaatcttacccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccacttcaagccaatcagcgtgcaccgatccgcgtcgtgctcctccaagccaacgcatccgcgccacgcgtcccagagagcgcgtgcctgctcctctcacgcctgcgcgccaccagtccgaagccgtcatgtcacgccccgaactaatcccgaccggaactagcccgtgacgctccaaattaacctgttggtcgataccagtcctaggaaacagtgctggtatcacagggagacagaatatcacagcaacagcggtcactttattatagagtagagatacagtcatgttgggctacggacagatcccgagctcacaactgcattacaaaagggaaacggaagccaggactaggaccaaccaacacaggcgcgacttgggaactagaccgaaaccctaaaactcatcgtagccggcttgctcctgaaagaactcctcatcagcaggatccgcttcttcttcttcagcaactggggggggattatttatatagagcaagggtgagtacgggagtactcagcaagccaagggaaataagtgtttaatgtaggcttcaaggaaaggctgttgtttttgctgttgattttatttgaactcttttctaaaaacagctaagtgagtgtttctcaaacgacacggttgagacagtgcgtctcgtccggtcggagtatgtgcaatgtatcagtctttaaaattgaaaacaaggttggcacccggccaacagcttttcaaacggccacccgggccaacaactttcaaacggccacccgggcctagctgatcccatcagctgcagatttttcaaacagcgaacccctttctacaacaacaatttcacaagcagtagtcaaacaaaactacgctaggaatcacctcacatccgcccatgacggtgggcacggctgttcgaacagtttgttaacctctgcagatggggtacactttacccacacgacattactaacccggatcacccagcccgtggggatcagccacgtcgggagacctccaagctttcatgacaaggcatttccaaagccgacacaggtttaccatataccgacgagaggggtcccagactaacaacaggttaggtcccagaccatactgtgccaggaagcccaggggtcctccccgacaccaccccggcgaatccacatgtctctcggcatcaaggctcccctgataagctagttactcagccaggggtgtcccattccacccatatggtcgtacttatcttatgtttggatgaaattccaaggaaacggtccttaagtgcaagagcgggaaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtatgcccaccgatctgccttgcagacggggcaacatattaagtgcaatcctatcaatgcataatattttgcaagcaatatgattaaatttcaaatataggctcaagatgttcaaaggtggcttgccttgctcgagatctggagcttgatcctcgaaagcctcgcgctgcggatcttcgggctccgaaactacacgcgaaacgggacaactcaacaaacggcgaaaataaagccctattaatgacctctaagcgtgccattagatagatctcaagatttgaggaattttggaagttgaacggagtcaaacggatttacggttgggaagatattgaatttctaagattattggatttttggtctaaaggaaaaggatttaattaaatcctttttgaaaaagaaaagaaaagaaaaaaaaggggagggaaaatagacttttcctcgggcggctagggcgcggcccgagagagatgggcggtccggccgagctaaatgggccggccggcccaagaaggcggcccagagcggcccaaggcgtgcgcgcggaagggaggagagagtgagccggtagaccgggctcaccacacgcggtcccgggtgggacccgcttgtcagcggctcggctcaccgtgcggagggagcacgcggcgcggcgctagggtgggggagggatgcggtgcacgcgcgcggttcgcggtggacgcggatgcggcgggcccacgcgcagcctctcggctcgcggtggaccgcgcgcacggggaggggctgaccgggattggcccgatccgatctcggccgagctggcgccgacatggcgcctacgtggctgccacgcgggccggcgggaggtagacgacgacgccggccgaaacggacggcggacgacaacggcgagcggcggagcgaaccacggcgatataggcggaagcgagtacaccgggtggttgaacaggacaaggggagacgagccaacggctcggattcaccggagggagtccgtcggcggcggattgcggcggcggcaaccggcggagagaaaaggggaaaacggcgacgaggtcacgaggggccaattcccggtggcaagagcatctacgcggccacgggaatccgatgctagcgtcggattgggcggagctacgccgagcgaggccggcgacgagcggcgcttccgagctcgggcggcgacggcggcgagcacccggcgagcggcggcaacggccggggcggcgccggctagctacggggaggctactcgtgctactaccgaaaactaagggggagaggtggagcgaggaggaagaacggagggaggcactaccgagatgaggaggggcgctgtgacgagaggccgacggcgcgggagtaatctctccggcctcgggccgaggaagaggaagaaaagggcgcgcccggagtccccttccgcgtccttgctcgtgccggctcctccgacacgcgcaacgacgaacggcgacggcgaacagagcacgggaggcggcggcaatggcgtggaggcgaatgggagaggaagggaaaggggggagctgggttttaagggcggcaatgtcggtttgggaaccgacttagggcggtcaaggcgcgagctggcgctccggctagcagccaaaacggcgacagaggtgacgccggcgagagggaaaaaggaggaaaatggggaagagaaagggggcttgccccttgcttctttgggaaaaggaggaggggagcgggggcgacgcggcagattgaggagggctctgcctccgtctcttggcggcttgcgcgcggagaggcggggcctaggcgatgacgacggcgatgacggcggggcggtgtggagcggagcggcgacacgagcgacaggcgcggcaggcgctgacgacggcggcgaccaggcggtcagccaccacggcacgcgcgcgcgggaagcaacgggcggcgtggcggtttgagcggcgtggctcgggcacgcgcgctggctagcggggccgggcggctgcgcggcagggcagcggggccaggcggcacagacggcgcaggcgcggcaagggcggcgaccacgcgggcgtgcgcacgcgaacacggcgcgcgggaagcggcagcgagggagcggaaagggaggactcggctcggcgcgggcggctcacgcgcacgcgcgcgggcagagcgga

SEQ ID NO: 35212 - DNA, 15306 bp, Oryza sativa
ttgaaaatttgatttttgacacaaagcaaaccattttgcaaaagtcgaactttggtcattttgaaatcgcgaaaaatcaagaccaagtgacaagaagaaaagggatgcaaatgcaaatgcaagaatgctccccctatgtgccaaactccccctttcaccaagatctaaagcaagttttaattttcaataagtgcaaaattctctccccctttgtcaatgatgccatcaagaccaaaaagagacaaaaatgcaaaatgaaaatgattgaaacttgcaaattccagagttctgagagctttgagagttatctaaaggcatcaaaaagtagacatggatcacacagatacaagcatgtgctcaagcctagctaagcatgtgcaaaagaagtatgaaacaagttatgaatatcaggatagtatcgccagcaagcaaacagctttcaagtggattagtgatttagtgtgcatagctatttctagaagaagcttaaaaggaagcaaaccagctcataatcatgcaagatttacataatcaaagcaatgaacccatgctaatgtgctaatgcccagttcataaagagtatcaacatggtaacaaagcatagaacatgagcttttaatcttttctcatgacttttctttttatgattttttttttaaattctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacacactcagtagcccggacaaaaacagagataaagcttgtaaagcaagattgatacaaagtatggacgcataagcatgagcattcatgagcatgtactgacagttattgcaaaaagaatgaaaacatagcatgagtatgagatggatacttcaacttaaacaaacttctagagcaagcattgcacattgattaagttcaaatgaatagtcaatttaagcaggtttcaacaagcttgaacagcataacatgatcacacaagctacttaagcaaatgaaagctagacaaaagatcaaactagcataagagtaatacatgcatagcatagtgatgaccaagagataacaagcaaagctcaattgaagagtgtataatacaatgcataaagtaaacatgatgcaatatgttacaaatgcatgtaaaagaaaaacaactccccctcaaatcaagccataggggtggatcacccctaactcactccgcaagaactcaaaatgagagcgatcaagtggttttgtaaaaatgtctgccaattgattttcagattcaacaaactctagcacaatggtacctttctcaacattgtctcggagaaagtggtactgtatctcaatgtgcttggtcctagagtgttgaactggaatttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggggtaccaaataccgtactcaagtgtagacttgatgtagcggaagatgcacttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcgccgtcctcatcaggaccaagcgatgaagtagttgccatgggggtggcgattggcttgcagtcggccatgtcgaacttcttcaggagctctttggagtacttggtctgatgtacaaagattccttcctttgtttgcttgatttgaagtccaaggaagaaagtcaactctcctatcatgctcatttcgaattccctgctcatcacatcagaaaactgggcaacaagtgcatgagaggagccaccaaatatgatatcatcaacatatatctggacaagaagaaaatcaatgccactatgaagagtaaagagagttttatcaactccccccatttcaaaaccattttgaagcaaaaaggttttcaatctttcataccaggctctgggagcttgttttaaaccataaagagttttatcaagtttgaacacatgatttggaaattttggattttcaaaacgaggaggttgtttgacatagacctcttcctcaataacaccattcagaaaagcacttttcacatccatttgaaaaagcttgaaaccttttgaagcagcaaaagccaaaagaattcgaatagcttctaatctagcaactggtgcaaaagtttcttcaaaatccaagccctcaacttgggtgaaaccctgtgcaactagtctggctttgtttcgaacaattgaaccgtcttcacttagtttgtttttgaaaacccattttgttccaatcacattaaaacccaaggaaggttctaccaaagaccaaactttgtttctttcaaaattttctaactcttcatgcatggcattaacccaattctcatcagataaagcatgacaaacatttttgggctcaaaagaggcaacaaatgctgaattgacaagttcataagaccgatttttagttaccctttcacccaggcctccgatcatcgagtcaggcggatgtcggttctggatgtgtcggggagctgttggtcctgatgtgccaccatcaatctcctcagctgctgaagatgatgtagttggtgcatctcctgaaggcgatgtagtcgatggagaaccggtttcttgtactggtggtgtactgtctagaggtggagaaatggaatcatcgtcatcatcatctgaatcctcatccacaaggatgctttcatctggaacacctgaaatttctggtctagctcctgggctagcctcatcaaaagtgacttcacaagtctccacaattttgttagttgaaagaacataaactcgataagcccgagaatgagtagcatagccaagaaaaatgccatccacagatcgagattcaaacttgtccaaatttccaggtttaagaacaaagcacttgcaactgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtagtaaactcatcaagcatagttcgtgccatctccacaagggtgcggttcttcctctcaaccaccccattctgttgtgggacatatggcgaagaaaactgatgttcgactccagaagaatcacagaaagattcaaatgcagaatttttgaattcagagccattatcactacgaatggctcgaagagcactaggaaactccaaagccaaactacgagcaagagactgaaagaagccaaacgtttcctcttttgattcaagaaaatagacccaagagtagcgagagaaatcatccacaacaaccaagacataccacttccccccaactgactggacctgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactattgcgagacaagtggtcaaagccaatatgaccaagacgacgatgccagaaaaacaaatccctattctctgaggcaatgaaacaacgagaaggaccaggagcagaagagtcaaagttagcaaagaaaactcgaccaacttgagaaatgttaaaaacaggagattcagaagcatcaagaactcgagacctatcctttttgaaacgaacttctagattttcatcacagagttgtgaaacagagagcaaattgtacttaagcttacttacaagcgcgacatccttcagcatgaatttgtcattgaccttgattgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctacaagaaaaacaaagcaaatctcgatgattcagtactggggttagtgagaaatgacttaggaatccagtactgaaccatgcgaggggtacaagcatctttagtgttatgagcagaattatatgcaagatgaccatgtctgttttgccccaaccttgctaggtcacgtcgagggtgcacatctcggcgaggaaagcgagatacaccacttgaacgacatgcacacttgaacctctcagggactctagtatctcttctagtcctaaaacgttcttgtcgctcttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctacaggcttagacttgctagtcataggtaccatctttggttctgaggttttgggtgaactagaactagtgtttccaatgaaacctgcagacttgaaggttataggcttttgagctagttctatcatcccatctgtgacacctaatatctcatgggtacctatcctcaaagactcatcaaaatcatagcctataccttgattgtttatggacactttggattagtctaggatcatgttcaactttttctttccttgagcaaacctctctaaagattgttgtaggtaaaagttctctctcttagcagactcaagatcaactttcagagaaatgcatgatgaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcatcattgtcactagtgagaatgggacaattttcacacctaccaatcctatcatgaaattttttttcttttagttctttcaattccatctcaagcaaacccatatcaactttcatttcatagcaagtagagcaagcaacactagcactagaaggattcccagctcctaaagcacatgatttcaacttatccttgaggagattaatttcagagagatatgaagcacaagtagaacaggtatcctcctcaggaatcatggatcgaagcctagcaatttctagcgccataccatcattttcagattttagtttctcaattttatacttagaagacctatacttgtcactaatttcaatcatcaagtgtgccattctttctttgcttagttcatcatcaacagagtcattatctgagcaaaaatcatcacaaagagaaccatccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttatggatcgccttcttcatcaaatccttattcccctttcgcccttgtccctcgggcttcttggtcgtcttgtcactcttcttcttcaacttgggacaattcactcttatgtggttaggctctccacactcaaaacacacaaatggttcattggtttttcctctttttctatctctcacatttttgtaagctcttgagaattttctagcaaaaagagcaagatcctcttcaggaatcttctctaattgctcctcagtgactgagtgtaaagcggcaagagagaagccaccacacacaaaagctgagtcattagaagaagtgctaccagagggatcagctaccaaagccatcgagtgtttgaggcctttccgatggaaaatatccatctcatgggtttttagctttgagtaaagcttgtccatggtaaggtcactcagaggtgcactctctgtgatggaagtaactttcatttcccaaacaccataatcaagacaattcaaaagatggcgagcattatcattattagaaaattcttttccaacagatctcaacttcgaaacaatttctccaaaacgcttgaaataagaatcaatggactctcctgggtgcatctcaaatctttgatattctttatgaaattgattctgacgaaccaattgaatatcattgtttcccttatggaaattgcacagagcagtccacatgtcatgagcggacttgtggtgttgaacacaattaaattcaccagaagaaattccaccaatgattgcatttcttgcacgataattaaaatcaacctgagccacatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagaatatttttcctccatagcggcgttcgttgccacggttaggttacaatgaacttaaccttgctctcataccaattgaaagaccaagaacagctatagagggggggtgaatatagcaattcaaatcttgcccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagttcaaattgcaagtagaatttaaattgcggaatttaaatgaacaaggcaaaaacgaaatccttcaaatcatttcattcataggtgatgcaaaataaccgctcaactaggggcaaacatacaccttcagaggaacattaacacaaaattaaaatctctcggacaaacacactccaaactaatcctaatacaaaagcctctcgagcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccactccaagccaatcagcgtgcaccgatccgcgtcgtgctcctccaagccaacgcatccgcgccacgcgtcccagagagcgcgtgcctgctcctctcacgcctgcgcaccaccagtccgaagccgccacgtcgccgttcctcccaccgagccgcttctgcgcgcgctcgcgaaaaccatgttcccgcgcgcaccatgcgaaaaaccgcgtgggacccggtcgcttccttgacgaacagaaggccgccacgcctccaggtgccgtacgatctcccgcttccgcgcgcgcatgcacacacctgtgcatttgctgagccgagctgggccatcgtcatgtctagggcttgctcggcctagccttcaccatcttgagtcagcaacgtgcttaggccgggttggctcggccttcctgccaaccgaactgccagcccacaagcctagtggccagctcctgttggtctccttgccattcaatcatggcagcacacgtgcacatgatacatgctagctacagtaagccgaattactgtagcagcaatgcactcggtcttcatgtccttgcacagtcctcttctccttccaattttcttcgcgaatccgatgcttgcacacttgaccttgtgaagcccgttgcaaagacctcctcacacggtgtccgcccaccgtgtgcaaccttgtgtccaatcttgtcacccggcatccttgatcgttctggacctcaacttctccctgagtctagtcccgatccgccgttgactaagattgactctgatcacctgcacacacatgagccaaacaaccgttgtcttggcacagatatcgcaacctgaccaatggtagtctacgcacacacttcttgcacttccggtacttgtcaatttcccatcacaaaagaactataaccacacatggtttcacactggcgcagactcatcgccgacaacgagcaccgaaagaagctgccgcagacgctgtcgggcttcttctacgagagcatgaaccacgagcgctgcccgtacacggcgcgccatttcaccaacgtcaccgggaaaggcatgcctctcgtcagcccgaccttctccttcctgccccagtgccacgacgtcgacctcttggattgctgcaatggcctcctcctctgccgctgctacgtgtctcgtggcacttttcagttccactatgccgtgtgcaatcctgccaccaaggaatgggtgatgttgccggacgccaactgggctatcgaagagaaccacaccgcctgcttgtgtttcgatccagccatctcgtcgcatttccatgtgcttgagtatgtggaagaggatgaggattcatacgtcacactggtcacaggggtggagatctattcgtctgaaactgggttatggactctccatgaaaatggatggaatgatgaagttgtgattagcctttcggtcaatcgaagaagtgttttgctcaatggttttctgcactctgtcacgcctgctgatgagattgtggcggttgacatagaggggaagaaatggaggaagattcctatgccggatcctgatggtgatattgggataattcatcaaactcagggtcgcctgtgtgcttttaatgttgatccaaatgatatcttcaaactgtcaatttggtttcttcaagactatgatacagataattggatcttaaagcataccgttggctcaatgaagctgtttggaggaaagaaataccaattagattatgactaccaagtaattgcagttcatccagaatgcaatttgatcttctttgtttatggatggcacaatactttgatggcatatgaaatggatcgcaaggaagtccgtgtcatacgcaaactcggacatgagtcctgccagtcatatctaccatatgttccaatgttctctgagtcattacctaatgggcggtaactgctaacatgcagaggtgcggctccacttttgttattgcaaaaccgtctttgtaccctaatgagaatcgggcttagagtgggcagccaatctctaatatgaattatgaagttctgtttgtagtacttggatgatggctcctttgttatgaagaatgttgtgaaatcctagatggtacgtaagttggccttttggaaggtatgtccggttgttccgaaggttatgtcttgttttattccgctggtgtttaccgtaggctagttaaaatttatgtcctgtgttaacatgacaggccttttgactgtaccagcagagtcagtttatggaaccgtgactaatgtttggaagttggatcacatgtactttgttgatttttgccttcctttttcccttttcttcattctgaactatacttgtctatgttacatccatgcagcttaatgtctcctagatcatttccactcgttttgttaagtgatccacaatgatcattaattggaacattgcttctctgacccttactagttggagaagaagagagtgcaaacaagagcacatacaattgtgcaccaacaagaaactacacaacattttagacttcaaaggtaacaaagactggtatacaatagttatactattaccacactggcttcctccgatgggcaccgttctgaattttcccacttacctgcttcaagccatgataaaaactactgccactttgagctcctcaagttccgacatgtataaatcaactatggtatgaattttcttcttcttttcaattatctctgttctaaattactgccaaagtgaccaagcctccctaaaatcattgtggttttgagacctggtagttccatatagttctccactttctttcagtcctgttctgagaaagagcaatggaagttctcagaagaataagaagagaaagagcaatgaatattcttttggccccataagtccttgttcggttgcttgggaattaatccccaaaggaacctatccagggtccctcccatctcacttaaaccctgtgggggatgattccctttgcctctcctaatccctctcctaaaacctgtgttcggttttggccaggttttagtgctcgtcagacgtcaggcatacctcctgggatctggaaccttccaaaactgcagtacttgttcttgtacaccaaccagctcaccggcgacgtcgtcgtcaatggcaagattggagcagcaagcttaatttatctggacatatctgagaaccagcttactggaacgatcccagagagctttggaagtttgatgaacctaactaacttagtcctgatggcgaacaacttctccggcgagatacgagcaagccttgctcagcttccatcgctggtgataatgaagctgttcgagaacaatctctccggccagcttccggcggagctcggcaagcactcaccatttctgagagacatcgaggtcgacaacaacgacctcaccgagccgggggtctgcgacaacttcattatcacaggggagttgggaagagaggagggtgagaatgacatgtggggcccacgtgggtcctaccatttttaatctaattttttttgtgtaaactgacatgtgggtctacaatttttaatattttccaaatcgatttgacacgtaagcgccatgtcattgccacgtcatgtgaaggccgagtcaaaatagccacgtaggcatcacgtcagcgaaaaccgccgttcaaaccgctatgggacctatattgcatcggttttgacagttaagggaccgttgtatatggtttttcggttaaaggatgaaatcggattcgttgttaagggaccacagataaacttatttcccctgtaatttgagagttagtcaaaaacgagtaacccagcccatgtaactcccgtggttgagttttgtctgtcaaactaggaataagttcactttgggtccctcaatttgtcgcctagtctgattttgttgcttggtcgcaaaaccggatatgtgtaacgctccgcttctcgtgagacgttaaaaactaattcggcaaaatccgaattgcgaaaatttcgttctttgtgtgcgagtctaagtcgtgccgtggatctcagttttaatctccttgttccctctcgtcactgtcaaaaccctccacctcaagatttcaaatcccgatttaacttcctagatcaattccgaaattcaaatccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagaaaaagtctattttgcctcccttgtcgatgggttgattcctctctcccggcccatcccctcctctcggcccagctctctcgcgcgtgcgtcgcacgtgttcgggagcgagagacagcgccgtctcctttctctctctctctctctcggcgtcgcttcccgccgacgccgccccaaaattccggccgcgtcaccgttttccgcgcgctcgcgcatggccgaccggcaaggacgccgctcccaccgccttcgcctttcccgcgcgcgctcgcgtggaggccgaccacccggtcgtcgcctgcctcgcgtgaccgcctttccgcgactcgcctgcccgccgcccaaaacggaagggacgagttcccctttccaccgccctcttcgccttttttccccctcgggctcaaccgctcgctctctcgcccttgtccgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctaaactacagtgtattaggtcgatttattgaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtagtcgcattttagttggataattacgaccatgaagcatggccaggtgtctcgagcacacagctcaatctgatactaaaaaggtctaatactgtaattaccccatcaactgagctagtagtaattaagcatggctaagcatatagttctagctaggtcacataagtaacatgagctagtcgatttattacccaaggttgacaaagaacagatatcaagtaaacatggcacaagcgagcagataggtaaaccctgatcccgtgtaattagcaaaacatgcatatttatttgcaaacggtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaacagctcaattcggagttcgaatgaattagatatggattttagaagttgtgagccattttaatgaatttctagaattaaactcgatttattgcgcaattattatttatttttacaaaggaaatggacctcgctgacgtcagcaaggggaaaccagcgccgacaggcgggccccgcacgtcagcggcacaaaggggcggcgcacggtggaccaagtccacacgtggcctcgggtgcgcgtccaccacgtggatggcccagatcggcccgaagccgatcggacggccacgaggcggcgcggctagggcacgggcacggcatgaaaccggctcggccgagcgatagcgcgcggcggcgtgcggccagacgaccgccggcgacagcggcgcgtcgcggcagcgggcacggggagcggcggaggaggaaaaaaaggagaagggacggtggggattctcaccgaggacggcgacggcgagacgaccacagggaggcggctttggcggcggaaaagaagaaattttgggggggggaacgcggcggcggcgttttaggggcagggaggggaaacggagtaggggccggggtgcggcgaggaacggcgatgccgatggcggtggtagcgcagcgcggcagcgacgggagcggtggtggcgcgcgactggaggtgacgaaaggcggctgtggctcggtgcacggtgggaatggtgctgcgggggtggaaggggaggacggagtggatgccggggtgcggcacgacgcggcgaagccgttggaggcaaaagcacggccgggcgaggcggcgctcgccggcggggagcggatggaggcggctaaaggcgaaggtggctcggggtggcggtggaagcggcgttgcggcggtggattggcgaagaggagcggtggacggggtgcgcacggcgactgcggtgccggggagggcgacggcgcagtgcggggcggacgggagcggcggcgcggcgctgctggagttcgccggagagcggcggtgcgtgggctcggcgcggggagagcgagggagggcgcggcggcttggggaaaatggggaaaatggatgaggggagcacggcgatgcctttttatgggctcgggaaggcgggatcgaggccggacgtggcggaatcgcccggcgaagtggggcgccgacgtggggtggtggagggtttaaccggcgccgattttcgcggtgagagtgggggaaatggtggaggacgtgtaggggatcgcgcccacgtcgttggatgcgagctcgggtgcgggagggcgccctattttgc

SEQ ID NO: 35213 - DNA, 3813 bp, Oryza sativa
aagggggaaattttatttgttttctttttattttatttgatgcaatgatctttgtgttattgaaactatttctcgagctccgaaaattcacggaaaattccggagagtacattagggcacaaagaatattacaaaatattcccggccaatgatttttaagggaaaaattttaattctcccattatttcacttgattaaattgctttaacttttatttaatttccagaaaatgtattattaaatgatttttaatcccgaacgaaaatcggggcgttacagtccgcttgcgctcgaaggcagagccgctgacggcagccgtcagctcgccgcccccaccttgacccagcgccagctcgccccgcgccagccggcgctgctcctcccgctcccgcggttcaatttccgccgcacgatccaccgccttcgccgcccaatgcatccacgtcgtcgccgctttcgcatcgcccacgaaaacgccgctgtcgccagccgagcgcctcttcgcctataaaatcccaaccccacgcccacaatcctttcccccttcgccccgtgctccttggaacgaagtactacccccgcctccttcgtcgccacggccaagaacgccgcaccgacaccaagccgttccaccccgtgtcccctccttcctcggagcgcccgcctcggcgtcgcgttcgccaccgtgcgccgccgctcggccaagcgccgccaacggagtccctcgcgcccctccttgctttcccggccgcgccatctccgcgccgtgccgcccagccgtcgcgtctgcctcgccgcgactccatccgccccgccgttcccgctcgtgggtgagctccccgcccaaatcctctcgtctatatcctctagcgactcctaaacagcactggggcatggtagtttgtgcgttcgtcctccaaatcgcgcccttgccgatgctttgcttccgccgccgcccgcgcgccgccggtcggtcccgcgccgaatcccctcgccgccacccaccttgagctccaatgaaccaccccaaaccgccaattccgccgccggcctcctcttttgctcccgcgccatgccacccatcccgccgtcgcacggcctccgtcgcgcctcctctcccacatccgagccggtggatggaacctccgtgaccccctctcgcttccggtgcccgccgcccactccggtttgccaccgttcgccggattccgccgcgcgccgtcagccgtccgatgcgccgccagcctcctctccctccccatccgacgtggcagccacatcggcttgaccaagtcaagctgaccggtcgcgcctgccccgtcagcgcccagtcagccaccccctcctctctctcccgtgcttgtgggcttggcccatcggccaccctcctcctcggcctgataagagaaaggaagtccattataactccctccccaaacacagtgaccaaaagtctatatctgctccctcccaattcacctctctctcgccatatgttggcccccacatgtcaatgagtgataaaagaatattcttgagaatgttcttttccagaaaattcaataaatcctttttcccttgttccctaaatcaattctttattctagaattgcaataaatcatttctcatattccggaaaatccaattaaacttcgaaaatccatatcttttgaaccgctcatccgatttacttcgttcaacttccagtaatttcgtaaaattgagatctattcaatggcactattatttagtctaaatagggtctttttcttggtcttttgtttaggtttttgtttgtttgcgtatagttgcggttaccagattttcgtcgatcgcgggttttctcgaagattcgtgaagctccgtgaagaccttgagcaaggcaagtctccctttgaccaattgctcctataattggaaaatcattattattttgtttgtaacttgcattattagaatcacacacttaatttgcttggcctcggtttgcgtgccaaaccgacggacctacctagtagttgcactaattcctgtaggttgtactatccagattccttgtcgctccacctttgcggtacttcagtatccatgctctctgagcgcgtataccaaatatcccacatacaccgttgattgtcgaaaaattgtgaatgggtttgagaagccttgaaaacccgacatgtggtgtcggtgtgtttaaaaataaaatgaattgtgaaaactcgcgatgcgggggttgtgcctgcgtggcactgttccgtattcacatataaggaccgattcctgtgggaaattcatcaagcataacaaagtgcaaccacaaggtggaatgggacaccctagctaagtaactagtcggttcagggaaacctcgcatgccaatagttggggaacgccgaggcggggtcggttggagccaacccgggttcctggtaaggcaagaacgcgaagcttgccagattaccgatcgaggtggttggagtttgatttgcgaaaactgaaatggcctatatttatgtgaaggattttatccttctatgtggcatgaggtaaccctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttctcgttgcgtagatttgtttgcctgtgctttgtgaaaagttattgtggattgggaatcgtaaccagaatcagcctatgtggcagatggatgactcgagtggtcggaaacgaatctgtgtgattcgggatgtctacgggcatcatagactaggcctcccgagtggaagcggattgttgtgctgctaggcagctggactctgggagtctgagaaaatgaaaaaggctctgggagccgcttaatcaagtgaaatggttctgggagccgagaagtaatgatctgacctgggaggtcggtacattaccaattgagctgttgaaaagcatctcttaagttgaatcgagacgcaagtctctttttgacccaaacctaaaaagaaattaatcacctagcgatttcaaaatgatttcaaacaaaggatttgcaaaacaaccttgcctctcttccaagcttacattaaacacctaaattcccgtgacttgctgagtacggaagtactcacccttgctctatataaatatttatagttcctccgccttgaagagaagatgatgtgaagtgaagaatagggtttcgtcctggttcccagccgtcgcctgtggtgttgggtgttagtccgttggttccgctgctgctgctgttgttggtgtttcctcgtctgtgtcgtcggttgcatttctcaggctgttttgagctgcaacctaagttaaggtaaataagtcctctatttattttaaggattgcaatgattcatatttgtcaccgtgggtaccagtactatgtcctgggactggtactgtgatcgcggtttcgtaggaagcggttcgcgccgtttttcctacgacacgctcctgtcaggtgccgttgtacggcggtaccggattggggtgtgacaatacgacaggtcccccaacttacgaaaccgtttaaataaggtccctcggcagtattgtgtccggttttagctaaggtggcgcatacgtggctcattttgactaggtctttgtccgacgtgtcattaacatggcgcttacgtggcaattagattcgcaaaaaataataaaacccgtgggacccacatatcagttgcacacacaaataata

SEQ ID NO: 35214 - DNA, 35318 bp, Oryza sativa
tgggcacaatactgctgagggaccttatttaaacggcttcgtaagttggagaacctgtcgtacccggttttgcgatgaagggatgaaaattggattgggcgataaatagagggacccaaagtgaacttattccttcaaactaaggcccgaccgcccgattcaagtggaatttggagagtcttttacccctatgccattaagaaagttggaggttacgcgtgtgccacgaaaaagttttgagtcacctgtatgccatgacgcaaactttcgtttacccgcgtgccattccatccaccttctgttagagaatgagctctgacatgtgggacccacgtatgaaaatgactaaattgcccctgaagcattttcatctctactactcctctcccgtgccctagcctagccgccgtcgccggcacgccgccactgccacctcgcctcgccggcacgccgtccccgccgcctcgcctcgtctatccggcgacgcgcctcgtctatctgccgccgccgcctcgcctcgtttatccgtcgccgcctctctagtcgcctcgcctcgctggcacgccgccgccgccgccggtcgtcgccgtcgctgttggtcgtcgcctcgccggcacgccgcctcgcctcgtctatccggcggcgcgcctctagccgccgctgccggtcgtcgccgccgccggcacgccgtcgccggcatgccgccgccgccggtcgtcggcgccaataacgttgtctttcggcgctaatggcggcccttgccggcgtgccattaatgctgattccatccattagcaagggtaaaatagatctttgaaacctccgtttgtctccgttagtgctgattccatccaaagtggcgcataggcaaaagaaagtttgtctcatgccaggtaactcaaaagtttttttttggaacacacgtaatctccaactttcttaatggcgtagggtgactagaatttggaaccaatgtcccagcagacattgaattggggattttggggcatctaggggtctcggcgccgtcgccgccgccgccgcttctagctcttcttctccgtgacgggcgcacatcgcagcagggtagcgggcgcaatggttggccttaaccggcgagggcgctaggtttgccgtccaggtgtcccgtccgacgagctccacacaggtcagccgaggccgagcggcaagtcacgcgcgcggcagcatcgctcttccctgccttgatcggtaggttcctgatctcagattagttcgtttagtaggtggattaacgaacccatgatgtcgatttgtagccagatttttctttcttcaccattttgatgtcttgtttgatttaatccccatctgctcacctgcttgatctgctcttgccgcggtgaatccttttcccgcggttgcaggctgacgacttcctctcctccaccccacccccgatggaggagaacctccccagcaggcggccagcatcaccgacgagctcatcgtcgagatcctccgccgcctccccgtccgctccgtgtgccgcttcaagtgcgtcagcaagtcatggcgcaaactcatcgccgaccacgagcaccgcaagaagctgccgcagacgctatcgggcttcttctacaagagcatcgactacgagcgctgcccgcacatggcgcgccatttcaccaacgccactgggagaggcatgcctctcgtctgcccgaccttctccttcctgccccagtgccaccacgtcgtcatcttggatagctgcaatggcctcctcctctgccgctgccacgtgtctcgtgagactttgcagttccagtatgctgtgtgcaatcctgcgaccggggaatgtgtgatgttgccggacgccaactgggctattgacgagaaccgcaccgcctgcttgtgtttcgatccagccatctcgtcgcatttccatgtgctcgagtatgtggaggatgaagagtatgtggaggatgaagatgaatacgacgcactggtcacaggggtggtgatctattcgtctaaaactgggttatggagtctccatgtaaatggatgggatgatgaagttatggttagccttccggtcgatcggacaagggttttccttaatggttttctgcattctgtcacgacttgcgatattgtggctgttgacatggaggggaagaaatggaggaagattcccatgccggatcctgatggtgatattgggataattcatcaaactcagggtcgcttgtgtgcttttaatgttgatccaaatgatatcctcgaactgtcaatttggtttcttgaagactatgatacagataattggatcttaaagcacaccgttagctcaattaatctgtttggacgaaagaaataccaattagattttgactaccaagtaattgcagttcatccagaatgcaatttgatcttctttgtttatggatggcacaatactttgatggcgtatgaaatggatcgcaaggaagtccgtgtcatacgcaaactcggacatgagtcatgcctgccatacctaccatatgttccaatgttctctgagtcattacctgatgggtggtgctaacatgcagaggtgcggctccacttatgttattgcaaaaccatctttgtaccgtaatgagaatcaggcttagggtcagcagccaatctctaatatgaattatgaatttctgttttatcgtacttgtgtgatggctcatttgtgttgttttgaagaatgttgtgaaatcatagatggcacgtaacttggcctttcggaaggtatgtcctgttctgaaggttatgtcttgtttttcactggtgtttaccctatgccctatgctagttaaaatttatgtcctgtgttaacaagacataccttttgattgtaccagcagtcagcttatggaacagtgacaaatgctttggaagttggatcatatgtacttcttttatttctgccttcttttccccttttgttctttctgaactacttgtctgtgttgcggcaatgtgcccatgcagcttattgtctcctggatcatttccactcgtttttgtttggtcatctataatgctcattaatttgggcattgcttcccctgcccttacttgctggagaagaagagagtgcaaacaagagcacgtacaatggtgcaccaacaagaaactgcagaacattctagaaatgaaagataacaaagatgggtaaccaaaaagtgataaaatagttaaactattctgcactgtcttccttttatgatcacccttctgaaatttcccaattacctgctgcaaaccatgataaaaactagtattatgttcttcttaagttccaacaagtatcaatcacttcaattgtctccattctaaattacttccactttgaattcctctaagttacaacatgtttaaatcaacaatggcataaattttgttctaattctcttcaattatctctgttctaaattactgtcaaagtgaccaagcctcccaataattattgtggtgttgagagttgagacctggtagttacatccgattctccacttcctttcagacccgctgcgagaaagagcaatggataattggatattttcttttggccacatgaaagggcgtattaaaccatatttgggcatcccctgcaaagaaagctatgcaaatctagcattagttttcagttgtcaccgttttcccaaactatttctgtgttgtagagtagtcgcaaataaattgttctctgtaattgaatttagtatgatattttctccaaacttcccgtttgctgtcaatgtccaaactattatgactttgatcccttgcagtagaaaataagataacgatgttctcttttgaaaataaaactcccagcaacagcgatgttttgaagcctttcaagtttcaacacattatacatgtcatggtaaggtcaaagatcagctagtgtggtgtggtggggccaatagaacacgtcatcggacaattaacctaataatgcgacaccatcatctgcatccttcccagttcgcagtgctcgccggcattcacacttaggggttcagatggttggctggttgctcctccttcaaatttctatcgttccaacgacaaaaatgcagttgcaaaacctgcaattcattgcatttgcacttgcacaccgtgatgtttatctgcaatactcgtcacgatgatctgcagatgaggctgaggctcatcgaaggaggacaccggcggcgttgagcacttgatgatggctgatgccagctctaactgtttgcagataaccaggacgcatgtaacgtcatgctaggaacaacagaaaacttaattgcgtccaggaacattcgacgacatggtcatagtaaatactgttagtattcagtgcacaccatgtggtacagatgtatatcatgtagtactacctagttctgcagtaacatagaatcttccattgctgccaatctatgagtcaatatttagcacaacaattaggcttcagaaagaaagaacaaaaaaaacattttccagcaacagcgcagcagcctgatgatttgactaatacaacaaaacaaatcacggctacaattccatttgccaaccaccttcttaatttcaagccctttgacttgtgtgatcgcccaaagtacttaagcgagagatcgagagagcccataactacggagaaagctgagaaagaaacacgcactaatcaaacaatctcttcttcttcttcttcttcttctgttcacaagcaatcagaaaagaagaggacacgccatgtcccttctcgtcgtcttgttcttcttcttcctctcgccgccgctcgccgccgccgccgcctacacggagtactcgtgcaatggcacccggggcaacttcacggaggggagcgcgttcgggctcaacctggagctcctcgcggcggagctccccgccaacgcgtcgtcgtcgcggtcgctgttcgcgtcggcggccgtgggcgccgccgcggcgccggaggacagggtgttcggcctggcgctgtgccgcggcgacatgagggacgccgccgcgtgcgcggggtgcgtctccggcgcgttccagcgcctccgcgcgctctgcggccgggaccgcgacgcgacgtactaccacgacctgtgcgtggtgcgctactccggcgacgacttcctgtcgcggccggacgacaactcgccggtgatcaacgcgctggacgcgaacgcgtccacctactacgggtgggacgggcggaacgcgacgacgcggagcttcttcctgtcgctggtggggacgctgttcggggagatggccatgtacgggtcgtacaactcgtcggcgcggcggtacgcgagcgccgtgatgtatgtgaacccgcagctgccgacggtgtacgggctggcgcagtgcacgccggacctgtcgccggcgcagtgctggcactgcttccaggggctccaggagcagaaccggcagtggtacgacggccggcagggcggccggatcctcggcgtccggtgcaacttccggtacgagagctaccagttctacgccggcacgccggacgtcaggatcggcctgcaagacgtcgcaccctcaccaaccgcaaacaatggtaacaaccaacacatatgctacacacacgatcatttcttctcctccgaataaatttgctcaaaagctatagttggagcttaactactattgttgtacgttgttataaatgttaaacttttgaccatattgattgtgttttttttttggaattattggagcttagattgaaggaagggtccatatcaattaaaacttgctagtagtaattattaattttgaatttgggggttacgtttatatactattaataagagatttcatgattgtccagcttatatgcatggtattaattttaatgtcatctttttatttaactcaaattctgaatacaatctatggcatgataatataatccacctaatcaacaaccagatctttcattttaacatgagagatctcatagtgcttaattagtataaggtgtaaacagatagatttgttacataggggctgttcagattatatcattttcaatcataatatttttttcggtaaagttacttaaaaaatgcctatatttagttgttgccaaacattggtaaatatataaaaaatcctgctaaaattttagtaatattgtcaacttgccaaaaatatcaaattttggtaaaatttattttgactacgatctgaacgccccataaatttgtttgaattggcaaagacaaatcatattattattactattactgtcatgtttggttgtgagctcacaatggtcaaatacgtaaccacttaatggtggtgttttctgtcagtgcattatcttttctacaaataacattgaaacaatctctgtatgatcactactaattttcttctttatttatgcaggaaccaaccacaggaagaccttagttatcgttctatccgtgtcaatcacggtcttctgtttcatgctggtcggctgcctcctactgataaaaaaactacggaaaggagacggtaacaacacgatgccactaactccctctcataatgaacatcattttctccctccatttcagcatcacaaagttcttaattaatcaaccaaaccacaaatgtccaatccatcattgatcacagggaggaagtcgaatcggcagctggaagcacattccaggaacagctccaagacagaggaggcactgaagctgtggaggaccgaggagagcagcaccgatttcacgctctacgacttcggcgatcttgccgctgccacggacaacttctctgaagatcacaggctcggcacaggcggatttggacctgtctacagggcaagttatctgaaactcctataatttttgtttttacagtcgatttttgaccaaaatgtgtgaatggttgtcgctatatatgctaataatctgcggcatcatagttgctgtccctattgtttagcagtcaatgttgacgaaaatgcggatgacttggtgatgctaacatgcatgattattatttgctttgtctgttcgtgttttcagggtgagttgtctgatggagccgagattgcggtgaagaggctggcagcgcagtccgggcaggggctgaaggaattcaagaacgagatccagctcattgccaagctgcagcacaccaacctcgtcaggctcgttggctgctgtgttcaggaggaggagaagatgctggtctacgagtacatgcccaacagaagcctggacttcttcatcttcggtattattctctctttttgttcaatacaatcttcgtccaaaattatacttaacaatttacaatttagacatacagttgtgtagattcatatctataaatgcttatatttcggaacggatggagtagacaggggcggagctaaaattttctcaagcttaggactaaattagtgtaattttcatatgttcgtcgaatactaatatttgagatatgaaattgagtttttttatagattaaaaactttttatcattttcataactatgcgattaattaaaaacaataacacaaaagcaaatgccctgaatatataacaggtaaaaagggaaaagacaattacttttgtttgtagtccacttgatcaaacagcgtgtcaaactgctgttaaaaaaaatcaacgtgccaaaatttcaaaagactatgttaccgtcgacgttttactcatcttccgattttcctaatcctttctatctttttcaagtacggtttaggaaagaaaatgtatattgccaaatggtttccatatccaaatggtttccatatccaaatggtttcctaattaaacaagtaaaaaaaagtgaaatggattacttctgaacgactttgttaccgtcaacgttttactaatcttcgataatgttttcacgcatgtagaccaggagcaagggccattgctggactggaagaaacggctgcacataatcgagggcgtcgtgcaggggctcctctaccttcacaagcactcacgtgtacgcatcatccaccgcgatctcaaggccagcaacatactcctcgacaaggacctcaatcctaagatctccgacttcggcatggccaggatcttcggctccaacatgactgaagccaacaccaacagagtcgtcggcacctagtaagaaaaagaataatgatatatatcgtagcaatacttatcattttaattacactcctattttaaattacttagcattttaattttttttaagttcaaacattcgtaaatttaaccatcaattactaaaacattataaagtttagcatcataatatttatgtttttattcaccatgagatgtaatttttataatatataattgacatgttactaattaaactatataaacacttaaaatgactttaaataaactaaagtaacaagtaaattaaaacggagagagtactggtaatctggtattaagttttagcatgtcaactggctgggcaaattgattaatagccgtgatgttttccttcaggtgtttgtacctttatttttggaggataagatcaggtacctgcagtactgtacttactagctagtggtattgattgttgttttggtgttcacgtgtgcagtggatacatggctcctgagtacgcatcggagggcattttctcggtcaagtccgacgtgttcagcttcggcgtgctgctgctggagatcgtcagcggcaagaggaacagcggccaccagcactacggcgaattcgtcaacctcctcggatacgtacgtttttacgttgttttttctatcttaatttctttttctctctcgctgaaataatggcgtgttactattctagtacgacctttttgtgtgtgtgttcttaatcaaaaccgtacttgtcgtccgtggattaataaatgggcacgcggcttatcctgtacaattatcaattatgtcgaaacgttttcacgtctacactgtagctacgtttgacttacgctagctagcaacatgattagtcatcactaacgaggattaataaattggttgatcaacttggcatctttttcaataactttatcgtgctctctactgttacaattatattccgattatatatattatcatcagctgattcttctataatataatctgagctattaatttatgaattccaatactaataattaaaagatgtactataaataaatactactatctattagaatataaaagatttatatatttcaaacatagagtttttttaaaaaatatattattattttttgtcaggcgtggcagctgtggagagaagagagagggtgcgagctgatcgacccgacgctgggcgagtgcagcggcagcgaggcggcggccataatccggtgcgtgaaggtggcgttgctgtgcgtgcaggacaacgcgacggaccggccgacgatgacggacgtggcggcgatgctcggcagcgacggcgtccccctgccggacccgctgccgccgccgcactaccagctgagggtctccggcgacgactacgacgacggcggccgcgggtcgccggccggcggcggcttccggccgtcgcggtggcgcttcaccgactcgtgcagcaccaacgacgtcaccatcaccaccatcgaggaagggagataatagcggtcgatcgatctcaccggcatttcgatcattacgtttacgcgttcgctggctggccttcacatgtggccaacgcgtccttttcgtgagacatctgtgagtgagtgtactccacttgtggtcgatcgaagtcgaagataggcagggcgcaacagtggtggttggcatggttgcatcaccgtatggatgttacgtcgttgtacagagacaactcgtatatggggatgagtacctgagcggctgagccaacaaagagggtgttttttttttttcttttgtacaacttttgtgtgaagagtgtacgactaaagctggtacgtacagtgtttgttgatggatgaaaagaaagtacaaggatggttggatgcaaattggggtttggggtgtcgattgcatggttggtttccttttgccacgaacacccccatgttaggtgtggcgtgcggccgactattaattcaagccgtgttaatgcgaagcgaaacttgatgatggttgacgatttattcgcggggggagcacgtgtgagcttggtagttgtcgtcagcagaaaataatgcagtacagtacagactgatggaaatcgacggattttcccctttgtaaaaatgggacaatgtgtgtttccctttcaaaataatacacaaggtcatcccaccaccacctctcatctgcagcagcagcagtaataataataataataatttttttggcatggttaccaataaatatatgataacataacatggtcccagaaaattaggactacaaatttctttatattttaatccatactaatgctttctaatatatttaaagaccactcgttacatttttaaaaagttttgctcttcctactttactaagttggctaaaatgcgtttattttcttcagcttctttaaagtgttggatggtaatcatagccacctcaaagaactgtgctcgtgcccacaatgtgaacatgctcacgacacaattctatttagtgaaaaatatgagtctagctaagtctatttgtcacttcggtacgatccgtttatagacatcatctcaacagataagtcctttccacaaaatatgtcctaaacaaccatttgaaagatggtatgaatttcaacaattaaatctcaacctggcaatctagatttgttatttgcggtatataaactataagagtggtttcgtagtccttacaagggtacctatagttatcatattttctatatctaaaatttatttagtgtatctcggtaccttatttattaaaagctccaaaatttacatgaaattattttggtacaataaaattgctcaaagtggtctaaaccctaactctccttggttcttttgtctcgccctgctgctgctgccccctcacatttcttctccaatgcggacagtgggtggatcttgtacttgcctattgacaattctgcatcccaacagttccgtacttccgtagtctcggctttttagatcaaagatcgatcaccgaagtctcatagcaagtttgataatatagcccactactaactccaaatcatctatagccaatgtaatagctaattcttacagtacatagttgcttactatactattaatatctggtcctacttgtcatacacacattacgtcttataatccgtgctgcagctggctacagatctgtagtccgctgttcttctctctcttcctttatctttttaaaatatatttatagctggcttatagcctgctattatacctgctctcgatcagctaacaaattgtgttgcctcgggccaagagaattcgctggccacatggcccataggccatagtcatctgccgccatcggcttgcgcccttgcgtaagccttctgggccgaacatggccgatcacccaagctaactcgtatgggtcatcatttggaggtggcacacatcgcctccttttccctcatcaattgccgcgacgctccttctcccagccaaggtgaacggatcctcttcctcctcggccacctcgccggcgtccggcgagagacccaacaagatcgccgcctccgtctcgatcctgcgaccggtggcgtcccgatcgcaggagaggccctgccagtctgctctctgctgccataggtggtggagatgtggatcagtatatgtaagttcagttcaggtatgtatgtttcatctggtaattaatttggtttattcccaacaaatttgctaccaatttcactacaaatagtgtacaatatgtcgagttgtttacatcttatagacctgcatgtaacgtagacgaatcaggtctctcctttataacaaccagagatcactactccgtactgttttatcaacttggttagacgcttgttgactgatatgcgtattccaattgatatgatacagggcgttacacttgtgtgtttctaagtcgactgatcgctcacaaagaaagggcacattcttattgatgtatattttattttccatgggagatgtagccactttttccttctaagaagaatgtttaagggcctgtttagatccatttggaatggtaaatggcaaatggtaaaagttttggtggcaaaagttttgtcattgcaaaagtactagttggtgtttagatgcatgctaaagttttgccattctagcactaaagtgagagagagaaagagagagggagtggtcccaaagcactttttggcacaatttgctactatggactagcaaatgctaaatgccaaattgccaacttttgctactagtgtttagatccaaaatgacaaaaagtgctacaaaatggcaaaacttttgccattttggaggatctaaacagggcacatcttttcccatgtttgtcaggtggagatatataaattagagatcagacaatgaagggcctatttagatccatttggaatggcaaatggtaaatggcaaaagttttggtattgcaaaagtactagttggtgtttagatgcatcctaaacttttgccattctagtactaaagtgagagagagagaaagagagagggagtagtcctaaagcactttttggcacaatttgctactatggactagcaaatgctaaatgccaaattgctaagttttactactagtgtttaggtccaaaatgacaaaaagtgcttcaaaatggcaaaacttttgtcattttgaaggatctaaacagggccgaagtcacaacatacccctgatcgtggtcgcatgcattaaggcatccatgcatgtatgttatttcattatattgatatctctaatttcatcttttattgcattctagtgcatgaagtcgcgcatgcgtgtgactatcactatcttttctgattagtgtttaagaataatctattactgatattatgtcactgaagaatttgttgtgaaaatatataaaatatatgtttgttttaagatagaaatatatgtttttatcatttctctcaaccatacaaacattttttctttatttcttatgcgtctcttcgttgctctatatccctctcccacatatggagacatggaaagctctataacaccctcttttatccaatggctgaaatttattctcttgttttgtttgcttgttgatctaacggttattatttattagatgatatggctcattcttcttatgttttgggattctcttttcaagagttaagatatatgtgtccatccatccatctatctatctatacagacatatactaattagattagttacttctaagaagctactacttttattagaaagatctaaccattaatttgttagatcctattgtcgtgaacgtagatcatgtgtgtagagtccaaatgaaataaatcatgcaactagaaatagaatggtgattctatttaaaataacttattttataaatattatctgtcaaactaggatcttgatgactatatgaaaattcaaaaacactatattttaaaatagagagggtaagttgtaactgatgtgaactcttattttaatatgaacagccttgaaagtaaacaacacgtttaaaatactactaaaatattaatatctagcaatagcatgtgcaacccaaaggttacgaatctttgtctataggaatagtatatgtggagtatatatgcacatgttcatcattgcaaagatcaaaagtgatcgagttaataactaatataatgcattgtgaaagctctttagttggcagctgctgactagtcaatggacaatggaggtttgtagtcaacggtcaaagtcaacactaaccccgcttatctatgtatacctactgaactggagcagcctgtactactactccggctgaattatctcttctccggcgatgactctcgccgcgatcctcctcctcgtcctcgccctggtcgcgccgccgcttgccgccgccgccgtcctcgacgacggcggcggcggccaccgcccgccgttccacatgtgcgggatggtgcagggtcggttcgctcccaacagctcgtacgaggccaacctgcggcgtgtcgccgccacgctgccagccatggtggcgaacggatcctcctcctcctcctccggcgtcgatgtcctcgtcggcgagcggcccgaccagatctccacgtcggccttctgcggcgccaactcgtcggcggcgccggagtactccgactgcggcgcctgtgtcgaaacatgatttcggcaataataaaagggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctgaaaaataaagtcaggtgcatcgaatagatgcacctaataggtgtagccccccgacaatgtggttaattgaacaaaccaagcatatagtcaaggaataaataatccaaccaaccaagtggttttgataatcgtaatcaaccaagtgacttgatatcaatatatagtatatgcggtgtgaatcctccaaataacatgatccgagtgatataccaaaatagctataaaaaagctcgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaatgaccataatatataatcagcctaagccataatattggtcaataaaaatgcacacttacgtggcaaaaagcaatgatattatatccaatcaattgcttgataaacccaaacagcaccttgactatataaaaaagtcagcggggcagctatgtaaagctttactgtttgacacattttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagatcaagcgtagctcatatgaatagcttctgatctaaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtttattggcaatagctgacgcagtcggcatggagatgaaatgaccaacatgaagacgaaattgctcatcaaaagtaacggaagatgtcattggtagtaaaaaacagtgacaccaatcaaagataatgaagttgcacagccgtggaggcgaagaaaccaatcggcagcagacaagtcagccaacagtgaagatgaaggcatccagcaacatcgacaaaattgagcggccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaaggcaaccgtcagtagcaacagagatgatcgactatgatgacgaaattgctcatcaaacagtagtagagtgggcaatgttgaagaggcttgacagtatgttgatgaagatgacgatgttggtgatccagccaatagcagtgtagcaaccaatgataatgacaaagacgctcatcagcatttgcatagtaggtcaaccatgaaggtgaaataataagtcggcgaaaacataatcatccattagcaacagcggagatgtcagggccgatgaagcagaggtgctggtgatgatgtcagtgacaataatccatcaaattaatgttatagctgttgtagatgcttcacttggaggagagttggtgttgttgtccaactcgtccaaaccgaaatatttgaagttgttgaagtagaatgtctgctccgaagcaaagatgaagataatgactcctggagttgactcgttggttgatgaattgatttcttcagcttgacataaaatttgtcaaattttgagccttatatttgtgtagcccctgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcacaagtcggcggcggcataatcagtcggcgacggaagatgatgatgtccatcagtagtggtagctgtataaaccagacgtagaggtaagggcactaatcagcaacagacgagacgaccggcgattaagatgtagatgcccaacaacggcggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtcggtgaagacgtagacgcccaacaacggtggcataataggccagccgtgcaggcggaaacaccagtcggcggcggcggaggcaggccggtcggtaaagacgtagacgcccaacaacggtggcataataggccagccgtgcaggcggaaacaccagtcggcggcggcgaaggcaagccggtcggtgaagacgtagacgtccaacaacggcggcataataggccagctgtgcaggcggaaacaccagtcggcggcggcgaaggcaagccggtcggtgaagacgtagacgcccaacaacggcggcataataggccagccgtgcaggcggaaacaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgatggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtctatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaaggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagcctgcgtcgccaaggcgctccggtacgcgcggcggctgtgcgggtatagcaggcgcgccatggtcgacctcggcgcctgccgcgtcagctaccacgacgtcggacgcgtggagctggagatacaagcttcattagccgttcgcatcttcgacgagcgtgagtgatctgctactgctagctcgatagatataattatactgtgattttgttcgccttaattcagtactgattccagaatttcagatagactttgcttcatccgaatcaacattttagtcgttttcttttccagatacttcatcttggtggagaattgttttgacccatgatttccctatgatggtggtgttccaagtgatcggagtcgcctgggttctgttcatgttcctccaggaatggcgagacggtagaaggagaagagcccaggccaatcggctgccataggtgggaggttcagttcaggtatgtttcatctggttttgtttattcccaacaagaattcgaaaagttcgttataatatcatagaatgtttcaacttggttgaaatgcaaatataatgtagacaagttaaccagagttctttgagatcttggtcggattcttgactgatatccatattccatttgatacagggtttcaacttctgtttgtaattcgaccgatcggctgatcctgaacaagcaaatccatttgcggcaaaagaaaagggcccatatatttccatacaagattgtacattcagaaattgatagggactgtttccttgttcctccgatttatcaaatggaaaaggcgatatactgatactccgtataatgttggagactggagagtgcggactgataaatatgcagatacagaaatcaatgtagggctgtaggcatcacttgcgatgtcaccttgttattgtttattatagaaaaagtccaatatgactccctcaactgtaggttggatctgatctttattcctcaaccgtaaaaccaggtataacgactccttcaattgcttagactgtgttcgaaccctcactccctggcacagaaaacggatgagcgattagcacgtgattaattaactatttgcttttttaaaaaaaatggattaatatgattttttgaagcaactttcgtatagaatttttttttgcaaaaaacgcaccgtttagtagtttgaaaaccatgcgtgcggaaaatgagggaggaaagttgggaaccggaggtaaagaacgcagccttaaaccagaataatttaactcccagggtagtttgagagcgattttggctaaggtggctcattgaccctggtcaactggctgactcagcatgtggggttcatatgccaacgcatcatcttcctctctatctctccccacccactcaagctcgtcggcgtctgacgcaaataggcgaggctttcccatgccgctacccgatctcaccgtcgccctgcgtggtggagggcaaagggcggggatcccctttcgcctacctccgcttcgatggcatgttgctcaggcaagagcgcgagtatgacgacgccgtcgaacaagtagactctgccatgccgatgacgtagcagcggaggaatgagctcgagatggaatagtttggcgcaggagactagaggtctatgacagtttagggcttgacatcagttgaaggagctctgatacccaactagcctcctagagcagatccaacacaaaattctccacgtacgccggtgtctactccttgtcacaatgttgtcattggcctcacttgatccccctcatgatcaagcagatatggaaggcggcttggaaaaagaatatggatagagagaggtagtccacactgttgcgtcccaagcgaaggactacaccgaccatgggtcctgccattcattcaacttcctgtcacaacgcctccctcaccttgcatggccacaatcactatgttgacctcaccaaatgctacagggcatggaggacgccatcaaccaaggtgccacccctattgtcacaccccaatccggcaccgccgtacaatgccgcctgacaggagcgtgtcgtaggaataacggcgcgaaccgcttcctacgaaaccgcgatctcagtaccagtaccaggacatagtgctggtacccacggtgacaaatatgaatcattgcaaatccttaaaataaatagaggacttatttaccttaacttaggttgcagctcaggacagcctgagaatacaaccgaagacacagacgaggaaacaccagcaacagcagcagcagcggaaccaatggtctaacacccaacaccacaggcgacggctaggaaccaggacgaaaccctattcttcaattcacttcatcttcagcttcaggacggaggaactatatatatttatatagagcaagggtgagtactttcgtactcagcaagtcacgggaacttaggtgtttaatgcaagcttggaagagaggcaaggttgttttgcaaatcctttgtttaaaatcatttttgaaatcactaagtgatttatttctttttaagtttgggtcgaaaaggagacttgcgtctcgattcgacttaagagatgcttttcaacaactcaaatggtaatgtaccgaccccccgagtcagatcattacttatcggctcccagagccatttcacttgattaatcagctcccagagcctttttcattttctcggactcccagagtctagctgcccagcagcacaacaatccgcttccactcaggaagcctagtctatgatgcccgcagacatcccgaatcacacagattcgtttccgaccactcaggtcatccatctgccattcaggctgattctggtaacgattcccacaccacaacaacttttcacaaagcacaggcaatcaaatctacgcaacgggaaccacctcacatccgcccatgaccgtgggcacggctgttcgaacagttagttaacctctgcagaggggtacgctttacccacaagacacgaacttactccagacactggccggtgtcagaggctcgcgacaaagcctttcccaagccgacccagggttacctcatgccacatagaaggatcaaatcctcacgtaagtataggccattttaagcattcacaaatcaattccaaccaccttgatcggtaagtgagcaagcttctcatccttgccttaccaggaacccggtttgtccgaccccgccccggcgttcccaactattggcatgcgaggtttccctgaaccgactagttacttagccagggtgtcccattccaccttgtggttgcactttgattatgctcgatgagtttcccacaggaatcggtctttatatgcgaatacgggacagcgccacgtaggcacggctcccgcatcgcgagttttcgcaattcattttattttcaaacacaccgacaccacatgtcgggttttcaaggcttcacaaacccatttcccaagttttcgacaatcaacggtgtatgtgggatatttggtatgcgcgctcagagagcacggataccgaagtaccacaagggtggagcaacaaggaatcagggtagtacaacctacaggaattagtgcgactactgggtaggtccgtcggtttggcatgcaaaccgaggccaagcaagttaaacgtgagtgattctaatgaagcaagttgcaaacaaaataataatgactttccaattataggagcaattgatcaaagggtgacttgccttgctcaaagtcttcacgaagcttcacgaatcttcgagaaaacccgcggttgacggaaatccggtaaccacaactatacgcaaacaattgaaaacctagacaaaagaccaagaaaaagaccctatttagactaaataatagtgccattaaatagatctcaattttacggaattactggaagtggaacggggtcaatcggatgagcggttgggaatatatggattttcgaagtttattggatttactaatcaaaggaaaaaggacttaataatttattaaaccctttttggaaagaaattgaaggagggatgtgatttagactccctcgggcggcttgggcgcggcccgagaggagaggcgcggctcggccgaactaatgggccggccggcccggagaggcggcccaaggggcgcggggagagtgagggagagagagggccggtgggccgagtccaccttgtggggtcccgagtggggcccgcttgtcggtggcgcggctcaccgtgggagcggtgcatgcggcgcgcgctagtgttcggataggagtggcgcgcagtttggtgcaccgggtggaccgaagggtggcgggcccacgcgcagccgttaggctctccatgcaccgagcgcacgcgagcggggacgaggctggcgggttgacttggtctagccgacgtggcgcctacgtggcggtcgcgtcggatggcgagaggaggaagacgaaggccggccgagatggacggcggacggcggcgcgcgtcggcggggcggtgcgaggcacggcgggaggagggaataccaccggagcgacgagcggatcgaggaggagtgagcctacgggacggattagaaggggaagggccgacgacgacgaatcacggcagaggtcaccgccggtgagggaaagaggaaaactcgccgggagaggagagggatcgattcacggtggtgagagcatatccggggttcaaggaatccttttctggcaccggatgggacggaggagcaccgaggagagccggcgacgagcggcggcctccgggagcggacggcaatggcggcgaggccatgccgggcggcggcggggctcggggcagcgtccacgcgcgtttgggaaggtctaggctagcaaatgcgcaagctaggggggagaggaagagtagggagggagaacgggggctaccgcgtcgggagatcgccgggaagagcgtccgacagcacaggcgggatcacctcggtctcgggccggggaaggggagggagagagggcgaccagagtcctctttggctccgcgcgcacgccgtcttcccggcacacgcgacggcggaggaaggcgaggatggcggcagcaaggcggcgatggcactgcagcggtggagactgaagcgggagggattgagaggagggactcggctttatagtggaggcgaggtcggttcgcgcgggaggtcggttcaaaccgaccttggggcggtcaaggcgacaactggcggtcgtgctcggagctagcggccaatcggcggcagaggcggtcacgggcgtgacgctggctaaggaaaaaggtgaaaagaggagggaaacgagctttgctctcttgctattttgggaggaaggaggatgtgagaatgagagagaggagcacgagctctgtctcctggttttggaaggatgcggcatgggggcatcggagccaggcgatgacagtggcgacgtcggcaaaaggcgagcggggccgggcggctgcgcggcgcaggcgcggcagggctgacggcggcagcgaccggccggtcggccacgcgcgcgcgcgcgggaaagagcgaaggcggtggcgggtttgaacgacaaagaagcagcgcggagcgcgggcgagagagagcgagagaaaacgagagagagagatcgggggagagagaggcactttctctcaggcagggcacgtgcaacgcacgtgaggaggggagcgggctgaaaggagatgggccggggaagaagagtcggcccaccgagccagagggaggtaaaatagactttcatagagaaggctgatttggagagaattggagtttggatttggattcaaattcgatattcaaactcgagggttcagggaggaatcaaggaaggctcaagatagagtttggcatttttgggaattgggagcgagcgtttagcgaggattcaaaggatgcgactgaatttcggaatttgatttggagacttgaatcggaagaggaatttgaggtggaggattttgatttcgatgagagggaacaacgggatttgaaatgagatcttggcacgacatagactcgcacaaaaagaacgaaaattttcgcaattaggattttgccgaattagtttttaacgtctcacgaaaagcggagcgttacacctatggccctcttcactgttacctgggtgacgaccccctcctcgcgctacctgtaggtgtagcaggtgttgcctcgaggggagaaagggggagagaggagagagtgaatgaggaaggagatgagtgtagccatttacatgtgggtatcatatttcttaattttttgatgactgggttatacgtggacatcatgtcagctgaaaccatcctcacaatagttgagggagtcattttacacaatttaaatagttgaagagatcaatatacccgcttttacggttaaaagatataaatcagatccgacctatatttgagggactcaaatggactttttccagtaatctttgtggtcgtctattgtaggcggagttctatcctagcaatctgggcccagaacagcccatcagagcatatactcgtagcatatgggccgttatttcttatttggttgtggaaaagtatatctgagatctctcatcttgtcactgaattacaaaatcgtccctgacatcacatgttgggggaagagagggagatggagagggagaggggaaagggtataaagaagctaaggtttcactgacatgtgggccctacgtgggtcctacactaactcagttgccacgtcggacaaaaccagggtcaaccagagttaatattgtctaaggactcagagtgatccggttttataagttaagggatgccatatactccctccatccataaaagttacacatattacttttgacactaagaccaaggagaaattaagtcaccttagatgttacaaaatcaatgagtgaatgcaagcatgcaaccaatgagtatttagatgactccttaggttctaataaaatatttaatttatctcttcatttaagtcttgaatgtataaagactataaatagaaacaacttatttggaaaaacttaaatgtgaaataggtgtaacttttgtggatggagggagtatcttgtttttgggtttagggacaattttgtaattcggtgacaagatgagagacctcagatatacattttcccttgcttgtggaatgggttgaaagtgtcaattaggcctagagggggggtgaataggctaatttaaaaatcaattaaaaacggaagcagtaatttttggatatttccgaaattttcggatatatccgaaaatttttcggagtcagcacaaatagcaaagtaaatcctagatctagttgcctacaacaagaatatgctagcacatacagcaactagacctatagcggctcaaacaagcaaagctagtggagagggaggaagtaaagtcaccaaagttgaagctcataaggttgttcccgaagttcgaatccttgaggggattctactctccgttgaggagctcactaagagccgggtcttagctaaccctttcctcaaaaggttgcactaagcactcctccttccactaagggtatctcttccctttcggaggtaagatccgaccttcacaaacttctcccggccaaccacaagtagatcggtggctcgggagcgacacctagccgcctaggagtcctcaacctccaagagtaacaaatgaagcaaagaactcccggagatgatgcaagtgctcacaaatcttcacgaagtcaacaacaagcactcacaaaactcgaatccataactctcacacacacacctaatccaaatcgaacacgggtgagaggggaaacaagaaagcaaggctcaaaagggctagagagagagagcaagccaagggcacaaatgattgaaatggaaccagcagccctcacaagtgaggggagggggatatttatagccacagcccaaattctgcccgttatgcacaataattgagattttcggatattccgaaagattttcggacatgttcgaaaattccagctcagcaccgacagcaaagtcaacgaagtatttttcggacattccgaaaacttttcggacaagtccgaaaacaacaacatcgttctggatgttctcggaaaagtccgaaaatcactttcggacaagttcgaaaatatacagaagcgaaattgactctactgatgattttcagaaaatccaaaaatcagtttcggacaagtccgaaaatatacagaaccacttttgccttcgcagtcattttcggaaagtccgaaaatcacttttggacatatccgaaaatttccagaagcgaaaatttggttctgtgtgttttcggaaagtccgaaaatgagttttggaaaactccgaaaaaatccagaacacaccaaactgaggagaaacacttttaaaaatagattttgagcactttgatcactcctcatatgtcaatgcatcatccctcttaatagtgcgactttcctattgactcaaatgaaaagaaaagttacaatatactatttgtcctttgccacatcacatctcatcaacgtatttggcgggatatgcattatgctaattcattgaggacataacaaccctcacatttgcttaaataaaaatgttagttctctctaatcacattgtaattaatcatcaaaattattaggggcctagatgcactttcagttaacatttttcgtacttgggagacttggttggtcctgctaaaatgggggaaagctagaaggcgcgtgcacgcctctagtgcacacttccggcgtaactaactccgttagttaacgctaatgacagtaattagaaaagattgtgaagatttttttcaggagatttttttactaacagattgaaaaatttttaagttagatttgataactttcgacttaagatttaaattttagagtcaaatttttaaaactttcaactcagatttgaaaactttcaactcgaaatttgaaaactttcaactcagattcaaaaactttcaagtctagatttgaaaattttgaaaactttcaacttgagatttgaaaattttcaactcgagattcgaaaactttcaagtccaaatttgaaaattttgaaaactttcaacttgagattttaaaatttttaacttgatatttgaaaactttcaactcgagattcgaaaactttcaagtctagatttgaaaactttcaacttgagatttgaaaatttttaactcgagattaaaaactttcaactcgagattcgaaaactttcaagtccaaatttgaaaattttaagttaagatttaaaaattactagtaaaaataggaaactaatcattagtaaactaattacgattttttctcctacccgtgcggcagcgaactgcgaaaaaagaaaaaaaaaagaaatagcggtagcttgcgttaaaaaaaaaagaaaagaaacgcgcgtgtgtgggccgtgtgggccggaagtgtgcgtcggcaacgcgcgtgcgtgaattagcattctcggttaaaatgtgcgcacctatcatgccttttcaagtagctgggcctatgcgccgtggctaccggcccagccaatccaagaacggtgaaggcaaaccgagtaggaagagttctagtgagaattagcttgtgcgcttgcaggggatcgaactcaggaccttgctccctatcgcaagtttctgaaaggttatagtactagacgagttacatattagttacatagttacacccgagttattaaaatgtttgttacactgtaattacatttgaaagattttttagaaaaattctttagacatttttataggtagccatgtcttttagaataaccggatagtaatatgtaaaactgcaaccaagtattccatccattccattaaaaaccaaatctttttttattgggacggtgcgagtagtttcgttcagaaatgatgggtcctgcgtatagcctagttgctagtattttttttttaaacccgagttgggtattgtaatctgtaaaatatgttaactgcatatatgcacgttgatcatcatgaggaagatgaaaagaagatcccatcaactagttgctagtatttttcttttctttaaacccgagttgctagtattgtactaatcggtaaaatatgttaactgcatatacgcacgttgatcatcatcaggaagatgaaaagaagatcccatcaacaactagttgaaacccgatgagttgctagtattatactctctccgtattttaatgtataacgctgttgatttatttaaaataaattataattacataaatttttttaagtaagataaatggtcaaacgttgataaaaaaattcaacagtattatacattaaaatatcgagagagtaatatgtaaagtaagtatgttaactatatatacgtacgttgatcatcatcaggaagatgaaaagaagatcccatcaacacaactaacataatgtaatccattgttgatctttctggactaatcaatggtcgtaggtagtcaacggtcaatgtcaacaactagctcaaacaatccaccatggaaacgtggatataaatgtgctacaagactggagcagatcctgtacgtaccagtccaccgccaccacctcccttcagctgatcaatcacctcttcctccggcgatgcctcgcgccaccatcctcctcctcgtgctcgccctcgtcgcgccgcagctgtcagccgccgacgccgatgccctcgtcgacgacggccacaccccgccgccgttccacatgtgcgggatcctgccggggccgtacgctgccaacagcacctacgaagccaacctgcggtacctcgccgccacgctcccagccaaggtgatgaacggatcctcctcctcctccgtcgacgtcctcgccggcgagcggccgaacctgatcgccgcgtcggcctcctgcaactcgtcgtcgtcggagtaccacgactgcggcgcctgcgtcgccgaggccttccggtgcgcgcggcggctgtgcccgtacagccggcacgccgtggtccacctcggcggcggcgcgtgcagcgtcaggtactacgacgtcgagcgcacggagcatgcggaggtgctcatggtgtggtgtcctccggaggcatcaccaaggagcgtgagtgatctctactcgctctacaaaacttgtcttttggattatgaatatggccatgtttagttccattctacatcaaacatttgaacatctgcatgaagtattaaatttaggctaaaaataactaattgcatagattgcaactaatttgcgagacgaatcttttaagcctaattgctctatgatttgacaatgtggtgctacagtaaatatttgttaatgatggattaattaggcttaataaatttgtctcgctatttattgacagattctataattaatttttttattagtgcctgaacactccatacgacactatatatataatatccgatttgatacgtcgaaactttacaaccctatatataaacacctcctatatgatgcgttttatgctttgatttttggttcgcctttattttagttttcgtagattcgacttcatccgaatttcatgtccacttcttcagatacgtcattctggtggaactttaggttgcataattggtataaaaggattgcgtttcaagtaagtctccaagtgatcggagtcgcctgtgttctgttcatgttcctccgagaatggcgagacagaaaaagaggcactgccaagctgctgccgtaggtgctgctgtatgcctgtatgatgtatctgttcagttcaggtctgtttcatctggtttttattcatttcctacagaattattacgctagtagttagcataaaccatttcaacctggttaaatgcaaatgtaacgcagacaaagggaaaagtccattctacaccctcgaactcttgtgcttgtctaaaatacacccccgaactacaaaaccggatataatacaccctcgaactgtcaataccggacacttaaccccccgggctatttttaccgtggtttttgccacgtcggatgccacatcggatgccacgtcagccctagccacatcagcgcaaaacattaacatgggccaagcccatattctctccccctctctctccctccccctcccctgttcattatcttctctcacggccgttggcggcggcggcggaggcggcgcagagctgcgagggcggtggcggcgcggagctgcgaaatcgatggctacggcggcggcggctgcgtggagctgtaagggcggcggctacggcggcggcgtggagctgcgagggcagtggcggcggggagctggtgcgagggcggcagctgcggcatcggcggcgcggagctgcgaaatcgacagctacggcggcggcgtagagctgcgagggcggctgcggttgcgtggagctgcgagggtggcggctgcggtggcagcgtggaaccgcgagggcggtggcgtcggcgtcggcgtggaaccgcgagggcggtggcggcggggagctggtgtgagggcggcgacgctgcgaatcacgagcttgctgcctcgctcagaagtggccgacctcgccggagccatacgcgcggggaggagtcatccctatgcgctcgcgccgccaccgcttggtcgaggacgaggtcgagctcaagctctacatccgccgccgcctcgttgagcttgagttcctcatccccaagcagctcgagttccaccggcgagctcgaacatggagaagatggagttatggagctcctggagccggcaggagaggtagacctttgagctcgtgctcgccggcggtcggcacggaagggaaggctggggatgtgcttgagctccgtcgccgcaacgagtcccctgctccatggccaccgatctcctgctcagctccaccgctgctctctgtctgggaggaagaaggatagagaaagaaagggaagaggagatgggggaagaagtggccactaacgtgtggctctaatttttatttttagttttatttgctgagtagacttccacatcattgccacgtagatgaaaaccagctgaaaaactacctgagggtgtaaagtgaacggtattgaaagttggagggggtgaaatatctggttttaaagttttgggtgtattttagacaacataaatagttggagggtgtaaaatggacttatccccgcagacaaacgtcacaaaccatcgtaccgtttatcaactttgacggactcttgactgatgtgcatattccgtttgatacagggtatcaacttctgtttgtaagccgattgatcgctgaccagaacaaacaaattcagtttgacgcaaaagagaagggcacatttcgtacaataatatgtagatccagttttttgttgctaataagaatgtacatcaaaagaattaataggcgcattttccttcttccagtaaccagtttaccaaattactgctgattatcctcctcaagtgaaaattaaacataccatgattccgatttgccaatcatagttgacaggagattttttttcgcaaacgcacaaaaaccttgcacgttaatatattagaagaaaaacaacgtacatcggtaacacgcctaaacgattacaggggtaggcggtacagtatgaccatgtctgcaatctccgattcatggcacacctcgaagattgaccggagatttgtgatgttgactaacactcgaagtttgatgagcagaagaaaatcgcgaacttgtaataaatgttagtcgatatagcggaatgacgactaaccttctcgatcgattcagttattgatcatccaagacacacaagataacgacacatgaacacacgatatttgttaacgaggttcagccgaaacctacatccccgaggctctgattatgggcgcccatccccaaccaatataactcctagccgctacgagtccatgacctcgccgctatcccctccttacgtgtctacgttacattgtggtcgctatagttatattgtggtgcccccctctctatttaagagagatgtcgggtttcagagtccgactctaacttcaccccctaccacctattacaactccaagtccaattataatcaaataggactagtatattcgacacctattatatcagaactagtgattcaagaggagagaagaggaaggctgaagtaatggaggggtaccaagaggtggtaataggcctaatattttagcatacaaaatgtgagggttgggcaaaaagaattaggctgagatttaatagattttttatctaaaaatatttaagggctgaggtgggttgcaaaagggccaatgagcactggcccattaccacctgaggtacctg

SEQ ID NO: 35215 - DNA, 16245 bp, Oryza sativa
tggctgtgggggactggtgacgcataacggcgatctgcatgtcgaagttcgccgccgaagagtggatatagcagattaggttttggggaagagcgatgggggtgtgatgggtgagggagcatgggttttggaggagggaaccgcaaaacgatgcagcgaggtgcgggttgcgaggtatggacgagagattcagagcattggatatcaagatgaacggtcgagaatcggcgtgtgccaggattggagtcaccgccaccactaaggtttctataagtaatatctcatccatcctaaaatatactctctctgttctagttcagtagtcgttctatcaaagaaattacaaaatatggtgttgtaaaaatgactaatgtgcccctatgttaatcatttcaatgcttaaaaattgacactaaactaatactgcgtctgccattctgatatgtctgcaacaagcataaggaagaaaattaatagaagtactcatgctagctagtggctaacctgctagctgccccgggcctaaacgacatcctttctgggacaatgactctagctaccccgcagggacaactaaactgggatggagggagtaaggcacaaccattttttctctatgtttcataatataaggcgtgcatgcatgtacacattaactgtcaactcttctttctctaaattcctttattttaaatgagtaaatttcagaaaactataaccactacactggccaaggtcacctgtgacgggcccaaaccctcatctttgacggcttcgcgcatggtcaatgatcagtggtcactggtgagtccagtcacctttgacgggtggccggccgtcacaggtgacacccacctctgacgggcaagttactagaagtccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggctccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctttgatagcgggggggttgatgggtgagatcttcaagccagctctacctttctgtttaataaataagaggttaattagcacgttttgaatagcaatgtagatattgaaatgagcttattcgccattagcaacaacctcagggtcgaaatctttcacctctcttacaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatgtacgtattagaactaatttaattaggagatatagtccagtcatatcacaagtatagaaggtatgcacttacaaggagtaagcattttagaagaccagtgtccaacttccggatcctgaaaagggtcgaagaggtcatcaaagcctagagttatatatacaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaaatgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagccggaccaggtgtcctttactgtatcgatggacaccttggcatacccagctagcaggtctgcgccgtggaccttgtctgtaacagagggcttgaaagccatgccctcagcgacttcaggagcgaaagttgggtggactctcgctagtaggacacattgtgctgcgccctgcataaggtgaaagtttgaatttaatattggaatgtgtacatgtcttttattacatatggatcggataacaacaattacctcgatgtggtccactgcagctagtggtgcgatagggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcatccatgctagcttctagttcttgaatgacctcaaccttaagttcggccttcaaacgagcgtccctctcttccttggagactttccgtttcctgtattgggatctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactgttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattatgtgaccgcggatttctactagacctacttgcacttgtcccgcccgacatcgacgtatgttgttcatgcggcaattctgcagcacaaacagaaggcaatatttgctaaggggtgctagctaaaatttatgtggtcatgtggtgaaaatttatcctataaattaccatgaatttcgtgttgttggaccgccgttgtcgcgggatgaccttctgcaactgcctctgtggctgggtttgcttcttcctggaccctcgcaggtgttggggagggtgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggagaaaaaagcaacccaaagaaaatagaacaagtgtaggtaatctgttcttatccataaagaaaagagcaagtgcaggaaattagagcagtagcaacagcatggccatataatagcagcaataagagcagtagcagggccatataacatcagtacgggtatatatgccacaggggcagcaacagcagggggagattcacataaacagcaacagcagagggaaattcacatagacagcaagggtatataaatcaacaagtgtagataatctgttcttatccataaagaaaataacaggtatagatagaatgttattaagcaattcatccttggccatttaacaagaagtacaggggcaacaacagcagtggtatataaatcatgcatatattattgtagataaaaaaatgaacaagtgcagaaaatatgttcttatgcataaaaaaagagcaagtgcacaaaatctgttcttattgagcaattcatcactggccatttaataaggaacacattgggcagcagcagcaagggtatataaatcatcaaagaatgacagaaaacaaaatgacaggcaaccataggcagcagcatgggcaaacatagacagcaaggcatcaaaaaaaattatataaatcatgtatataaaaagcaattcatgcaattcacctattcatagacagcaagggtatataaatcatgtatataaacaacaattcatgcaattcacctattcatagacaacaagggtatataaatcaacaagtgtaggtaatctgtggccaatctatcaacaagggtatataaatttcaaaccctaaacctaataaagttccttcattatcaaagaatgacagaaaacaaaatgcatggagaattttggtgtctaggtcggttccgtccatggactacactgaccaatccaccaaaattccccatgcattttgtattctgtgatggtttgataacctcggattccccaaagttcatcattcgttcatccattccattgcatcattcattcatgcattaactgcaccattccattcatcggcatcagagagagaggggtacttggagaggagacgacgagcagaggaggcggcgcacggtgacgacgagtcccggccggcgcacggcgcacggcttctcggcacggcggcgcggcggcggcttcttggcacgacggcgctgaggaggagaagagggggttaatcggcgaccaatagtaaacgaggggaggcgggggccgtgggctcaccgtggaggtcccggtggcggcgatgacggtcctggcgtggcgactaagaggaggtcccggcggcggtcgagagagtgagtgaggcggcagcagtgcagagggcggtgtagagggtggagagggcggcggagatggcggcggagaggtcgaggcggcggtggagaggagggcggcggagaggtcgaggcgacggtggagatggcggtggagatggactgcggcggtggtggtgcaggccggcgtcgggaaggtcgacggagagggtgagcggcagagaggtcggcggatttggcggcggcgagggcggcggtggagaggtcgaggcggcggtggagaggagggcgtagagggtagcggagaggtcgataggggcgaggcggcggtcgagagatgagagtggagtgagagtgggtgccggatctggatcgatgtccaaccctaggtcaagcctagtcaaactcacctgtgacgggcgccaactatgtggccgtcacaggtggcctcacctgtgacgggcgccaaccgtgaggtcacctgtgacggccctacagatagagcccgtcacaggtgagtttgcctagagcaattttatttcactttcgttcgcaagtgccggatcggagcttgacttttgggttgggaacatgtagtactgtagaccactgtagcagtgtcagggcgtcaaagacactggaaaatattgaaagcggcagcctggacgccgtctatggccgacactttccgtcgccgtgccgtgcgatgccgggcaggggctggcagtggaggtactgtagcatgcgaattaatgggtgtttgctacgcgggtgaaagagatatttgctacgcggcaccaattgtgaaagaaatatttgatatgcacacacatgtgatttctttaataataattttcataatatgtgaagattcggacataaataaatggtaaaccatacaatcctgaaaattgaagtactgaacatacgacaagcattatggataacatcacctacctaatggtagttattgtacgcatcatcagcaatacagtcacgcaacatgcacatagcggcctcgctatttgttgcgtaatacatatggtcgaatgaatcgttcagcagcggcactggattgccgttgtagagagcattagtgaaccgataggtcggatctttactatccaacctaaagttgtgtagagcgaaagctgcatgaatgatgcgtgcagggatgtcgtcatctcggtaataagggatttctttcaatattttccacatcttttttgcgatgccaaattgtctttccacgatccctcgcaacgtggagtgtcgatggttgaaagtctcttcccgtcctacgggtggcggggctccctcgaccgcaagttgatccctgtggtaccgtacatgtgggtacggtgcaaggaagcccatcctggtagggaaatccggagtcgacaagtaggtacctgcctggttaacggcgcataattaaatattagtgcacatgtatagaattaaataaaatcaagacatttggcaataaaaaaaagtgtattgaccgatacaactcacctaacggtacccgtgggaaatcgtaggggtaagcctgcactgcctcattgagaatcctttggtcgtgaactgatccaggccagccagcatcacagaaaataattctcccatcatgatcacatattactagaacatttctggttgttatgtggtgacggttcctgtgttgcatagcgctagctgcattaggcagaactggaatatgtgtgccatcgacagctcccactgattggtagaaaggcttgaaaggattctcttgcagaatctgagggttgtaatctaagaagttgggatcaaccggtttcaatattttcccagcgagatcattcatagcctgcaaaacatggtggaagtgaaccgacactgtcgagttggagcggacccaccgattgttcgcgtctctgattggacgatttccacccatcgtgtacaagaaaataccaagcttttccatggaacagacccctgctgttcctacaagaccaaaagaagtgaccaatagatcatgcaaattgtgtatctcctctgcagtaagcctgaacattgccctgcattggcttcgatttgccatcgtgtccatcatccaactgataccggtttgcaccggtattctccttggtgccctctcattgaaatcaagggtagcagccatgtactcaatgatggcatcttcttcttcgctgcttgtgtgaccgcctccattccaactcgatccacccgcgccgtaactcatcgccgatttcctttaacatatgagaaccgaagaatatgcaatgtttgtcataatcaaaaggatagaaattaataatggcagtgatctatgcaatcgaagaattatttggatataaaagcaatgcaatggaatacgtagttgctcgaattggatataaagccacaaatgtttacggactcacagaatgtaaaaattgttagcacactgagttctaaacataaataatggtttatttgaaaaacatcgcccatcacaactcaaagtaaagtacagtgcacaaactaccaggtgccaccagatgactgtccagtaccaccagtgcgtataaattccaagcgcctagcggcgtccttgattcgaacaaagcatttgcaggtgaatgggtcacggaatagcgcacaagcagcataccacacacttcctccaatttcatggccatcattttccaccaactccatgcacgcatcaaggcccatagacttctctgcttccatctgagcaacacgactctggtagctctgctctcggatgtccgcaatcctctccaaagccaagtcagcggagtcgcttcgtgacttcttggaagaactccctgaggcagtagtgtttgctgctggcctctttcccttgccccggtctgctgccgttgggggtggagttggaggtggtggtctataagcagcagcgagctgcgccatgtcgatggtctgccactgaactgctccttgcggtgcctatggggctgcccctgcgacggcggagtggtttctgacaactgtgtgcccactgaataccgcgtggtgaaggtcaatgtgcttcagaggatcattcctgaagcttaagacacctttattttgctgcaacataagtagacagtaaaaataagttagtacaaggcaagtgcattaggcttgtgcaaacattgaacataatgaatatgtgcagtccaatgtgcattactactaaaatgctggcagtaaatgtgcacattggtaccaagttatcaaatataatcaggagtacatgttacaatgggccacacatctgacagaatgaaagaaagatagtttgaacattgtaaacataagataaactgcatatattatattctttgtagatgagcacatttttgttcattctctctatatacatcacaaagaaggtgtgtacagctagttgaatatgtattaacatgttcctaaatgacttgtacaagatctttcctaatttactgatacactacatatacactacatatagatctttcctaaacatcattttgttaacttaaatacaagggaatggcacacattactaaaaacgacatgacagtaacaactatgaaacatatgtgatcacaatccttccattttactgcagctagtcatttgttggcacacacaatttgaacaaaaaaattattacacctcacaaaactgtattcataattgcatgcatgtactaaatttcagataataccaattgtaggcaaaattgttggttcaaaatatttatggtcaagtgtacgtaccgcattcttgctttcccaccactcatcatcggcaacaatggctgatgtatggggatcacgacccagcccgcttgcatgcgattctagccacacccacctgttgtaccgcttcttacactgcccccaaatgtactccaattgagccttgttcaccttcttcttgcacttggtgtacatcttgtgtattaggttctgccatgcctgcggcttgggggagttggaggtgatggtgaacgctgccatctcctccaagcagctctcaagaaacacacgaacctccatatcggtccaccggctacggccatcgcccatctactccgtgcaagtcaaataaaattgaatcggaaatgaacaaattaatacaaaccaataccttacatgactcttcctcgcggacgacgtcccaatcaatcgaacggccgacggtggcagggctcactcttcgaacaaagtcgatgacggctctaggagacttggcgcaaactttgcagagggcatgcgcgatatgaagcacgtcgtcgggagcagccttggcgctgccagcgtcggaggtgacagagtcggaggagtcctcgccggactccagatcggcgccgcggacagagatctcccctgtttgaggggattgaacaatcgtcccctcctcttggatcgacaatagatcccgctctcgcttccgcttcttcgctgtcgtctccatcggaccacgcacacgctcggcctgaaatagagactcctcaactccgccagcttggatgccttgatgagactcttcaggccagcactgtctgacccgagaggcagagaggacgagcacacaggcagccagactgcttgctgcttcacagcgagcacgccggccagcttttactcccctcgaggacgacgcagacagctcgacaggcgtggagctcttccacttccccccgattttgagcaccttgaaccgaccgctgccgcaagacgacgcgcggacgagaatcgattggggggggcacgggcctgcaagccacagtcgaaaggggaggacgggagcctgcagcggaggggaagaaagagggattctccgccaggcctgcgtcgcatcgacgaccgcggaagcaacagcgagaggaggaagaaagagggatcgagagcattggatgccctgactctgacggaaaagccgaggcgcaacggcaacttctcacatccgttaacgccgttaacgtcgcctcacaagccgtccttctggtactgtgtgcgggaccacgcttccagtgcacggaacatgaaccggaccaggactcgcacaacggaacatgaacctgtgacgggcgccaactatgtggccgtcacaggtgccctcacctgtgacgggcgccaaccgtggagccgtcacaggtaataccacctgtgacgggcccaacactctgggccgtcacaggtgaggtcacctgtgacggccctacagatagagcccgtcacaggtgagtttgcctagagcaattttatttcacttagttcttttattttccttaacatattttcacatacactacatatttttttatacttaattattttatttcactaacagttgtaattgcacttcattactatactactttaattattttagttccaatgcttatacttgcttaattattttaattcacttctagtgggtgctttacttaattattttatttgactatttcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggattttgaacttcaagtaatctagctccaatatttgctcaactttaccatagtattgatcacgacgaccaccgtcactagtagcctcgatgcgtaacccactgttctgcactgtgcatttgctgtcttgctttaccgtgtgaaaggtgtatccatttatgtcatatccttgccaggtggtggcactccattcaggaccctgtgacaagcactgaagtgtttcactagacaagttctgcaacctggcaattcggttcttcagccactcgttgaaagaagacatgtgcttattcctgacccaactctctgatcggcctgggttctcatgtcggataactgcaaggtgttcgtcaacgtacggcaccacctcagtcatatgctgtagtaccgtgaaatgagctttatcgtacaccttccgatccaacctaatagtctttcttcctacagtaccaacaccgtcaagcctcccttcgtgatgagatcgtggtaatccaattgaagatgtttctgacatgtagtccacacaaaattcgatggcctcttcggtggtgtaactctcgatgatactcccctcagggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcggggtcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacaagcctactgattcttgatgagtaaccagatggaacctttataccactcaaacatgttagcaaatcaatcttctcttctttcgagagagtgtagcaggctggaggaaggtaaaccctgccgaattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtatgaggtaaattgttcccctctggcaacagatcctttaacagctcaaggagttctgtaaaactattgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtctaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaaatcgccccccttgccctcccaaccgatgtgtgagcagtacaatggtcgggatggaaagcagttggcagtttgggggtatttatagagccaacacacctcaaacgggttagataaaaaaagcccgtcaaaggtattgctcatacctttgacgggcttgtattcaacggcccgtcactggtatcatctcacctgtgacgggccagaaattaaagccgtcacaggtggcggcccatcacctctgacggcttctaatgtattggcccgtcacaggtgaggggataccagtgacgggttggattaaaaactcgtcactggtatacctctgacgggttttcctttcggcccgtcacaggtgaggggatacttgtgacgggccgcggccagatgcctcaccggtgactgcatcccgtataacccgtcaaaggtaatggtcactactgaccaattcgtttgcccgtcacaggtatcccgtcagaggtgtgaggatctggcgtagtgaactttagtgacaaaactatcagtttgctgccacattagcgacatgtttcaatttgttgcaacaatagcgtgagaaattatcacaaaactacaacttttacgttatatgctgctacaatacatatatgccgcactgttgcagcatataacgtaaaagttatagtcttgtgataattttgcacgctattgttgcagcaaactgaaatatgtcgctaatgttgtaacaaattgatagtttttccactaaagttacaattttctaaaatttactcattttaaattctttaccatcaaaattcaaaccgctcaatcatattatttgcatgcatcgagacgatacagccgaagagatgattatttttgttatctttgcgttagtggtgatttttccttatatttttgcttgagggagtatagatatattcattgttactgctctttatggaggttagtactcaacggtcaaagttaacaactaacccaagtaat

SEQ ID NO: 35216 - DNA, 19233 bp, Oryza sativa
gccgccgcggccaccgacgctctagacgacgacgacgggggccaccgtccgccgatccaccagtgcggcggggctgtgcaggggcggttcgctcgcaacagctcgtacgaaggcacgaagccaacctgcggcatgtcgccgccgcgctgccagccatggtggcgaacggatcctccacctcaaatcgctccagctgcgtcggcatcctcgctggcgtgcggccggaccagatctccgcgtcggccttctgctgcgactcgtcggagccggcgtactccgactgcggcgcctgcgtcgccatggcgttccggtacgcgcggtggctgtgcgggtacagcaggcgcgccatggtcgacctcggcgcctgccgcgtcggctaccacgacgtcgaacgcatggagcgggagatgcgcgccgtgtcagccgttcgccgtgagtgatctatttgttactccctccatcctaaaatataaatttttagcatagtaaaaagtcaaatatttttagctttaattattaatagtaaaaaaataaaaaagatcaattatgtaaaattaatgttactagatttgtcattggacaactatcataatatgtaactctttttatttaaaacatattatttttatagatattgctggtcttttttttcgaacagtcaggctgttgacgacgttttatataaaaagaaggtgtctggtttttaggagaaaacgagaccaaaccttacaatgcgcagttaattaggggtagatattgcaagtcaaagtatcatcttggagaccgtgttagagaaaaaaatacttatattttggacggagggaatagctcgataaatttttgtcttttgattatactgtgattttgttcgccttcctttattgattcagaatttcaggtagactctgcatcatccgaatcagcatttttcttcttcttttatttttttcagatacttcaccttggtggaaaattgtttcgatctatgatttccctgtgatggtggtgttcgaagtgatcggaatagcctgtgttctgttcattttcctccaggaatggggagacggtagaaggagaagaacccaggccaatcggctgccataggtggaggttcagttcaggtatatttcatctggttttgttaattcgaaaagttgttacaaatatcatagaatactccaacttggttaaatgcaaatataatgtagacaaaccagagttcttggagatcttggtcggactcttcactggtattcaaattccatttggtacagggttgtcaacttctgtctgtagccgcggttgatcgtagaccacagaacaagcaaaatccagttgcccaaaagaaaagggcacatttctacacaagatgtagatgcagttttcgtgtctaagactgttcattcagaaattaatagggatattttctcttgctcttctgattgatcaaatggaaaggatgatactgatgtaatattggagagtgcgaactgataaatgtgcatatactgagataaaagttttcaggaaaaagtgcgcactacgaacaaacgtggaactaaatagcagtacccgaaattgtgtctgcctgtcttgctacctagtactatggtttacttttgaagctttattcctatataatactgccctccatttcacattatatgtcattttatcttttttctaaatcaaatttaatacagtttgaccaaatttataaaaaatatattagcattttcaacataagacaaatatatcatcataatatatcaaatgtttaattcaatgaaactaatctggtattttagatattgctaaatttttcactaaacttagccaaatttaataaaacttaggaagaaaatctaaacgacttataatatgaaataaaatggatgaagtatttgattccacaaagaataaaaccctgtttagatcccactctaaaatttttcacgctgtcacatcgaacatttgaatacctacatgaagtattaaatataggtaaaaaaataaataattgcacagattgcgactaatttgcgagacgaatcttttaagcctaattgctccatgatttgataatgtggtgctacaggaaatatttgctaataatggattaattaggtttaataaattcatctcgcgatttactgacggattctgtaattagtttttttattagtgcccaaataccccatacgacactttatataatacccgatatgacacgcaagtactttacacctctatatctgaacaccctaactaatacacccgtgagggtttctgcctattttgagaccttcccaacacttgggaggaaaagataatggtcgatactgtggcccctaaagttaaattaaatatatatatatatatatatatatattgtatctttatttggggccatgcattatcgtggggcttgtacctgacgtcctgacctgagaagtgagaagtctcatcgcatacacactatcgtgacatcgacagacgcaaatcgaatgatccagactagcgatcgtagtgttcatctggatttttcacaattgggtcattttgaaaaatttattttataaatagactctaaaataatttattctaaaaataatttttttaggcgccagagtcgctagcgctgtcgtccaacgggcagggacgaagctatgttgtcccgagggggttcctaggaacccggctaggaaagtaaaattagtgattaataccccctaatgaccatgtgggcaccccccttgcctcacgtatgtgtacccccagactgaaagttaagccacagaggcgtaaagcccagcgcgtgcactgcagatcaccaggccgaacaggtgctactaggaaggtttcaaattttcaatgcactaatgtgttcatagcaaggcttctgatggattagatcatactacctaaaatagtaaaattaaggactatttatcaatgttgtataggtgatttttttgggatttttttttataaaagaagtggacgatagaacaagccaacagtgaaggaatatatataatatatctaggcttgccttactgtttaacaaacattaaaaaaattaaatattgagtcataaatagtagaaggtaatgtatgatgtatctatttgacatgattagttcataagcttttttagttgagagctaacatggaggttggggcaatgtattttagttttgctggtataatgcattcactcatattggtcagtacagtatttttatcattgcactcctcttttgatacaattggcatcacatattgatttcattttttaatatttgatgggaggcgcaattatttagtataatatatcacttgaaaattctatatggttcgatgggtatgaacacatgattgagtggtgcacccccccttcaattctctctagctccgccactgccaacgggtcggcgctgaggtggtagggagaacgcgcctatgtggctgccccccaggcattttttcctctctagtgtagaggagaaatatatgcatcctttattattattattattattattattattattattattattattataatatatttttttcacacttaggagcgcacaagaatcaaccgtagaaacattaaacttaaatggacgaaatatgcgacttgtagaatttttcaaagctatatcgaaaagccccttcctgctcttcgttgttttagtttttcataaagtcaaaaaaatagattagatttcgaacaatcttagctttttcttacatgaaaaaaagttagggtttgtgttttatttgttacatttgggtatcattttttaaaacatgcataattttctcatacggactcggaatcaggcaaataatacatccactgacatctatagaaaaagttacatccgattctccccgattcgtcgggttaggcaaaattagaacctccaaattccacttgcaatattatgttttcgagacgagaagcttttcggtagagctttggaaaattctacatgtcacatatttcatctatttgagtttaatttttctatgattggttctcatgtgctatatcaaaagaaaaataaaaaaaaattggggggaggacgccagctacattggcgctctccccctgctaccctagcgccgacccgctacggtggcaggaggctggcgccctcccgttggacgacagtgccaatgactctggcgcccaaaaaagactatttccggggataagttgtttcttagatctatttacgaaataagtttttcaaaagaatgaaatcgtaaaaaatccaatagcgttcatcatacgatcgatcgctgcatttaccgagtccggcaatggacaacgttccaattggagcctgtcacatcacttgactattattgtgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgcccccatcctatataaggtgggcaggaggccctttagggggcatgagatacaactagatcgtcaaatcaatacacacccggcggattcaaatccccaaacaggagtagggtattacctctcattgagagggcctgaacctgtctaaatcctttgtctccgcatccatccacttttagggctcgtgcgctaccccttttattattgccgaattcatgtttcgacagttggcgcgccaggtaggggtgcgtcgagtttctatcgacaagtgcgatggaatcaactttatcggtcgccggcttcgtcttcgttttgggagttttcgcttcctcgtcgtcgacaatttcgacaagctcttactctttgactcggattcaaaccagtcaagacagtttcaatctactatggctgccaccaccttcacttccgtcttccccaggatcttcttggacttcatcactgctgccgaaaatccgacatgctccaattagtcggctaagagatcactcgccaattaaagcaatcaagcaagatacaagactggacagccatggagttttttcttttctctagatcagccgtggagatatacaatcaaaaggatgactaggtcattacatgcaaagctgacaccatgcaagccatatgccaggagatacattgatccgtcgccgtcaacacaatcttctgatcaaatcaatctaaagatttcctgcatgttttgttatcggctacgacttccgagtcctccattggctgaactcgcagcgccagagggccctcgtttccttgtcaagatgtatatgcctgcctgttaattactatcatgtcagatcggaataggagctgaccgagcagcatgagtgcatcgcatctcgtatcaggcgtgcatgagtagattcaaattcagactcgctgattaatggatgttttaatccactcggactcagcatcaattcttccaatttaataaagacatatggttatgggcacacagcaagctatatcagcactcggcaaacataggctccaagtcctttttccaagacgcgggatacataataggttggtcaactgcattaatattgctaggcgtcatcttcttcgcccacggccgtgccgactggttttttaaccatcacggctggtggactccgccaccgttgatgggcctcatcgtcttcaccgaccaggcaccttcgccacctttgattggtgttttcgcctatacggttggcggactccgccgtcgttgatgggcctcgtcatctataccaccggcttgcttttgccgccgccgacaggtgttttcatcgctattgagatggactgcttcgttcccacatcggctacttctgctgtcaccaagggaatacgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgggttatggagttctatcttcctatgctttccgtttggtttgccaatggatgattgactttgggccgattcctagcacccgggagcttgttggatggaccgagtaacgcaaggtgctaagtattattcggaataaatcaaaagcatagagatgagataattttttttttgctcttaataattgcaaaagtacccgagtagtaaattctgatccgtgaaactttgttccattaatgacgaactcatgtcactcatatgcatgtttgggaagtgcctaggccgactcccgatgcttggggactatgattagtcgggcagagtgtttaaacgtaaggagtcatctgctcggggaaatcaaaattgacaagaggagaaatacatatttataaatattttaaaatacttgcatttttctcgagtattatatttacatcagatactactcatcctatatgtttgttctgcaggatccaaatccagatatgcataaaagggattcatggctttaagcttatctcttacactgcaggaatggatcagtcagaacatcaccaccggcttgccgtcgccgccgtcgactggtgtctccgcctgcacggctggcctattatgccaccgttgttgggcgtctacgtcttcaccgatcggccgcctcgtccgccgccgactggtgtttccgcctgcacggctggcctattatgccgccgttgttaggcgtctacgtcttcaccgaccggcttgccttcgccgtcgtcgactggtgtctccgcctgcacggctggcctattatgccaccgttgttgggcgtctacgtcttcactgaccggccgcctcgtccgccgccgactggtgtttccgcctgcacggttggcctattatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgtctctacgtctggtttataccactaccactactgatggacatcatcgtcttccgtcgccgactggttatgccgccgccgactggtgcttttatcttcacaactgcgcgtcttcactaccggtttgcttctgttgacgccgactcgtgttcacttcatcacggcaatgcaactttgtcatcatggtagagcgacttcatctttattatcttcggcaccggcaaactctattgctgctacttcgcaagtttcgctacttcaccaaccacgacgtctttgtgaatctcgacatctcggcatgcgatgccgtgttattttactacaacaagtggctctccaatattcaggatttctacttggacatcttcaacacatatcttcaatcaagcaataactattcgacgacaagaagctacagttctcgactctatgttcagttgtttcccaactaatcaaagagtcgggggctatacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaagtaaagcatctacaacagctataacattaatttgatagattattgtcactgacatcatcaccagcacctctgcttcatcgaccctgacatctccgctgttgctaatggatgattatgttttcgccgacttattatttcaccttcacggttgacctactatgcaaacgctgatgagcgtctttgtcattatcattggttgctacactgctattgactggatcatcgacatcgtcatcttcatcatgtcggttgcgtttgtcatcgtcaactattttcttcatcttcatgattggtggatttcgtcatcgcatttgatctgcctcgtctgtcaccgactgattatttcgctgccatggctacacaactttatcgctgggcgccttcatcttcattgttagttgatctgtttgccgccgactggtttcttcgcctccatggctatgcgacttcagtacttttgattggtatcactatcttcactaccaccaatatttttgccacctctggtgggcaatattatctctatattggtcgtcttgtctctatgccaactgcgtcagctaccatcgatggacaattgtgactacaaagaaggacaagctatatgctcagaggcttactagttcaaacacaagtatcataccttcaatttggacttgttccggttacatgcaacatgaattcatgatcatgggtctattttctatgctcaaagactggactatttattattctccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgcgtcatcctttaaagggtgtcgagggcatatgttttggcctaggcctaatatgtctgcagcccatattttcaggtgtggcctgtcacgttcttttagggacttaggcatctttttgcttaggcaaaagtgcgcgtgattatgtgcccaataccttaaaatccttttataccgcagttactcaactttttaggagttggtacaatgcattttaaaaggtgccaaacagtaatgctttatatagctgcccgctgacttttttatataagtcaaggtgctgtttgggttcataaagcaattgattggatacaatatcattgttttttgccacgtaagtgtacacttttattgaccaatattatggcttgggctgattatatattttggtcattttctaggcggttggtaaatcctttatgagtttatttactcggattttacaccacatatgccatatattttcaggtgtggtgaaaccatgtgtctttagggacttaagcacatctgttaaagcagtgtgcgcatggcgtatgcccaatactttggaaatttctttattcacaacatacaagcttctttatagctgttttgctatgtgaattttcaataatgtagtcgactttaagttacacgcatcatattttacaaagcagtcggtatatcacttggatcatattattcagggattcacacatcatatgctattatcgaaaccactcggttggttagattatttattccttgactatatgtttggtttgttcaattaaccacatagtcgggggctacacctattaggtgcatctagtcgatgcacctgactttatttttcagccctccacagtcttcagatttggtaaaagtactcgggaagtcatggcaaagatgattgaagcactcggctttggagtaatctagttcgagagaagattatcttttcgactgtgaaggtctcaggggctactgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatgagacacaactagatcgtcagatcaatacacacccggcggattcaaatccccaaacaggagtagggtattacctctcattgagagggcctgaacctgtctaaatcatttgtctccgcatccatccacttttagggctcgtgcgctacccccttttattattgccgaattcatgtttcggcacattgtttgccgtgatggaagcgcactggatattattgctgaggataatggtataatgatgtatcccattcgaaatacttatatgtatcatgcgattcctaggtatcgacgtataatatcttttaagatattatcccgtctaaacatgatagtgttgtataggtgctaatgatattagtattaaggacctattttatttacaaataggacttcaatgccaataacatggcactgagagctatatgtaaatatttttatattacaagtaaatccttttttaattaaaaatattcctttcacgaataggctctcgacactacttattgctgtctagcctatctatttataaaataagtttttgtaaataaaaatctaaaatataaaaaatccccattgtttgccctcacgccggccatgcaatggtcgtcacggcagcttgacgtgggcccaccagcatttatgcctgggtcccatgatgtcaggatcgacgacagcgcaacatagacgagtcaagcaagctccactcgagtcaaccaagggcccaccgctcatctatcatctcttctccatttatccctctttgctcgccgaccacctccaccctcgcgccatggccacgccacgtggccatctccccgcctgcgtcgccgccgtcgcggcggcggcggcgctcctaacctccctcctaccgccgcccgtcgcgggccagcccctcggcaacttctgcggcgacagcggcaactacacggcgaacagcacctaccagggcaacatccggagcatctccgccaccctccccaagaacgcctcctcgtcccgcacgctcttcgccaccgccaccctcggcgccgtcccggacatcgtctacgcgctcgcgctctgccgcggcgacaccgccaacgccaccgcctgcgccggctgcgtcgccgccgcgttccaggacgcgcagcagctctgcccctacaacaaggacgccaccgtcttctacgacgcctgcgcgctccgcttctccaaccagaacttcctcgcctccaccaacggcgacaacaagttcctcatcctcatgaacacgcagaacgtgtccgcgccggccaaggtgttcgacgccgccgtgggcgtcctcatcaacgccaccgccgactacgcggcggcgaactcgtccaggcggttcggcacgggggaggaagggttcaacggcagcaagatttacgggctggcgcagtgcacgccggacatggcgacggccacctgccggagctgcctggggggaatcgtcgggatgatgcccaagtatttcagcgggaagcagggcggcagggttctcggactgcggtgcaactacaggtacgagatatatcctttcttcgacggggtctcgctgctgcagctcccggcggcatcactgggagcgccgccggcgccatctccggcggccgtaaacgtcacgccgccggccaccaccaccggtaccagacgacgaggtgagttgggtgaaactgatatacgaagtagatctcatttcaacaatgcgatatgctaaactcaaaaggggggaaaacagtatcctgatatcctaaatggcctgaattttgtgttggtcacggacagaggatcagtccatgcatgtgtgcagcaattttagttcgatgggtttgaatagaagtggtgtttgatttcaccgtaggaatttgaaacgatatttgattcggtacctaagtatgctatcagcaatctaattatcgattggtccacagttccacaacactgttattggctttgagtcggtccacatgaagaaactgaatcgtccaaatacagaaaaaaaatttatttttttggcaaaatttgtccaaattctacctgtttttgtcgataaccgttccattgtcgtggctattgaaaaaacctctagggacctgtttttggtgaaaatggcatttgtaaacctcgagttgtccatcgtgactgattcctagccatagaagttgttgtagaggcagggccagtcctatgattttgagggccctaggcaaactcatcacgatggaccctctaaggtatatataaaattttatgatatatatatatatatatgctaattttacttgcaaaacaaaaacaaaaacatccatatattaaatttaacatgtatggtaattatcaagaaataaaatcgatcaaaataacaatatatttgtaacttggaactaatatcattattcattaacttaatgaagaatagaaccccatcatatccattgcttcccatgaaaagatacttctttgggcatttcttgatgcaaaatcatcaagaacggtattaagatcaatagtgttcaagatatccttctcgattgagcgcatagccaagccatttaacctttcttgtgacatagttgatctcaaatagttcttcaacaacttcaatttttgagaaacttctttcagctgaaactacagtcacaggtacagttaaaagaattcgataggcagctgaaacatttgtatagcaatctgcatccataacaaactttaaaatctcaggcgcggagacatcgaagaatctggtaaactcacttgcaacacctttaattctgaataaaaatcattgatctcaacatcggatgaggtactcgactactagaattagatgcccccccctactactagaattagatgccccccccccctaacatggccccccaccatcatgggcccccggcggtcgcttcggctgcatagggctagggccggccctgtgtagaggttacgaactcgtctttctttttgaagttagattagtctttcatgatttgttttttagtacgaacaacttaatttggaagaaaatattttctttgtcattttgtggactggtctgatgttcacatctttaatcgcatgaatctatgagtttccttttagactagtcatataccagatgtttccatgatcaattttgctaatgatcaattttgctaaacgtttgtcgcgtgatttctcgtctgaaatttgacgtttttctggccgtcggattgtgcgtctagattggtggtggatttagcgctatgaggccacgtggggagccacgtgggccggtctggtccgaattttctggccattttctagctgttacggcgtatttctcactctctctctctctcccgccttccttctcgctctctctttcatgcgctttcttttctcattctctctctccctttctttcgattttctatgtaaaaattgatttctttaaccattgaaaaaataagacaactaaaaataaaaaaataaaaataaaattacagtcctatataactaaaattacaattgtaaatttagttgatataacacgtaagtgcactgtaattttgataaaaatatcgtgtaagtaaatatgcattttttattttctttaaaatataaaattacactcctacataactaaaattacatttgtaaatttaattgatatggcatgtaagtgcattgtaattctgattaaaaatactgtgtaagtgaatatgtatttgttatttttttaaaaacatataaaattacagtcctatataactaaaattacatttgtaaattcagttaatatgacatgtaagtgcactgtatttttataacaatattgtgtaagtaaatatgcatttgttattttctttaaaatataaaattatagatctatgtaactaaaattacatttgtaaattcagttgatatgatatgtaagtgcactgtaattttgataaaaataatgtgtaagtaaatatgtatttgtcattttcttttgtagtccatgcagtttcttttttaagaagatcaattctatgatccttgaggaggtaccatgaagtacaaaaaatttagtgtaaaatttggtacgtactgtgaggtaccaaatttacaataaaaaattgatacctcctaaaggatcgtaaaattgctcctttaagaatggttagtgtaagttttcaaaaaaaaaaagatggttagtgtatactggttaatgatgtcaaaattatttatacttgtgtttctgtcttatgtcttacattaattgatgcattccgtttacgggatgaacagggaacaccactggtagggttttagccattgcattgcctatagtcgctgcaatactggctgctgtagtaatttgcttttatatctggaagaggaagacggaacgagcaagaaagccatcaatagcaggtaagttcctgtagttcattcaaattccattaatttccagtacgtgttctcaatacacttgaaatggcaaaattaagtttttgtctatgcagtgacttcattctcatacaaaagcaagaattccattaatgcattacaccattattgttgtattttttttctgaaacaatagatccaacagacccagcggacatagaaagtattgattcacttattcttagtatatcaactttacgagtggcaacaaacaactttgatgacagcaataaacttggcgaaggaggttttggtgcggtttataaggtgctaattataccattccattttagtttttatattcaatactttacagtttcagccagtaaaaattctctatctgtacagggagtcctccctagtgatcaagaaatagcagtgaaaaggctatcgcaaagttctcgacaagggatagaggagttgaaaaatgagcttgttttggttgctaagcttcaacacaagaatttggttagactccttggtgtttgcttggaagaacatgaaaaattacttgtgtatgaatacatgcctaacaaaagcctcgacacaattctgtttggtgggtactcttcagccttttcaacagtgaatcaataactgaaacttttttatgtataattttgaagttttttcttctatgtgacagatcctgatagaagcaatgtgctggattggtggaaaagattaaagatagtcaatgcgatcgctcgaggcttacaatatcttcacgaagattctcagctgaagataattcaccgggacctaaaagcaagtaatgttctgttagattccgattttaatcctaagatttcagattttggcttagcaaggctatttgggaatgatcaatcacaagacgtcacgaaccgtgttgtcggaacatagtaagttctgatgatattattggctactaatatattcggtagtacacattagtccttgacataacagaatttctcactgcagtggatacatggcccctgagtacgctatgcgcgggcattactccatcaaatcagatgttttcagctttggcgttctgattttagaaatcgtcacgggaaggaaaaacaatgtctcctacgactccgagcaatcggttgatctcttaactttagtgagtacctcaggagagatcagctatatattacaaactctacacccaagtaatgttttgtattaatatcagagcatttacattacctatcaaaatatgcaggtgtgggagcactggttggcaggaacagttgtggagcttgcggattcatccatggcggggcattgtcctggagaccagatcttgaagtgcgtccacatcggactcctgtgtgttcaagaagaccccacggagaggccaatgatgtcgatggtgaatgtgatgcttagcagcagcaccgtgtctttacaagctccatctaggccggcattttgcatccaaaagagtagtgtcaactcagattcgtactcggagccattccgtggagctaatcagtccacagtatagttggccataaggcccgaggcccgaaggcccggcccacggcacgcctttttggcccggcccaagcacggcacggcccgacttgggtcgggcccgtgctggcccggcccgactgtcgggccgtgcctgggcctccccaccggcacgctgggctggcccggcacggtcgggccggcccggcacgatgggccggtaggccaggcccggtacataaagtacagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgatggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagtctcggcccaggcacggccgggcctgggccgtgccgtgccgggcggcccacatggccaactatagtccacagatagatcgcctatgtcaccaaatgaggtttcgatcactgagcttgagccaagataaatccaatgtgatgctgaattcatattgtaccctttttgttttgcaaaaaaaaaaaaaaaatgctgatgtagggaaagacctacttcggctgtgtttggaactccaagttcccaacccctctccctcgttttccgcgcgcacgcttttcaaactgctaaacggtgtattttttgtaaaaagtttctatacgaaagttgcttaaaaaaattcaaattaatccattttttaaaaagaaattagctgattcttaattaatcacgtgctaatggaccgctccgttttccgtgaggggagattgggttcccatccctgctatccgaacacagccgatcatatgtattattacaccatcagacttcaaagaaatattagctatgatccacatatagtagggcacggtaatataatatgtatactagcaaaatgatagtataagcagataattgtaagttgtaaccctctgtatgttacttcacatacgcatactcattcctgaagggttatttacatacttcctccgtcatatattataagacgttttggtatcttcatatctcatctaagtatgaatttagacacatatataaagcacaaattcattgtagctctttgtaacgctccgcttttcgtgagtcgttaaaaactaattcggcaaaatcctaattgcgaaaattttcgttctttgtgtgcgagtctaagttgtgccaaggatctcaatttaatcccgttgttccctctcatcgaaaccaaaatcctccacctccaaattccttttccgattcgagtctctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgaatcccccttgatatatccccaaaccctcgagttcgaatatcaaatttgaattcgagtccaaaccctaaaatctctccaattctatccaaatcagttttctctgtaaaagtctactttacctccctgtattttggatggaccgatttcctctccctcagcccacctccctccctcagccgccttcccccttcccacgtgcgccgcacatgagccgctcgggagagagagctctctctccttctctctcggatttctatgtatatctctccctctcggtctctctgtttctctgtctatccctctccccggcgtggatttcccgccgtcgacgtttgaattcgaccacgtcctcacgttcgcgcgcgcgctcgcgcgtggccgaccgcccggtcgacggcgagtaggacctgccgtgcctgcgccgcgcagccgacccgacccggttggctttagacgacatcgccgctgtcatagctcggtcccgatgcccccatgccgtatccttgcaaaaccaagagacagagctggagctcctctccctcgttctttctttctccttcctcccaaagtggcaagggagccaagctcttttccctcccctttttgcctttttccccgaccacagccgctgtcaccacctgccgctccttgaccgcaagcgccgcgccagccgaagaagcttgaccaccaatgtcggtttccctcctccaaaccgacctctcctcctcgcctataaagcccgcgccctcccctctcgtttcgtcttcgcctcgctcgaaccacccgcgccattgttgccagccgctagctgctcgccccgcgactgcctcctcgctgccgcgctgtgccaatggccgcgtgagcctcggcgtcggcctcgtcaagctcggtgccgcactgccgtggccaagagcgtgtgcatgcacacatcatcctttcggcctcgttgcctccctccttgcccggccgcgccctctcggtgccgcgcctccccgccgtcgcgaccgcctcgtcacgactccctctgcgtcgccaacgccgctcctccctcgccggtgagctcccccaccgtattcctcctcctgccgcacaatgcgccgcgcgcctcgccgttgctctgtttcagccgccgcgcgcagtcgcgcgccgtcgtcgggccccagctcatcgaccaccctcaccgacaccgtccttgagctccctagggtctccccaaaccgttccctagcaatgccgtcacccgccataggcttgtcaccatcgccgctcgctcccggaggccgccgctcgtcgccagatctccacggcgtcgctctgccccatccgacgccggagatgaactccttgaaccccggagatactcccaccaccttgaatttaatccttgtcgcccctccgccgtttaccctttttctcgccgccagcgtgcgtcgacgaaatccgccgcctctggcctctttccggcgaatccgatccggtggctcacttcctctcgtccgtcccatcgttccgttgtactccctctctctcgaatcgtcgcgatgagctccggtgaactcggccgccgtccg

SEQ ID NO: 35217 - DNA, 24827 bp, Oryza sativa
gacccttgggcggcgtccttgccgcccgaaaaagtctaatatacatccctccatccttttctttttcagtgatttaataaatcctttttcctttgtcccataaatcaattccttgttccaaaattccataaaccatttcctttggtcccacatgacagtgactgtcaataatattcttgggaatattatttctacaaatcccataaaccatttctcgtattctagaaaattccgataaatcatttccttgaccagaaaatccaaatcaaacttccaaaattcatatcttcccaaccgctcttccgattgactccgttccacttccagtaattccgtaaaattgagatctatttaatggcactattaattaggctaaataggatctttcttttgggtcttgtgtaggttttcaattgtttgcgtatagctgcggttatcggattttcgtcgatcgcgggttttctcgaagattcgtgaagcttcgtgaagaccttgagcaaggcaagtcaccctttgaccaattgctcctataattggaaaatcattattattttgttggtaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcaaaaacttgggaaatgggtttgtgaagccttcgaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtagctagtcggttcagggaaacctcgcatgccaatagttgggaacgccggggcggggtcggttggagccaaaccgggttcctggtaaggcaagaacgcgaagcttgccagattaccgatcgaggtggttggagtttgatttgtgtatgcctaaaatggcctatatttatgtgaggatttgatccttctatgtggcatgaggtatccctgggtcggcttgggaaaggctttgtcgcgaacctctgacaccggccagtgtctagagtaagttcgtgtcttgtgggtaaagtgtacccctctgcagaggttaacaaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcaggatgtctgtgggcatcatagactaggcttcccgagtggaagcggattgttgtgctgctgggcagctggactctgggagtccgagaaaatgaaaaaggctctgggagccgattaaccaagtgaaatggctctgggagccgagaagtaatgatccgacccgggaggtcggtacattaccaattgagttgttgaaaagcatctcttaaagtcgaatcgagacgcaagtctcttttcgcccaaacatagaaagaaataaatcacttagtgatttcaaaatgatttcaaacaaaagatttgcaaaacaaccttgcctctcttccaagcttgcattaaacacctaaattcccgtgacttgctgagtacgaaagtactcacccttgctctataaatatatatatagttcccccgccctgaagagaagataaggtgaagtgaagattagggtttcgtcctggttcccagccgtcgcctgtggtgttgggtgttagaccgttggttccgctgctgctgctgctgttggtgcttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacactctttctaaaccctagagagacagaaggggaataggtaaggctagatggtttttttcttttcttttctttcttttttttttttgctaggatgaccgaaagaagtcattcaaatattattaagatagagggaaaaagggttacaataaggtttttcatcgaggaaggatatacaccaaaacacatgccccgacaccacacgctgcaaaaacacaaactatagagcggaaagctagatggctttccacttattctattcctgtctctacaggattcttggttttttttttaacttttaattgcttatttaattcaagatattctacgggatttcgctgtttagtttttttaagggactttaattacttatttaattctatatgttgctaaattagtttgggttaagaattcaagtctgttcagattgtagctaaaataaatcttaccaaattttgacaatttgacaatattgctaagttttggtagaatttcttatatatttaccattatatatttaccagagtttagtaagaaactaaatggatacacatatttgacaacttaaaaaaattgtatagtttgaaatgacttcaatttgaacaaccccttcatgacgaaaatttagcacgctttcattgtagtgtcaaaattcgttggaatattgtaggtagtcagcgtgttcatatatagacgtcatgtctatttcattaaacctcgtcctttctttcattccggatcaaaggatattgtgaacacatgtactaccgtttatataatcatattctttgtcgtctgacccggatcaaaaaaccatctccatcatttacaaaaaagattacgcggggataatcgatcactaccaactctcatctcaactcatggcgatgcacccgtgcaccactacgctcctcctcgccttcctcgccgtcgcgctacccggtggtgccaaggcatggcatttctgcggcagcagcggcgacgtcttcgcgccgaggagcacgtaccagtccaacctcgcgctcctctccgccggcctcgccaagaacgcctccgcctccccggccctcttcgccgccggcggggtcggcgacccgccggacacggtctacggcctcgcgctctgccgcggcgacaccacgaacgccaccgcctgcggcgcgtgcgtcgccgccgcgttccaggacgggcagcagctgtgcgcgtacgccagggaggccaccgtgttctacgacccctgctacctccgcttctccggcaggaacttcctcgccgccgacggcgacaacttcgcggcctacttcagcaaggtgcggaacgtgaccgcgccggcggaggtgttcgacgccgccgtggtcgcgctcctcaacgccaccgcggaccacgcggcggcgagctcgcccaggcggttcgccacgggcgtggaggcgttccgcggctggggcgtccgcgacatctacgcgctggtgcagtgcacgccggacatgtcgccggccggctgccggagctgcctggccggcataatctcgtgggtgaacgatcccgactacttcagcgggagcccgaccgggagggttcttggggtgcggtgcaactactggtacgacgtgcatccgttcttcccgggaagcccactgctgcgtctcgacgcgccggcgtttgatgtatcgccgccggcgccatcacccgctccggtggcggcggacacgacaccaccggcggacagagcaggtgagtttttttttgttctttttttttttgacagttgatagagatctaaaatttttttcttatactttctctgtttcacaatgtaagtcattctagcatttcccgcattcatatatatgtctagattcattatcatcaatatgaatacggaaaatgctaaaatgacttatattgtgaaacggaggaagtggttagctaccaagaaattcttaatatctccggctctctagatttgaaggtcggccgacggaataactaaattgaccgccaagggcattttgttttcttgtagtgtcagtgacaaaatggtttacatctcaagttagtctctgccgtgccgtcaaccctggatggattatatgattgtgaccgtatatcgtatttagagtttatgttcaataaaacatgcaattatagaaatatggtggactctttaatctttactcctacttataatactgtagtttagataaaacaaaaggctatatcaattacaaactggagtatttactaatttttatatccgaattttgagcaaaaaaaaaagacataaaagtgctaattataagcctccaaagtccaatatgaggacaaccctatatttattaatctttaattttgaaatattaaattgaaaccccaacactaattacttatgattaattccaaaactccaaaatattaaataaaacacaaaaaaacacagaaactatattactaggatggattataaaatcagtattttattttattctataatttgaaattaataattgacaggtagtaactgctgtagactattctttccatctagtaattcaatatgattcaaaatgtagtcaccatatgattaaaattttaatttgtacattatttcctctgtttcgaaagagaaggcacattttattttgttaggacaagtttttgaccaacaatactttattataatatatttaggtgacacaaaattgaatttattatattcgtattcgaaagtacttagttatcattatgcttttataatatgtatcacataagatatcctaatagagcaattgttgatcaaaattttgtcctgccgaaacaaaatatgtttttatattttgatatgaagggagtactaataccaataacctgtggagcgcatagtttagcgactagcgagtaactgaagagtcattttttcataacataagttatgtggtatacacatttctctgtttttttttaaaatgttctagttagttttacgaggtcaaataagaaaagtcaggctacaaagacatcaaaagaagaagatggaaatattttcaaagcgcgttagccatgcacatcttatagttgttagtcaagctcaaggtataaattgtccactttatgattatcatatggttgttagtcaagctcaaggtattagatcgataaatctcgttagttacatcgttttccatgggtttgcctcctctcatatcgaaaagattatctccagttttaacttgtttcaccattgtcaacaaagtttggtaggggtaggcacgaccaaactacacatcgcctgcataaaaaccggatctgctacctcttaatttatcagtcccgtcacaatcagttgcttaattgaccagttaatgacaaatttaacgcggaggtgtccttccttgaccatttctgcgagtactaatactattttctgtttgtaaataatgattcatgcaggaagaaagaggacagctgtgataatatctgcatcagtcgcttgttccattgtctttgtattgattatttcaggttctgttttcatctgcttgaagaggaggaaggcttccaaaaaccagaacagtgagtggcacacattttatgtttcattcagaattagcatgagtttcagtctgttgatgccatttttaccccaatgccagctccaatcatcccagcaccgaacaaaatcaaaagaggaaattgcgcgatcttcgatttaccaacactgcaaattgcaactgataacttctctaacagtaataagctcggggaaggcggtttcggtactgtgtacagggtaaataaccatagtatgtaagataaaaaaaaaatagacctgactaccattttctcttcttctctataacaggttcgttttgcagggaaagcttggtaatgggcaaaaagtagcagtgaagaagctgtcacaagcacagtacaccagagagggactgaaccagctgcacaatgaacttcagttgttggctgagcttcagcacaagaattttgtcagattactgggtttttgctcgcatcaggatgagatgatgcttgtttatgagcacattaagaacgggagccttgacatctttctttttggtactttccttcctctatggctgctgatccagtattttgtctggtgacacactgcaaactgatctcttttgaaacttatgcttacatttgagcacaaaattgttaattttcctctaaaaagctatactataaccagctatgccaagggattgacaagaattaaatgagtattgtataagtagtgatggagtgtgatggataatccaagcactgtagcattttcggcaaacgagttgctacagaaattagctaatactagaatgtacaattaacaatctccatttacatgattgtagtaatttttttagatatgacatgattgtagtatggccttccatatattgtatatgataaaaaatgtttaattcaaataatttattttgttgaaacagatactagtagggcgaagacacttaactgggagcaacggtacaatatcattcttggaatcgcaaagggaatattgtatcttcacgaagattcaagcataaggatcattcaccgtgatttgaaagcgaacaatatattgttggatgaaaacatgaacccaaaaattgcagactttgggttgggaaggctactaggaggtggccatactcagactaagacggctacagttgtcggaacatagtaagttcacaaacataactgaaacttgaatgagataaatgtaagtttcccagttccaaagtgtagacttattgctgatcttctacatgcagcgggtatatggcaccagagtatgcgctatttgggaaggtatcacctaagatcgatattttcagctttggtgttttggttcttgaaattgtaaccgggagaaggaatagcggtttcgacaccacatacaacgcagtgaatctcctgacagaagtaagccctattttcagctctacttgatttagaacttttatggtggcctctactgcttgataatctgaagagactttcaagtttcaactgaaaaaaaaatgactacattgatataacaggtgtggaattgctggacaaaggggacggcactgcagctggctgatcaatcacttgatggatattccgacagcaaagtgctacgatgcatccacattggtcttctttgtgtccaagagagccccattgacaggccaagcatatcttcagtgattctaatgttaaccagacgcagaataaaactccagcaaccgcggcaaccggcattcttctttggaggggacttcagttcagtttatcaacaacaacacagacatcgcaactacatgtatgataagagtggcgtgattgttgaggataaattctctgtaaatgatgtcaccaatactgatccctatcctagatgatctgaaactcagaatgtgactgccagaatagattggtgttcattatttgtacgaattctttcataatggaaaatttcacttgtatgaaattggtcaaactaaactacgaattctttcagttgagagaagtctttgatatcattttagttgagctgatcaacagtttcttgaagtcttcgacgctgaggctgaggtcagagtcggcagacaagtcacatcacagcaaatttcttctgcgatgattgtctctgcaggttctggagcagttgagcaccgagaagctgggccccacctgtcattctcagccagcaccacacggtcaattggtcaaactaaagccgcacgttacatagcttgcgggacaacttttctccaacccacaggtgacgagtgacgacgggtctccgcggtcatggcgcgccaccgcgtacgctgcctcctcgccgccgcgctcctcctcgtcgcgccgatggcggcggcccagccgtggcagttctgcgggcagagcggcaacttctcggcgaacagcgcgtaccagtccaacctccgccagctctccgccaccctccccaagaacgcctccgccgccctcttcgcggccggtagcctcggcaccgtcccggacatcgtctacgcgctcgcgctctgccgcggcgacgccaacgcctccgcctgcgagtcctgcgtcgacaacgccttccaggggggccagcagctgtgcccctacaacaaggacgtgttcatcgtctacgacctctgctacctccgcttcaccaaccgcaacctcctcgcctccgccacggacaacgggagccccatgatgctcatgaacgcgcagaacgcgagcgcgacggcggaggtgttcgacgccgccgccgccaccctcctcaacgccaccagcggctacgcggcggcgaactcgtccaggcggttcgccacgggggaggaggccttcgatgccgccgaccccaccatctacgggctgtcccagtgcacgccggacatgtcgccggacgactgccggagctgcctcgggggcataatcgcgttgatacctcagtacttcggccggaagaggggcgcgagggttatcgggacgcgctgcaactacaggtacgaggtgtatcctttcttcgccggaggctcgatgctgcggctcccggcgccggcggcgccggcggcgcctccgcctgcacctggaccagcaaacatgaccccaccggcgcacaccggaggtgagttgcagatttgcggtcaaaaatcagtttcgtttggagtaaatttatagcactccctccatttttcaaattacttgtcgttttacctttgttgttagtcaaaaatttgtatatttaagcatcgatgtgtagaaaatcatatagtttaacatcacactatttatgtttttaagatttaccatgagaaatactttcataatatatataattcacatgttaaattatatgaatttctaaaagttaatggtgaaagataaatgtttaacttaaaataaagctagaacgatgagtaatttaaaacagatggggtgttggtatttagcacaataacaactcctcataattagttttccatcaattttgagaaaactaggaaaaaaaatttaccgaagataccaatatagtagtagttttgagtagagaaagagagaaacttacaatcagttcgaagaaaaaggaagaaagaacccctaaactaatttgcatgtctttaaattgttttgtgctgtctaggttagaaatgctactgcgttaagaattgtggctgctctgcagtagggctgaattgcaaattttttaggtaaagacaaaaatgtctttatcagggaaattggttgcatggggattactgaacattggtcagagaaatctggttgctatgacatattaatatagataaccctgtgctctttttgcccttttttggatagatctgacatttctgttgtcctgtttcttcacacatttattccatgtagaattggtaataactgcatttccattatgcaatatatatgtgccttaaacatgtaaagttcaacaacgattttggtttcctccatgtattgccatttaagtaggaaaaaacatgagaagatgaaaccatattctaaaatgccatttttttacagtgaagaaagccctgtataatatattgaaaagtttgcgatgtgctgtacaggtcaaaaactgaaaagtgttgaactgtagcatgtacctttttgaacagaaacttaattatagtggaaatgtatcatcatatttaggttatgaattagtctcgttaagttcatatctgtctgaaattgaaatcacttgcttgcagaaagaaagaaaaataaaagtggaacagctctagccattgcactgcccctagttgttgtattgctggctatggttgccatttgtttttctgttcagaggcggagaaaaagatcaaggtcaaaacagcaacattcatgtaagttcagtaacaattttgattattattatagggaaatagtgattccctttgacaattcgaattttattcttccctacaatttttagttggaaatgacgtcacatttatttcagttacatcgcatcaaaattttgttgccctcttttgatagattcaatgcaaatgggggaggacattgaaagcgtagattcactttttatcgatctatcaacgctgcgtgctgcgacaggtaacttttccgagacaaataggcttggtgaaggaggatttggttcggtttataaggtacaatcatatatatctctcacttcatgtaattatgttcgcgttctgcttcaataagtgagtgcctacacttatatgcagggtgtccttcctaatggtgaagagatagctgtaaagaggctctctatgagttcaggacaaggaatagaagagctaaagaatgagcttgttttggtcgccaaacttcagcacaagaatcttgttaggcttgttggtgtttgcttgcaagaacatgagaaattgcttgtgtatgaatacatgcccaatagaagtatcgacaccattctatttggtactattctctactcagaattcaacaaattactggtaaaactgtggtttactaatggtatttcttgttcaactggcagatcttgacaaaaggagggaactagactggggaaaaagatttaggataataaacggaattgctcgaggattacaatatcttcaagaagattctcagctgagaataattcaccgggacctcaaagcaagcaatgttctattggactccgactatactcctaagatttcggattttggtttggcaaggctatttgggggtgatcaaacaagggagatcacacgccatgttgtcggaacgtagtaagtattgtccatattaacccaatcagatacaaatatagtatgtcagcatgagtaattttattctcttactgcagcggatatatggcgccagaatatgcgatgcgtgggcactattctgtaaagtcagatgtctttagctttggcatattgatgatagaaattgtgacaggaaggagaagcagtggttcactcagctttgatcaatcaaacgatctcctaagtcttgtgagtccttgctcatttcctggactcttctacaaatttaagtagcttacttcttcttgcaaaaatctgaatcatctttgccaatatgaatatatgatgcaggtatgggagcactggaccatgggaacaattttggagatgatggatccctctcttacaagccatgctcctcgagaccagatgctcaagtgtattcacattgggctactgtgtgttcaagataacccagcagatagacctatgatgtcaacagtgaatgtcatgcttagcagcagcacagtgtctcttcaatctccatccaagccatcatttttcattcccaaaagtgacacagactcaaatatatactcggaatcacacccactaacttcccaatcgactgcctcgaccggtaggtcgggagggatgtcagttaatgatgtgtcaattacagagcttgaaccaagataaggaaaccaaatccttcgaatttaagataagaaaatcagtgacaacggtaattgaattgttacttttaagaaacaaacttcagggagaaggccataaacttgtaggagaagcattgaattctgagtgcatttctccattggctgagtcaatattttggttggttttgtttgttcgtacaagccacccttgtttattttatagtttgaaaattggttggttgcacatccagtgacaaaaatttatgtagaagctatacacacaaaataaaaatttgttgcaaaccttttactgatgctaaggtggcatactgcgaataaatctagcttttcaatttcttcagatagtggtaagactgaaattacacacgacctctgcatcaaccaggcatgtacacaacttagaaaaaaaaacctaagacaaacataaatatattatgttatcttataacaatttaggccaatcccaatatgagtttcattctcattaaacggggtgtcatgtcaatattatttatgatgtggcaagaaattaatgaaatggtcagatgataaaaccatgtcgacattgtttttaatacaacttgtatcttgtatgtattgtctatgaaacaagaaaaacaaaacaataaattgtatgagctattttaatcaactatatacctttttgcttatgtggaacttttggaaatataaaaataatatcttccattgaaaatggcattacaaaaatatatggttagtcacatccaaaatatatacagtcaagacaagccaagacaaaaccataaagttttatatatctactccaaaacaacgttttgaggaaggacccaacgcttgcttacatctgccatcgaaaaaaagactgagatgataccgtcaacaaaaaaaaaagtgacaaaccagcaccgaatttgccaaatcgagataaactacatcaggattttcaccctgaattaatcactagtattatgtgccatgtccgaataaaatgaacacaattggttgtatccactagaaccgactttagcaattaccaaccaatctttctgaccaaaacagaagatgctacccgcatggcacaaacacataccaaacagtgcccatgtgcagccattagggacgaagcgctagcctcctggatccttctctccttagagtaggtaaatagcaggctataaaccagctataaacatattataaaaagataaagaaagagagaaaaaagaagcgggctacagatctgtagccagctgcagcacggactctaagacgtaatatgtgtatgacagatgaaccagatattaatagtatagtaagcaactattgtatgaattgactattacattagctatagatgatttggagctcgtagtgggctatactattaaacttgctcttaagggcttgtacgggtactccctccgtttcaggttataagacgttttgactttgatcaacgtcaaattgtttcaagtttgactaagtttataaacaaatataataatatttataatactaaattagtttcatcaaatcaataattgaataaattttcataataaatttatcttgagttaaaaatgttactagaaatttggtcaaacttaaagcagtttgactttgaccaaatcaaaacgtcttgtgacctaaaacggaggaagtacttttttttcttctaaatataggtctgttcagtttgataataaaatgaaccttttcggaatttgataatgttaaaattttggtaaatcggcaacattgccaagttctactaggatgtgctcagtataggccctatttagttcctagggaaaaacttttcacctttatcacatcgaatatttggacacatacatagagtattaaatatagacaaaaaaaataaaactaattatacagattgcgtgtaaattgcgagacgaatcttttaagcctaattgtttcatgatttgacaatgtagtgctacagtaaatttactaatgacggattaattaggcttaataaattcatctcgtagttcacaggcagaatctgtaatctgttttgttattagtctacatttaatacttaaaatatgtatccgtatatccgatatgacataccaaaacttttcctaccacgaactaaacaaggccataatattatcaaaattctatggacattaccaaaattagatagcaaactacatatagctacataattattaattttatcaaataatgatatagtttaaaataccatcaatttaaacaagcctataatgatacgtaacttttttgcaggttcgggggaaaaattaaaaagatggagcacgtttccctacatgataaaatcgattggttttcaccgtccgctttttgtacgaatttggtcgcaagttactagagttcggctcttctggttcctatcatctcctccctcgttttccgtgcgcacgcttcttaaatgtctaaacagtgtattttttgcaaaaaatttctataggaaagttggtttaaaaaaatcataataacccatttttaaattttttttagctaatacttaattaatcgtgcactaatccatcactctgttttccgtatgggaggtaagggttcctaaccctcacctaagaacatttttctctgagggcctcttaaaatcaatttgatgcggtaatttttttttgtcaaaagttttgatagcaaaaaatttgacattgcaattttacaagttggtgtttagatgtatggtaaagtattttcattttaccattaaaaactgatttgtccatattaatggcaccttattaattgctgttgtctctgcactctagcaatctctcttgctgctgctagtgtttgtgccggagcgaaggaggcccttgtagctttccattcccggccacccatcatcgtcggagttgacgtcgaggggggccatgcctatcctgaagcactaccgttgtcggatctaataaagtggtacgggaagttggtgaaagggtcttacccgccggcgggggaaagtgaatcggcctgcgacatgaagtccctcgtgccggagccgtcgccgtccatctccggctaggtcttggactggtgcggcggacgagttcggcggaggtggaggcggatgcgggcatgagtggtggcagcgacgggtgagatcagcggaggcagagccggcatgagcggcggcgcgagcggagcaagggtgagagagcgagcggatagggaaatttttgggagcggatgagagagagagagcgagtgaggggcagtgcgcgtcccgcatggggcccaacgcttttttgccaaatttgctgctctggactcccaaatgataaatgtcaatttgtctactttttactactagtgtttagatctattttgctaaaatattgtccaaaccgacaaaaaaaaattactattttagtggatctaaacagatcctgaattttctttgtttgctgagctgatgaagaagtccgaggtcaaacaagagacaagtcacatcacttcaatttcttcttcaattttgtctctgcagcttcatcaccttgagagcagtaggggtcctatacgtcagtcacagcccgcacccggtcaaacgaagcgacagtacttagcttgacggagagcatctccgcagtccgcagccatggccacctttgcgcgccaccgcgtcctcctctgccgcctcgccgcggcgctcctcctcgctccggtggcggcggcccagccgtggcagttctgcgggcagggcggcaactactcggcgaacggcacctaccagtccaacctcgccgggctctccgccaccctccccaagaacgcctccgcgtcccggacgctcttcgccaaggacagcctcggcgccgtcccggacatcgtctacgcgctcgcgctctgccgcggcgacgtcgccaacgccaccgcctgcgagtcctgcgtcgccacggcgttccaggacgcgcagcagctgtgcccctacgacaaggacgcgttcatcgtctacgacctctgctacctcgccttctccaacaggaacatcctcgccgccgccgccgacgacgacgggagccccaggttcctgatgaacacgcagaacgcgagcgcgccggcggaggtgttcgacgccgccgtcgccaccctcctcaacgccaccagcagctacgcggcggagaactcgtccaggcggttcgccacgggggaggaggccttcgatgccgccgccgctactccgaccatctacgggctgtcccagtgcacgccggacatgtcgccggacgactgccggagctgcctcgggcgcataatcgcgctgatccctcggtacctcagccggaggaagggcgggagggctatcgggatgcgctgcaatttcaggtacgaggtgggtcctttcttcgccggaggctcgatgctgcggctcccggcgccggcgaactcgacgccgacggcgccaaccggaggtgtgttgcagacaaaggggatccacttcttttgcagtaatttatcttggtatttaattagcgcgacaacatctgctcataattaattttccatcaattttgacaaaatgaagacaaccaaacgactattgaagaagaaaactctaaacaaacttgtactatgtcttcaaattgtttctgctgtttaggtaaaaaatgttaccgcgttaagaattgtggtttgctttgcagtactgttgaattgcaaaaataacaaaataaaaatgtggggaaatataaaaatatctcaatcatggcaactggttgcatggggattactggtcaaaggagcctggtacgctggtagctatcacatattataaccctgtacacttttcttccttttttgggttgatcttgacatttctttagtcctgtttctatcggattcttgaccagaaacggcgaaaagcacgtcttactcaacatttccaactgcaatgcatttatttaccaataaataatactagtatgatgttttcaggaatacttttagaagtacttttccttatcacttgatcacgtctccgtcactttccataaatttccccacaatctttcatatttttatttgtattcaattatcctggttgtctactttgccgagatttgtggataccaccagtaataataaaaagaattgtagatctgatcactccagcgccagagctaggtgaatatggtttcatcttctcgtgtcttttccaattgagcctgattacttggtcagttcacacatttattccaatgtagtgttggtaattaactgcacttccattatgcaacttgtatgtatgtgctttacatgtaaagttcaacaatgattttggtttcctccatgttttcccgtttaattaggaaaagacacgagaagatgaaaccatattctaaaataccttttttaacagtaaaaaatagtcgtttataatatattgaaaattgcttgactttactagctttgcggtgtgctgtataggtcaaagtgttgacctgcactaaataagtttctggtgtgacttcgtagcatgtacctttttgaacagaaaccttaattatagtggatatgtgtcatcatatttaggttatgaattagtcttgttaagttctatacttctatatgtctgtcttcgcaacaaaaacaagttttatctgtctgaagctgaaatcacttgcctgcaggaagaaagaaaaataaaagtggcacagctctagccattgcattgcccctagttgttatattgttggctacggttgtcatttgtctttctgttcagaggtggagaaaaagatcaaggtcaaaacagcaatcttcatgtaagttcaccaacaattttgattatagtgagagggaaacagtgattccctttgattatttgaattcttttattccctagaaatgaaaaaagggtttcatagttggaaatgtcgacgttatatttcaggaaaagttaatatttcagttacattgcatcataatgttgttgccctcttttgatagattcaattcaaatggcggaggacattgaaagcacggattcactttttatcgatctatcaacactgcgtgctgcaacgggtaacttttctgagagcaataggattggtgaaggaggatttggttcagtttataaggtgccaatgcaatcatatatatcattcactttatatagtgcataactatgtacagcttcaataagcgagtgcttgcacttatgcagggcgtccttcctagtggtgaagagatagctgtaaagaggctctctatgagttcaggacaaggaatagaagagctaaaaaatgagcttgttttggttgctaaacttcagcagaagaatcttgttaggcttgttggtgtctgcttgcaagaacatgagaaattgcttgtgtatgaatacatgcccaatagaagtatcgacaccattctatttggtactattctcagaattcaacaattgcacaagcactactagatctgaactgtacatttcctttccaaaatgtgtttctttacaccccccccccccaaccttcttgaatcaggtcttcaacccaagccaaacacttggaattcacatgcccttgtcatcatgaatatatattagtggtaaaactgtagtttactaagacatttcttgttcaattgacagatcttgagaaaaggaaggagttagactggggaaaaagatttaggataataaatggaattgctcgcgcattacagtatcttcatgaagattctcaactgagaataattcaccgagacctcaaagcaagcaatgttttattagactccgattataaccctaagatttcagactttggcttggcaagactatttgagggtgatcaaacaagggaagtcacaagccgtgtggtaggaacatagtaagtattgtctaaactaacccaatcagatacaaatagtatgctggcatgagtaactttattctcttactgcagtggatatatggcaccagagtacgcgatgcgtggccactattctgtaaaatcagacgtctttagctttggcatattgatgatagaaattgtgacaggaagaagaagcagtggttcatatagctttgatcaatcatatgatctcctaagccgtgtaagtcctttttcctggactattctacaaagctaatcagaatgatctcctaacttgttacaaaaattctgaatcatctttgccaatatgatgcaggtatgggagcactggaccatgggaacaattttggagatgatggatccctctcttacaagccatgctcctcgagaccagatgctcaagtgtattcacattgggctactgtgtgttcaagataacccagcagatcgacctatgatgtcaacagtgaatatcatgcttagcagcaacacagtgtctcttcaatccccatccaagccatcatttttcattcccaagagtggtacagactcaaatatatactcggaatcatacccacaaacttcccaaccgacccataggtctgggatgatgtcagttaatgatgtgtctgttacagagcttgaaccaagataaataaatcaattttctgaatgaaagataggaaaatcaattgcaaggacaatcagattgctatctgtcaaacttacagggagaaagccttcgataatttgtattactgaattctgaatgcatttctccattgattgagtcaatatattatgttttagtttattcgttaattgttagtacacgtcacatttgtttacgatttggaaaagggctattcatcaagtgacagaaatttcaatgcctcccacttttcttatcctttggatgagatctaactatgctcatcattcccacaacttttctcattgtttctttttatacaggttgaacaaattaatctaaccatacaataaatttcaaaatgacgaacctatacaaaaatgtaaatacagaatactgaggtaacgtaaacccaagtacataaacaaaattgcagtgaagtttaactaaaattagccttgcaatttttggtgactacaagataataaaacttcaagcaaccaaaatttagcaaaaccttgtcaacaaaaactttacccttttctccatgcgcttctattaaaaagagcaattttacagtgcttgaggaggttccatgagttaccaaaaatttaatgtaaaatttggtacctcatattacctaggtaacaaatttacaatagaaaaagtaaaacctcatgtaatctcttcaaggaccgtaaaattactctctattacaaaagtttacaaatattttgaaatcactggtttgtagcacaggaactcaggctccatggagccactgaaccacaagttttcagtatattttgctgtctttgattcttttggtaatcagtctggtacattgcgttatatacttatgaaagcctaacctaacctggcaaagaatgcttcagcggaatggcagatcccacacagcgagcacagtttcaccgttgcacacttctacagttacttgccttgcaccgacgccgccgtcgacgtaccagacgacgtgccccccgagctggcaccggcaccgccggtgccgccgttcctcctggcacagaacgccggcttggacggcgccctgagcgacaccgtgtcgctgccgagcatcatcaccaccgacgacatcaccggccgatccgcagggttctcctgcacgcagagcagaccgatgtggatgcaccgcatcacgtcgctccacgagaaaccgccgcccatcaccgggtcgaccgcctccgacaccgccctcgccgtccactgctcccacacctgcacaaaaacgagtaatccagtcaattttagctaagcaatcacctcatttttccatgaacagacgagtaggatcatatggttagtgctcacaagggttaagaggtcttcggattgcagggagttgtagcagtcgttgttcttcttccccgtcacgatctccagcaccatgacgccgaagctgaacacgtcggacttgagggagtagttgcctcgcatcgcatattccggtgacatgtacccactgaaatacaacagcgtaaagtactattcattaactgaccatccaagcaacagctttcaacaaattgttatgttctctgtatttgggttactgccactgactatgtgccgatgacgaggttggtgaccccctgcgtctggtctcgcccgaagagcctcgcgagcccaaagtcagagatcttcgggttcatgttcatgtcgagcaagatgttgctcgctttgagatcacggtggactaccttgagctgcgagtcctcgtggaggtattgcaggccacgagcaatgccgttgatgatcttgtacctctttccccaatcaagctgttgacgcttgtcggcgtctgatattgataaaaaaacatgttgagagtgaatgatcagcttgatgttattgaactttgcagagaaaatggtgaagatatttagctaaaattgagtggattagtaagtttggtggtaccaaagaggatctgatcgaggctgcggttgggaacaaactcatagacgagaagcctctcctcttgctccaggcagacaccgacaagcctgacaagattcttgtgctggagctttgcaaccaatgcgagctcgttcttcagctctcccactccttgtgctgaactcttcgataatctcttcactgctatttcatcgccatcaggcagagtaccctgttcagaccaaatcaatagtaacacttagtaatgaatatatttttagtgatactttcttcagttatgttagagtcagcaccttgtacactgcaccaaatccaccttcgccaagcttgttgcgttctgcaaaacaccctgtagcagctcgtaaagtcgaaatgtcgataagcatcgactccacacttgaaatattctccgattcagcagagttgctggaatctgttcaagtataaatgccaatgtaagctaacaacttaatttgtttcaaattctccttgaaaaattttgcagggcatacatggctgagttgctcctgatcgtagcctctccatcctcctccagaagcagagccaaactagaatgttgattagcactaaagctgctatagtaggcagcaaaattgctagaaccaagcgaggaacattgtaatctttccctgtgaattgacagatgtagactaatttcagatcaaatgagtaagttgcaactaaacacataatcaatagcattacgcaagcaacgtgcaagagctgccagaagctaataggcaagtaccaacatcgcctttcagtcattttcaatctcatttgccatattcttgtcatgtatattcagaaaactgaaggaaaaaatatttttttattctgtcaagatcatttaaacaagagtaaatttcgtaaagagtaaattgtattggtggtacacaaacttgttaggtgggtacaatttattacataaacttgtaaaatcctcatttcagtacacaaacttgtctatttcgtgcgaacgaggaccaaaatatcatttgcttggtttttttcatctttttctactatcactatatcatattctattttttttattgaagaggtgtatgtctaatagcaaccttctcagatatatgtttacataatatcctaattagcccctaaatcaataagattagctatatatataatgtccttttcgccttcctccggacgcactagacaagttcatgcaccaacatgagcattttataagttcatgcactagattgcacccacctgacaaattcgtgtaccgccaatgcaattcactctttcgtaaaactacagatactttgcacgatttatcacaaaactacagattaagaacttgtttcacaaaaatacagattcaatgtcttcgtttatcacaaaactacatgtactttacacaatatattataaaactacatatttaagaacttgctttacaaaactacagatttaatatcttcatttatcacaaaactacaggtttagtgtctccattatcacaaaactataggttttaaaacactaaatttgtagttttgtgataaataaagacactaaatgtgtagttctgtgataaacgaatacactaaatctatagttttatgaaacaaattcttaaatctgtagttttgtgatctattgtacaaagtacttgtagttttgtgataaacggagacactaaatctttagttttgtgaaacaagctcttaaatatttagttttatgataaactagcatggtggctcgcgcagattacgtggctagcattattatattttctctcatataatagcatatatgttttcttaatgtattattcaaatatattaaaatgacaacataattttaaattttgtactaactttacgaaactactaatgtgtaatattcatattgtattttatatacgtgatagttattaattattcttaatattttttaaattctgaattttcgttatctgtaaattgtatttctatgtagactctaggctcttcttccaatatttttttatttttaattctgaatttttgttatttctaattgcatttctatgtggactctaaactcatctttcaatattctttaatttttaatttcgaatttcagttacttctaaattatatccctatattgactttagaatcttcttcccatgtttttttttaattttgaattttagttatttgtaaattgtatttttatatggactctaaactctacttttaattttattatgtttattccgaattttagttagttttaaattcctatatggactctatactctacttctaatatttattatttttaattccgaatttatattatttcctaattgtatttctgtatggactctatactctacttctaatattccttatttttaattccgaatttctattatttcataattgtatttctatatggactctatactctacttctaatattccttactttttaattccgaatttcagttatttataaattgtatttctatatggactttgtttttctttttctccgattaatatgagaatttctatgccgtgagagcgaacgtggaggctcctttttctattcctttaataagttaactagcatggtggcccgcgcagattgcgcggctagcatcattatattttctctcatataatagcatatatgttttctcattatattattcaaatatattaaaatgacaacataattttaaattttgcaataactttacgaaactactgatgtgtaatattcatattttattttatatatgttttagttattaattatttttaatatcaaattttagttatttgtaaattatatatattttcggtctgctagttgacgaagcggattgcatgaaaagatttatgtttgttaatctgctgatgaagtggattgtagtaaaaagattactgatgtgctaatttgcggcgagaaaatcatgcgattacttttgttatttatgtttttctaggacatgtatttattgagatgacatgtattgtgtacaattaaaaaagggataagtcaattaccgtgatatgggcatgcagaaattctctcatacggattccaaagaatcattatctgtttacacactatcattataatatcctttgtttttttttctatttgttctgtatagttattaattattcttaatattttttaaattctgaattttcgttatatgtaaattgtatttctatgtagactctaggctcttcttccaatatttttttatttttaattctgaatttttgttatttctaattgcatttctatgtggactctaaactcatctttcaatattctttaatttttaatttcgaatttcagttacttctaaattatatccctatattgactttagaatcttcttcccatgtttttttttaattttgaattttagttatttgtaaattgtatttttatatggactctaaactctacttttaattttattatgtttattccgaattttagttagttttaaattcctatatggactctatactctacttaaaatatttattatttttaattccgaatttatattatttcctacctgatttctgtatggactctatactctacttctaat

SEQ ID NO: 35218 - DNA, 24327 bp, Oryza sativa
  unsure (1)..(24327): unsure at all n locations
atattaaaatgacaacataattttaaattttgcaataactttacgaaactactgatgtgtaatattcatattttattttatatatgttttatttattaattatttttaatatcaaattttagttatttgtaaattatatatattttcggtctgctagttgacgaagcggattgcatgaaaagatttatgtttgttaatctgctgatgaagtggattgtagtaaaaagattactgatgtgctaatttgcggcgagaaaatcatgcgattacttttgttatttatgtttttctaggacatgtatttattgagatgacatgtattgtgtacaattaaaaaagggataagtcaattaccgtgatatgggcatgcagaaattctctcatacggattccaaagaatcattatctgtttacacactatcattataatatcctttgtttttttttctatttgttctgtccattttaacttttaatttttcttgtccgtttgcatgacctaatcctaatacacttggtgttttgtttttttctcttattttctttcgattaatgtgagaattcctaagccgtgagagcgaacgtgaaggctcctttttctattactttaattatataattattatataatagatagatagattgtgcaaaacacatatagttttgtgaaatttactctttaaacaaacattgcttctaactgctaatgccgtagccaatacagtgtgttgccttcagaatgtgcctctgtattggagcaaacctacaggcgctgactgaagaacaaaaccacaggctgtatgatgataggaacattgtgaagggctaaatgccaacaaatgtgacatcttatctacttggtgcactgcatctctaatcccacttggcctacgaattccattctttaattttattgttatttttttgtagatacactgaagctgacatactgaaaatgaaatgacactgtccctatacaccacccccacaaataaacaacacagatagatcacctaccgattatggctgtgttcgacacatggggttgggaacccatctactccgcacgaaaaatggagcagtctattaacgaggaacaggggttgggaacaccctgaaacaaacgcagcctatatgtgtatagtactccacaatgctagcagtgttcgttaacgactctcacaaggttaactaccagttgaattaatcaacggaagatcaatcacatcaaaccaacttcaggggacttcgctaatcatttttgtcaccaatggatgaactaaacaatgtttcaatcatttgaaagccatcacgcacgtgcaaaatctagagtaagcaaaaagaaaaaaaagaagcatgctttgactcaccttctccggccgccgccgcggcagcggcgggcggtgatgctgtcggaatcggtggcgcagtcagatgcaccatcaccaggccattgaggaaggggtttacctcgtaccggtagctgcacctgactccaagaaccctgccgccgatgcggttcgtgaacaacctcggcagcttggctatgatggcggcgaggcagtcgccgcactgcgccggcgtcaggtccggcgtgcactgcgcccagctgtacaccttggggaactccgactccctgtcgaggacggcctcgccggacgcgtaccggcgggtggagttgtgcgcggcgtagtcggcggtggcgttcaccagcgccgccaccatgccgttgaacctgcccgggtccgacgtgacgttctgcaggttgacgcggctcgtcgaggcggcgttgtcgacggaggagaggaaggggacgttggagtagtagaggatgcaagggtcgtagtagatggcggcgtccttgtcgtaggcgcacatgttctgcacgtcctggaacgccgtggcgaggcagccggagcactccgtggcgttggcgtccccgcggcacagcgccagcgccgacacctgctccggcacggcgcccaccatggcggtcgcgaagaggtccggcgacgacgagatgttccggggcagcgccgccgcgacggcgtcgaggttggcctggtacgtgctgttggccgtgaagttgcccgtcgtgccgcacacctgccacgggtacgccgcgccacgcggcgccagcgccagcagcacgacggcggcggtgagcagcatcgagaggcagccagcgcgatgcgccatggacacagctgacactgtcaagaggtggaggcaggcgacttatgtagggagaccgacgcgagaccggagttcgccggggagaatgggcctcaccttccgacacggaaatgccgacctcagccaattggcaatgcaagttgctgtacgtttatctgatgacgagaacttgacaagtaccagcggcaacgcagaggaaatgaatattctcaaacgacaaacagcgcaactgtaatggcgggcgagagctactgatcattgtctcggtcaaaaaccgccaattgcgcgtttttttcctgcaaaagaaaaaaaattgttagttaagctcaggctcagagttgccgcgcaaggttcgtccgtcaaagaagggaaagaggaattgtacgttgcattctgccggccgcggcaatgctcgcagttgtagtcgtcgtcgttgccgtgctgctgccgctcgccgcggcgcagcagaccatgcagttctcgtcatgcgccagcggcgcctacgcggcgaacagcacgtacgaggcgaacctcgccgtcctcgcggcggcgctcccgggcaacgcgtccaccgcgcggcggccggctacgccacggccaccgtcggcgcggtgcccgaccaggtgtccgcgctggcgctgtgccgcggcgacgcgaacgccacggcgtgccgcgcgtgcgtcgcggcgtcgttccgcgtcgcgcggcgggactgccccagcagcaaggacgccaccacctaccaggacggctgcatcgtccgcttctccgaccagcggttcctcgacttcgtcggcgtgaactcgccggtcagcgagctctactccgacgccgacagcaacatcacggccgtcccggtggcctggttcaacgccgccgtcgtcgcgctgatgaacgcgacggtggacacggccgtggccgccggcagcggcagcaacaacaccaagaagtacttcgccacggcggtggaggacttcgacccgaagcactacccgaagatttacgggatggcgcagtgcgcgccggtgatgacggcggcgcagtgccggagctgcctcggcggcttcgtctcgtcgatcccatggttcttgaacgggaagcccggagggagagttcttgggatttggtgcaacctgaggtacagcgtgaagccgttctatcagggccagccaatgctgcagatttctgcgccgccggagccaccgccgccggccatgccttcacttgctgctccgccgactagaacaggtaaaagaattgccttctttttcttcttcttccattgaagaaacgatacttttttctcgcaaactttgacactgcacatatcaattcaacttctctgaatgtctgtttgttgtatgcagcgaggagaaggagagttgcagggatctctgcaggcgtcgcttgcttcgttgtcttgatgttgatactgtcagcttatgctttcattcgtttcaagagaaagaaggctgcaaagaaagacaactgtaagtaactgatgagtagcttgatgtttgttcaggaactgttttcttattttacatttattgatatgtattgcattaaaaaaaaaacacaacaacagtattgaagaaaatggcaagaggaaaatgcacgatctttgatttggctacactgaaagaggcaactgagaacttctcagagaagcataagcttggagaaggcggatttggtactgtatataaggtactgttatgcaagcaaaatgaagagtaaaatttgcaggtcctttttcttatgagaaagagtctgtttcagggaaaattaccagacggccaagaaatagcagtaaagaagctcatagaaagttgtgggcatggactgaatcagctacacaatgaagtgctggtgttggcagagcttcagcacaagaaccttgttaggctacaggggttttgcgtccataaggatgagatgttgcttgtttatgaatacataaaaaatgggagcctcgacaactttttatttggtattctccctgatttcctctccaagtaatactaatcctgaattttgttcaatgttaattgatttcgtgttcataagatttcccattgctttatcaagtttaagaaactgttgcaacctggagattggaattatatttttgcaaattgcaacatgcatggtcaaaatgtttgcagtactaaatggtttttccatacagttatacaagcagaactgcaaaccaaataagtaatcactgttctaacaacgacgttgcaaaaaggaccatagctaagactgaaaaattcagtaaacattttctcaggatttctttctaagaaccaagttgcaaaaggatcataaagttgttctctacttatcaatcagagtcactgcctgatacaaactaaccactttgttgcagcacatgctagtagaggaaatgcactaagttgggaccaacagtacaacatcatttttggaattgccaagggaataatgtaccttcacgaggactcaagcataaggatcatccacagagaccttaaagctaacaatattctgcttgatgaggatatggatccaaaaattgcagactttggactagcaagactgataggaggaggtcatactcacacaaagacaactagaattgttggaacatagtaagcttatgtattcaattcaaatcgctgggaccaaaatgtgtgcttctatgcctaacttctcatcatctgcagcggatatatggcaccagagtatgcaatacatggaaatgtgtcaccaaagattgacattttcagctttggcgtgctggtacttgaaattgtaaccaagagaaagaactgcagctatggcgatggcaccactgacacagtgaatctcctaagtgatgtaagtgcatttttacatactacattgcggtatccacattcccatttctaaaacaaacataattgaagaaatatattcaaaaggaaatctttaattgctccttgaaggtattaagaggtagtatgtcctagtgttaatcatgagggacaagagatgtgaggatcagaataaaatggaagcaaaattaactatagtatatacttctaactctcaataacttcaaggaacatgaaaaactccttcagaaaagattgaaaaactgataagaacacctgacaggtatggagttactggaccgaaggtgtgatttcacaggtaattgaccaatcacttgaagggcactttcgaaaccaggcgctaagatgcatccacattgggctgctgtgtgtccaatcagatcctgacgacaggccggacattccatcagtcattttcatgctgaccagggataacatggagcttcagccaccaacagagcctgcattcttcttcaacggaaactcgaactcagcttctcaaacatctgaccagcgcgtctatgtgtacgatcggtctggtaagatctatgaagaggatatctctgcgaatgggatcacacttactgacatatatcctagataacccttttagtttttagtttttcatagataagtgaaatgtgtatgcatctaaagtgatcaaaggcgaacttcgctagtgtttggtccttgaattcgaagtcagatgcagatattctgcctattgaggtaacattgtaattttatatggtcagttatctcatcttatttgcagactcgagctattagtgatcttccagagtatcgccatatcatcgaacaccttgtctgcactaggttgagttctagatttgtagcattcagaccagctataatcaacgaaacaggcaacctggaaagaaaaaaatatcacaacaagagatattcatatcatatcctacggaatgcaaaacccgcacctgctctgctcagcctgtcccggcatcccgggctcccacggcacgccgcccttcttcttgctcatggacgtggctccaactctcctccttgtctagtgatctgcatttccagtggtgctgccgatagcccttccggtccacggcggcgcatcaccccgtcgcctccctggcgaacggcgaaccccccccccccccccccccttttggccctcctctccctcctcgccgngctcgatcgatgatatcctagttggtaggcccatcttacagcccatgaaaattaatcggaaggcccatttgacagaacagcccatacgagtaatgggccacttttgatcggaggaggatatttctgaggtgaaaaaaaaagaggaaaaagtacaccagaggtccctcatcttgtcatcgattacaaaatcgtcctctaaccgcaaaaccaaatatatatcatccttcaacttacgaaaccggatcactttagatcctcaggcggttttgattctggttttatccgacgtggcagttgagtcagcgtgggccccacatgtcagtgagatctgagtctcttcttcccctttcccctctcctcccctcagcctactcacgacgccttctccatcagccgcgtcgtcgcgacggcgcctggctcgtcggggaggccgggcggtgtgggagggcgggtgcgggaggccgtgcagcactggcggaggtgggtggcgcgccgtcgctctaggtggagaggcgacgaaggacagcggcgtgggatggctggccgcgcatgtgtggtggacgccaaggctgcaaagggttgtgcggtgaaggccattgcgaatggtggccctgtcctcccttcccccacctcatccctgccgtcaccggaggagccaagcatcagatagggatagtgacggcaaggtggcctaaggcctgagggtgccgcaacaacgagcagcagagacggaagagcgaggacgtcatcgtcatcatgttgcccgtcgcaatggggggaggccctctcctcccttcccccacctcatccccgccacccccggaggagccatgcctcgggatggggatgccgacggcgaggtgccctggggccgccacggcaacgagcagcggggacgtgagcgcgatgggaaagtgaggacgccgccgtcgccatggggggaggccctctcctcccttgccccacctcatccccattgccgccggaggagccaggactcgggatggggatgccgacggcgaggtgccttggggccgacacggcaacgagcagcagggacggggagtgcaacgggagagtgaggaggccgccgtcgccatgaggggaggctctcttctcccttcccccacctcatccctgccgccgctgttgcctcttgcttcgttgtcgtcaccgctgccgccgcgtcgcccgttgtcggtcgccagctgtcggacctcctcctctcccgtctcggctcgccagcctcttgcccatccaccggccggaccttctcccacccaccggctagctgcccattgaggagaaaagagagagagagagaggggaggaaaggagaggaggggaaagaaagggtgtgacgtggcatcctgacatgtggggcccacgtgggtcccacgctgactcagtagccgcgtcaaataaaatcagggtcaaaaccatcgaaggacctcaagcgaacggttttgtaagttgagggatgtcatatatctggttttgtggttggaggacgattttgtaactcgatgactagttgagggaccttgggtatactttttccaaaaaaaatcaattttacctctctcagtctcgactatgggcttatgtaatccaattcgcatccgtcgatcacaaacccaccattggctttcgcccccatcgtgctgatgctcctaaagtctcaccggaatttcgccccaagactccaacgccatgcatgccatccatagctagccagtctggcggaaaggaaatgtttgactccacttacgcgttcaagtcgccgcaacgtgctaaatgatgtcgcaccgactagactacgccactcgatttgacgtcggccgccgcaactccattttggtgttccaatttacttgacaaaaagaaaaaaaaattctccccttcccccctttgctgcgatgatgctcgccggctatggcatcctcgccgttgtcctcgtcctcctgccgccgtcggccacgccggctgggatcgctgactgcgacctcggcgtcggcaacacgtacgtgggcaacagcacgttcgaggcgaacctgaaccacctcgccgcggagctccccggcaacgtctccacggcgcataccggcggcttcgcggtcgccaccgtcggcgcggatcccgaccaggtgttcgcgctggcgctctgccgcggcgacgtgaacgccacagcctgccgcgcgtgcgtcgcggcggcgttcgtcgacgggaagaatgcttgccccggcatcaatggcgtcaccgtgtacgaggacgcctgcgtagttcgcttctccggccagaggttcatggatttcctcagtccggatcagtggcaggtcaccgagatgatgtacggacaatctacatatctcccttctttcgatctcttcctgctagaatcagatagactaattcgagtagctcgttacaaacagttgggttcccgagcaagcctcggagagcgtcaatgcgccggcggttggctggttcaacgccgccatcgcgaagatcctcgccgccctggtcgaccacgccgtggccacggcgacgggcaacaactcgaccaccaagaagtatttcgccacgggtgaggaggacttcgaccccaacatctacgggttcgcgcagtgcgtgccggacctgacgcaggagcagtgcaaggaatgcctcaacaccttcctttttcaagcaaaacaagtgtactttggcaagagccttagctgggttggtatgaattcggtgtggtgcagactgatgtatagtgtgcggccgttctacggaggccgggcgatgctgcagctgtcggcgccaccaccaccagcagccgaggctccggttctatctctagagcctggagcaggtatggagtatgacctactctgttcttcatttttcctgaagaaaaaaaaataacagaagttacagtgaaatcaaggtttccccaattgaagttcatgtttggtgtttgcagggaagaaaaagagtgcagctggaatcgctgccgtcgtcgcttcttcagttgtggtattgttgatcctttcattttttgcagttgttctcttcaggagaaggtccaaggttactgagactgaccaccgtgagtagcatacagcctctgttcagtagctcgaatttactgttcactgacataatccttgtcatatggcaacagagttgaggaagataacaagagcacaatgcttgatttttgacctgccagctctgcaagaggcaacggataacttctcggacaataataagctcggagaaggtggttatggtattgtatacaaggtaaggttagcacccaaaaatgtaagagaaatgtttgaaatgtattatgcattagtgatcaaacgaagattaaattgcctgcaccaattgtgttcagggagtactctcagatggacaagaagtagcagtgaagaaacttttgggaacaagtgagcatggattggatcagctacaaaatgaggtgttgttattggcagagcttcaacacaagaaccttgttaagctacaagggttttgcttgcatcagggggaaacactgcttgtttatgaatacgtcaagaacgggagcctggataactttctattcggtaatttcccttctaatttatcatttcagaagcataatcataactctatcttcgtttgtcaatgtaaaaaaagattgcagtgctgatctactttgcaagtacaaaaactcccccttttctgtatgcacagacatatttataatagtggagtcgctgtactataaacactaacatcaataagaataaactgagcaatgcacaactgcaagttagtgtggggtactgaatatgtactgtagcatttctgacaaacaagttacatggctaagaatagaatttgacgtattataggtgagtgattatgattaaattaaacatttcatctcaacagataccagtaggggaaacacaccaaactgggagcaactgtacaacatcatttttggaattgccaagggaatattgtatcttcacgaggactcaagcttgaggatcattcaccgagacctgaaatcaaacaacatcctacttggggaggacatggaaccaaaaattgcagattttggattggcaaggctactagaagaaggtcatactaatactcggacaactagaattgttggaacattgtaagctcatgtgcataataaaaccttcactcatagagatattgaatgtgcaagcctaatgcttatcctctgcagcggttatatggcacctgagtacgcaatacacggaaatgtgtcaaccaagatcgatgttttaagttttggtgtgttggtccttgaaattgtaacagggagaaggaacctcaattctgacgatcatgatcgcgggaatctccttagtgatgtaagtgctcaataaggttgagcttgctcctgtacatatatacttttagtgcatttacatactgcaatattcatgatatcatacccgaaagtactctatatcaagttttagataacaaactaatttcaaatcgtctaacaggtctggaattgctggacaaaagggacggttacacaactaattgaccaatcacttgaagagcaattccgaagacaagcactgcgatgcattcatatcgggctgctgtgtgtccagtcagatcctgatgacaggcctcacatgtcatctgtcattttcatgttgagtagggaaaacatgaatcttcagccaccggcacaacctgcattcttctttgatggagactcaaactcatgttctcaaccctttgagcaacccgtgtataatcggcctaatgcaatctatgaagaggatatctccgtgaataggatgacagttactgacatataccccagataacccttccccctccccattcctaatcccccctttcccagtggcgcaattgtcaccattgtttgtcaacttcattgaaccatctgcgtatggtttgatctgcaccttagaaggcacatttaaatattctagttgttgtcattacattatattcttatatggccagttatcttatgttctttgcacactctgaactaatgttcctaaacatggcatatcatcaaacaccttgtctgcagtctgcagtaggtagagttctagatttgtagcatataaatgaacaactaaccatcgaaacaggtaatttggacacattaacaatataatgtatagcagtgtaaggccttgtttgggagagggagcaattattagaaatcgttgtttttccaacttttggcttagttaattttctaaagtatgtagtcgctggttctcatagtttgagcacagaatatggactatttaggcagctaagtgtatttgcattcccaaattttccattgcactctaggagtttgatggagtttattgtacattttattctgcattgtgtagaaaggaattttattcaacaagagcgaacggaatacacttaaaattcttaaccagaatctaaatacaatatcatccttattttctcagcacagtaatacggggctattcttcaatcccactttcattattgagcttctggtaagctaccttcggtcttcagtaaaatatgttcattgaagaagtcttgcttggtgggagtacgcagtttccaattcctatgaatgattgaacaaacgctaataagataacaattaacaacacgaaataaaagtatgcataagcgtgtgaactcactcggtgcctggttgacgatggaagcagcaccaccaaagtcacacgagccacttgccctgccggcagtctggtaatagtcattgaatgcataggtcgcatgcgccaccttggtgttaggatcaaagcaccgtccaccaggctggatggcactgcagtctgcgcagctactgcatgcatagtctagtgctgcctgtaaccgcatgtccccgacctctgcgttcgccacgcaccaactcgggttcgggtcacagatgcctaaatcccaacaaacaattcatatatagaacatgtaaaacataataagatggatatcacaatatgaattgaatgcacaattgcaaaagcttattgatcttaaaagatggccattgaatggaaactaacttggtgatggcttgtagacgatgtaagcagcaccggcaaagttgcacgcgctacttgccttgccattacgctggtagtagtcattgaatgcataagatgcatgtgcaaccatggtgtttggctcatagcacacttttccctgttggatagcactgcagtccgcgccgttactacacgcccagtccagtgctccctgtagccgtgcattcccaatagctgcatttgccacacaccagctctcctttgtgggacatgtaccaccaccatgaaagtcaacatcgtacaccttcgtcccatccggatagaacaggccgaagttgctctctatagatggcccacccttcttgttctcgttgaacaaagcgaatatgtacgcagaaacatcctccatattggaggccccgaacaagactcgcttggcaaggccattgttgtatgcttgagcgttagctttagttgccaccgagtccccatcagcattggcttctgtgacccctgagcggattctaccaccagaggggtggcctgattctgaaactctgatgggcacccgtcctcctgcttgggctaacgaggccctctcgttactaccagaaaccttgtttattgcatagtaaactgcatctagctcggcatcaaagagactgtaatatgtgacgccgctcaccggatcgaacacaccagcattgggacggaacgtggcgtactcgagggagattccggtagaaggatccgcatatgcaaagaatgggtagagatttaccataaagtacgagtcagtctgctgcaagaagtcgatcatggggctcatcaccgactgcgcgatgtcatcccggaaagcgcctgcggacggcgggaatgacacctcgactgagctgaacgtgatcggggtggacacccttatggcatcggcgaggcccagcctcgccagcgccgcgtgcacgttcctcatggccggcaccagctgctgggtcaggtgaggcgcctgatcgaacacctcgttccccacggccacgccgttgatcagcgtggccgggtagtagggcaccacgctgctctccacccacctctgtgcgtagctcggatcccagccggcggagcccagatcggtgttgggtagcgccaccatcaccttgatgccggtgttcgccagcgccctcagcaccgccgggtcggcgtcgaagatcctcaccatcgtgatgccgttcgccctgagaaggctcaccacggattgcgggtccatcagattgtccgcgtccctcccgtagcacacgcccaactcgcccgcatctgctgtgtgcaaattaagaacaaacaaacgacgtcgttgtgattgttaattacgaaagtgagattaattacctttcagccttaatttgtagtttgtacatctctgatcgagttaattacctgcatgggagagaaagagcaacggtaatgcggtggctaagagaacgcggaggaggtgatgagtgagcgccatctctagtcctgtttggcgccgtggcagactgaggatagtcgaattccactgtgtgactgtgtgagcagtaaatttataacgagcagtatatatggccgtcgtttaggagctagcgcgatacaaggaaaataatagtacctcccttccaaattagttgtcgctttaactttttacttgtaatactattcatcttatttaaaaaactagtgcaaatataaaaaatataagtcttacttaaaaagtactattgagcaagtcataaacaaaataaataataatttcatactttttttaataaaacgaatgatcaaaatgttacaaacaaaaactcacaacgataagtattttgggacgaaggtagtacaattttgatatacatgtgttgccacattttcacgtaaaataagttgaatttgtcattgttcgatcaatcatctatgttcgtgtatcccggcatatgctttgatatgccgccttcattgatttttctcggttgactatcttgtgccgcactgccgcctacgaccctgcgtctagcctgtctggttgcacgtgcaccacttgagattttcttcttgatgataagaatgccagagtactgggttttttttggtgaatatattaatgtatggttgtgagtttggttgcattttattaataacttcatcagtttcaatatataagtatatctaggatttcagttttgttcaataatataagcatttgtaccactatttacactacattttatcacataaattattttccattcaatatttttccccatcttaatcccaaccatcctcccacacctaagtctctaaccctctcttttttgttgagaggcaccaaaatcttttctcctcaattttaatctctgtgaaataatttagaaatacttatattttagactagaaagagtatagcatctagcgtatcatagtattagcattccaggtcacggatcccaatgcctgaaaatctaaagtcttgtgtgtaatgggcctcttttcatccaaggggatatttctagccgaacaaatattgattatggcccatcgaacagaaaatcccatgtataaggtgagtaatcttagagatatgttggcctgcattgagcggaataagttcacttaaggtcccttaacttgtcaacgaatgccgaatcggcggaggccggtgagaggggatggggtggggagggaggagcgtcaccggccaggcctcttcgcgcactggccaccgctgctgagcccgcgggtgtcacggtccgctagtgagcgcacgcaaagggggacgagcaatggtgggtgcgtgatggaaaggcggcagaggtagaggtagcggcgcttgttggtggcagtatcccggaagccgacctcgccttcctcaacctccacggtcacccgtcgccaccaccaccttcctccgccgtcacccacactgattcccgcctcccctcggcctccccgcaatcctcttagcacctcccgttggtctcccccccgcccctaacgccatcgtcatctgatttccgtcaccgggaaaggacgagcgcccggtgccacggtcctccactactccaccagcctcgtcggtgtgccgctcgctagcctcctccacatatgttgtcgtggatgcttgacttgccaattgggacaaggactggtgcggtgaacgtggttgtggctggcggggaaggaacacggcggtggctctcggccgctcctacgcccacaagctcgccgaggttgaacgcttccccgaatgcctccaccgacgctcagatcctttccgccggccgccactcctccccaatgccgccgaccgtcgctcttccccaacgcttgagactggcgcggatcttcttccaccctctctatctcttccctcaaattctccccactgctaccaccgacagcattccttggaaccacccgtgctccaaccccagcgccgctacagccaatgccacttcccagcgcccctattggggaaggattgcgaccttgcaccattcaacccctattggctccggaggaggtagggcctctaggggcctgccgccaacgccctgcggagcccatctccacagggagggccctgatcgaacgcctaggaagctgaccgagcctgaagagggcagtcggctccgagaagttcggagccaaccaaagggcctcggggatctcggagcccagtcaaggcccccggagccccagagccggttcaagggcctcggaggtccaggagccagctcaagtgttccggggctcttgccatggctccgggcccggagcctagggaggacaccgggaatgagtatggggtgccataaaagcgcactactcatctcccatccaccaccgatgttacggcacgactagcgatgtgaaggccgatgctagctattacccgagtaaaggctagcatcatgctagcgccataccgctccccttgatgggcaccgccaactctcggcctggtgaatggaccctcggaccattcgtcggcccacctctcagccacctcggggtagctacggagataggggtagggttgtaatttcctttacatacaacctagtataaatatgtaaatgttaccctcggaaggggggatagaagctagacagacacttattgcacacttgtgagttctgttccaacagccccctcctcttccgcccatagccagtggagccatgccccctcatgtcacccataggctatagctgccagagccgcgccctcgaagccaccctcccccctccccctacctaaccaggctgagatagagaaggagaaggggatgatatagagaaaaggggatgaggtggaggaagttggggcccactgacacgtgggtcccactatttttagtatgtattatttgactgacatgtgggcccatatattttattttatctttaaaattgttaaatttcacttcatatatgccatgtcatacgaagactaagtcaaattagccatgtaggcgtcacgtcaactaaaatcgccatctaaaccatcatgggacctatattacaccggttttaatagttaagagacccgctgtatttggttttttggttgaaggatgaaaatcgaattcattgacaaattaagtaacctcaaatgtacttattccttcattccgatgctccatgtaatgcacgtgggcttgtacaaaaattgtgcaaacttttcatgattcttacattgtccgtacagtagcacaatcctcctttcagagtgggagccactaatcagcagcgcaagaagttccatatcctggaccgatcgaagctctctctatgacaggttctacactgacgcggtcgactcgtcggacgcgacgccgggtttagcgccgccgttcctggcgaagaacgccggcttggagggcacctggagggagaccgtctcgctgtcgagcatcatcaccaccgacgacatcaccggccgatccgcggggttttcctgcacgcacaggagcgctacgtggacgcacttccgcacgtcgctcgccgagacgtacctgctcatggccgggtctaccatctcatccacggttccggccatccaacgctcccatatctgcatcatttttgtagtgcagcatcacacatagatcagccaaactgcactgtaatctgcagagtgcaggttatcagatgttcagagatatgaactactatgttgtatgttcaccgtgttcaggagatcttcagattggtgagagttgttgtagaagtcgttgttcttccttcccgtcacgatctccagcaccatgacgccgaagctgaacgcgtctgacttgacggagtagttgccacgcatcatgtactcaggtgccatgtacccactgcaacagcaaagataatttgaagtcatgattagtcactacttaattactggatgactgaacaactactacagtttatgttgttactaactatgtgtcgacgacacggttcgtgacagcctgggtctgatcttgaccgaaaattctcgcgaggccaaagtttgagatcttggggttcatgttcgcgtctagcaagatgttgctcgccttcagatcacggtggactaccttgagctgagagtcttcgtggaggtattgcaggcctcgagcgacgccgtttatgatcctgtacctcttttcccagtcaagcttctcgcgtttctcagtgtctgacaatgatcaaagagaaggtgttaattaatagatcaatgcgatgatatgacatcaatctttgcagagaaaacagaggagagaattggtaatgtagactcaattagtagtagtattgttaccaaagaggatcaggtcaaggctccggttaggaacgaactcgtagacaagcagcctctcgtgttgatccaggcagacgcctacaaagcttacgaggttcttgtgcctcagcttggcgaccagagcaagctcattcttcagctcttgaactccctgtgttgagctctttgacagcctcttcactgcgatttcgttgccgtctggaagaacaccctgtgaaaagattcaaaatatgctaattaaattagttttggtttgtaattcagagacttgttttttttttccctttttcagtaccttgtacaccgctccaaatccaccttcaccaagcttgttgctctctgcaaaatccccagttgcagctcgcagagtagaaatgtccatgagcatggagtctacgctgtcaacgtcatctgcttcagcgtaatagttggcatctgcataaacgtcagcatcacaacaattggataagttttttttttttgcattgtcagctgaaatgattaaaatggagaattttgtaggacgtacttgtctgctttgcttttgttattactggacgcttcctcctccagacacagaagcaaacgacaaggtttacggctgctattatagggagcagtattataagaaccaggcgcggaaccttgtactttgtctctgcgaattgaccaattcacaaatttccaaggttatcatgttaaaacatgtcgaattgtatggacagattccgtactactgtactgtactactccccttatttcatgctgcaagtcgtttaattttttcttagtcaaattcctttaaatttaacaaaatatataaaaaaaatatattaatattttcaatatagaacaaacatattactaaaatatattcaatgttaatgttgctaaatttttctacaaacgtgatcaaacctaaataatcattttagataatagaaatgacttacaacctacaagtactcagaaaaaaattaaatgacttaaaatatagctttttcttggaaataatttttgccgggttttcttggaaataataaacgtgtagttgactaattgtgcaataatgtcagtaatgccgcccgaaagtaatacacacttcgactcacctcgtcccggcgtggccgctgaaggcgtcgcgttgaccggcggcgccggagacggcgccgatgtcgccggtagccgcaccatcgtcgtgccattgaggaaaggcttggtctcgatccggaagctgcacctgacggagagggtcctccctccgatgtcgtccttgtacgaccaaagctcctgcgccacgatcttggcgaggcagctccggcacctcgccggcgacaggtccggcgtgcactgcgccaggctgtacaccttggggagcgccgcgtcgaagtcggcctcgccggccgcgtaccgccgcgtcgagttgtacgccgcgtagtcggcggtggcgttgacgagcgccgccacgaggcggttgtaccgcccctgctccgacgtgaccttgttctcgttgttcaccgtgtacgcgtcgatcctcgccgggtcttcgccgccggcgccgccggagaggaagttgatggcggagtagctgaccatgcaccggtcgtagtaggtggcggcctccctggagttgccgcacgcgttgggcaggtcggcgaaggcctgggtgaggcagccgaggcaggagctggcgctgacgtcgccgcggcagagcgcggcggcggtgacctgctccgggacggcgccaacgtccacggcggtggcgtagaggtccggcgacgacgaggcgttaccggggagcgtggcggcgatgagctggaggttggcgaagaacctgctcttgggcgtgaaggtgccgaagtcctgcccgcacaccggccatggctcgccggcagcgcggggcgcgagcagcgcgacggcgacggcgacggacaggatgagacggcgatccatcggggtatttccggcgtgcgcaaagaggagctcaatccatgttcgttcccacggggatggactatagtagtgagtaatctccgtccaacacggcagagagacagagacgaccatacaagtcgtccctgattcttgaaccaactttgtcgcttaacaatggatacgattgcatccagctagtcgagatatagaaaatccatgtctccttgcacacactagtacaaccaagataccggtttagcagtgaatttgaatatagcgtagggagtatctctgctcaaagtttttgaattgagcaaattttatagtttttaagaggtgccatgagatacccaaacttttaagtacaaatttagtatctagtcgtaccagagataccaaattttgggtcttccgaatggacgcgtgagttctagctgcctaactggtgcagccgcgcatgccccctatctcgcctctcctcagcgctaacaacgctgattagtgttgatgtcattaattagcgatactgataattgttagtattagttttttatttaactctgatttggaaaacttttaaccagatttgaaactttcaacccagatttgaaaactttcaattcagataaaaaaatttcgacccagatttgaaaactttcaattcagatttaaaaactttcaacttagatttgaaaactttcaagtcaagattttttaaaaacttttaactcagataatgaaaaaattcaagtcaagatttgaacaccttcaatttatttttttcaaaaaaaacaacttagattttgaaactttcaaatctagatttgaaaaaattcaagtcaagatttgaaaactttcaactcggatttaaaaacttttaactaaagatttgaaaattttcaattcaaatttaaaaccttttgtctaaaaattcaaaacatttaactcaaatttgaaaactttcatatctaaattaaaaaaaattcaactcaattttttacctttaataatttttaactcaaattcaaaattttcaactaaaattgaagatgaaagatttcaacttctaaaattaaaaaatcacgaaaaaggaaaaaataaaaaaaaagcggacgttagattttttatgggaaaaatatacggatgtggacactgtccgcacgcatacgcgccagcgctaggccttataggcctgaaacgcgcgccgccaacgcgcaagcgcgaattagctatcgcgccaaattttatattagaaaacgagatttgctccggtccaacaaaaagtatctcgagatgccggtacctcactgtaccaaattatttccgatcgttggatctaactggacaggatggatattgttagatccaacgatcagaaacgatttggtatcacgaggtatcggtacctcgagatactttctgttagaccggagcaaatcttttagaaaacatagtgtctcccgatactttcataaaaactgtataatcactcttttgaatttgtttgaaattagcaattaattgttgaaatcagggaaaacgtattcaaatttcaaggtgaacacgcttcattcgggccaccaactgaccaacctcctctatcatcgattcatcgtagcggaaagaagtgacagtagtgcgcaggcggctatggaaaaggaggcgatggagtcgcaaaagccaaagaccaaagactagtcgatgacttcaccggccttgggattcacaggcttccagttgcaacttgcatggcagcgataatcacgcccaatgtgcaatgcaattcgcaataatccaagtattgcaacttgtaatcaagtggcaatgttgcatcgcatcagtagcgaattaattatccacaaatttgcaaactttgcaagtttgtaggcgactggccaagtggccaggcatgctaattggactcgtcaaggtattcggctcaccagtggtcatccaagaccgtgacatgaatgggcatatggccatgaaaaagaaaagaaaaatcaagctccaaacttaccactagcaaattagcaatatggagctatatggagtctgtttagcatagctctaactctaactttaacttttctgaaattgaagcccagtcaaacagtttcacctccattcaaaaataagagtggagtcagctgaagcgcttttacaaaacgaactagacgggtgaagccggcttcatcctgtttcacaactccacttcagaatcaatttttagagttacatttagttgttgtagccctatcgaacaagtccatagaggataaaaatggattgcttccatttattcagttttaagaaaggattttaaacatatgctcaaagctcgtgttttacattcgtttgagaattccagggcaacatatatataattattttacagttgactaaaaataattcgaattttcagtacaaaattatagtagaaaaaagtatatgataaataataaaacaagcaaaaaactacacttcacaatttatttgaaatcccatgatgacttttatgatccaaactagctagaaaaaaatgaatgtttatactaaaaattctttcagaactatttgccgggcgaatcacatgttaatgactagatttagctaaaccagatcaatcacagttatagccgtgttgcccacaggatggaggagaggaagctgattctctacccaaaaagaatgcaggttctgctggtggttgaagcttcatattttccttggtcaacatgaaaataatagatgacatgtgtggcctgtcatcggggtctggctggacacaaagtagtccaatgtggatgcatcgtaatgcttggctttcagagtacccattgagcgactggtaaatcatttttgtagcagtcccttttgtccagcaattccaaacctgttaggcatgttgacaaacttaagagattattactttcacgtaaaaatcatcaatatagcagtgttctccccaatacactaaaagtagaaccatattggtgtgagctaagggttattaagcacttacatcactaacgagatcatgatcgtcagaatgccagttccttctcctcgtgataatttcgaggaccagcacaccaaagctaaaaatgtcgatcttggttgacacatttccatctattgcgtactctggtgccatataaccactgcagagggtaagcattacacttggaaacgtacatccaattaatatgtgctattaatgaaggtattattatacttatgagcttacaatgttccaacaactctagttgtcttagaatgagtatgaccttcgcctagcagccttgctaatccaaagtccgcaatctttggttccatatcatctccaactagaatgttgtttgattttagatcccggtgaatgatcctcaagcttgaatcctcgtgaagatacaatattcctttggcaattcccagaatgatgttgtactgttgatcccagtttagggcattccctctactgggatctattgggacaaatcttcaacttaatcataattacccacattcaatagaattcagaaagtggcaaagtgcaaattctggtcttagttatgtgatttgtttgctggaaatgctacagaacatatttagtgatactgaggatatttacttattgagtatatatgtttgtcatttgtgaacagatgaatgagaaggcaaaattaccaaatagaaagttgtccaggctcctgttcttgaggtattcgtaaacaagcagagtctgctcctgatgcaagcaaaatccctgtagcctaacaaggttcttgtgctgaagctcagccaacaacttgatctcattgtatagctggtccaatccatgaccagttcctaaaagtttcttcactgctacttcttgtccatctgagagcactccctgaacatattgtttttcacagggagcaagcaatataatccatcttttggaaagtaatgcacaatccatttgaaaattttctctttgtatttttgcgtgctaacttaccttgtatacagcaccaaaaccaccctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 35219 - DNA, 834 bp, Oryza sativa
gattggtgtttccgcctgcacggctggcctattatgccgccgttgttgggcgtgtacatcttcaccgaccggccgcctcgtccgccgccgactggtgtttccgcctgcacggctggcctattatgccaccgttgatgggcgtctacgtcttcaccgaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgccgttgttgggcatctacatcttaatcgccggtcgtctcgtctgttgctgattagtgcccttacctctacgtctggtttatacagctaccactactgatggacatcatcatcttccgtcgccgactgattatgccgccgccgacttgtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcg

SEQ ID NO: 35220 - DNA, 593 bp, Oryza sativa
  unsure (1)..(593): unsure at all n locations
gtgccaccagatgactgtccagtaccaccagtgcgtataaattccaagcgcctagcggcgtccttgattcgaacaaagcatttgcaggtgaatgggtcacggaatagcgcacaagcagcataccacacacttcctccaatttcatggccatcattttccaccaactccatgcacgcatcaaggcccatagacttctctgcttccatctgagcaacacgactctggtagctctgctctcggatgtccgcaatcctcnnnnnnnnnnnnnnnnnnnnnnnnnnncgtgacttcttggaagaactccctgaggcagtagtgtttgctgctggcctctttcccttgccccggtctgctgccgttgggggtggagttggaggtggtggtctataagcagcagcgagctgcgccatgtcgatggtctgccactgaactgctccttgcggtgcctatggggctgcccctgcgacggcggagtggtttctgacaactgtgtgcccactgaataccgcgtggtgaaggtcaatgtgcttcagaggatcattcctgaagcttaagacacctttattttgctgcaacataagtagacagtaaaa

SEQ ID NO: 35221 - DNA, 394 bp, Oryza sativa
  unsure (1)..(394): unsure at all n locations
ttcaccacgggggattcagtggggcacacagttgtcagaaaccactccgccgtcgcaggggcaggcccataggccccgcaaggagcagttcagtggcagaccatcgacatggcgcagctcgctgctgcttatagaccaccacctccaactccacccccaacggcagcagaccggggcaagggaaagaggccagcagcaaacactactgcctcagggagttcttccaagaagtcacgnnnnnnnnnnnnnnnnnnnnnnnnnnngaggattgcggacatccgagagcagagctcccagagtcgtgttgctcagatggaaccagagaagtctatgggccttgatgcgtgcatggagttggtggaaaatgatggccatgaaattggaggaagtgtgt

SEQ ID NO: 35222 - DNA, 93 bp, Oryza sativa
aaaaaaaaaaaggtcgtttcgatgtcgagcgatcatgatgatgatgtcgacccgggaattccggaccggtacctgcaggcgtaccagctttcc

SEQ ID NO: 35223 - DNA, 733 bp, Oryza sativa
agtccgcacatcctcaaatacaaagcacttccctagttagatgtaggttagacttcccgttcgagaaactttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacaatgaaacgtaaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatt

SEQ ID NO: 35224 - DNA, 12748 bp, Oryza sativa
  unsure (1)..(12748): unsure at all n locations
agagaaacgattgcttaatcagggtgagaagaagacactggttgctgtccaacgacaacttcgcgttcagaacactgaatatatacacacggtcgtcgacagcaacttgccgtacgtacactggcctgaaaaaatatcagcaaattgaactcagagaaaaggttaactacacggnnnnnnnnnnnnnnnnnnnnnnnnaaattcgtgccacgcgctttaccccgcttactgcttcctgagcagagctcatacggttaagagttggcatcatggacagtaagtttatgcattattatcaaactcagtacaattttatttcaatttgttttacagtaaatacactgcacaagtacgatgtactctgctagtacaaagtaaaagactgtttgtttcgttgacgaaaccaacctcttattaataccaaattttatcaaggcaacaaacattcactcttggttacattctttgccttagtttggaggaaaaatttttgtaaacgcaaaatgagaaaactcattagcacatgattaattaaatattaattattataaacttaaaataaatttatttttttaaaagaacttttatacaatttttttaaaaaatattatttaatggtttgaaaagcgtgataacgaaaaacgagaaaattgaagtttggggttgaaaaaaaagaacagtgccttaaaaagctagtacaccaaatttttcatactgtctgtttagtactaactagcatggtggtccgcagattgcgcagatagtatcattatattttctcttatataatagcatatatgttttctcaatttattattaaaatatattaaaatgacaacataattttaaattttgtactaactttatgaaactactaatgtgtaatattcatattgtattttatatacgtgttacttattaattatttttatatcaaattttagttatttctaaaatatattcctatatggactctacacttagtctttcaatatttcttattttttaattccgaattttcgttatctgtaaattgaaattgtatttctatatagactatcggctcttcttccaatattatttatttttaattctgaaattttatattttttctaattgtatttatatgtactctaaactcatctttcaatattatttaatttttaatttcgaatttcaattacttctaagttctaaattgtattcctatattgactttagactcttcttcccatgtttttttatttcaaattttagttatttgtaaactgtatttttatatggactctaaactctacttttaattttattatgtttattccgaattttagtttgttttagattcctatatgaactctatactctacttctaatattctttatttttaattctaaatttctattatttcttaattgtatttctatatatactttatactattcttctaatatttttttattttttaattctaaatttcagttatttctaaattgtatttctatatggactctagtcttctcttacaatattccttattttttaattccgaatttcaactatttctaaattgtatttctatgtagactctgtttctttttctccgattaatatgagaatttctaagccgtgaaagcgaacgtggaagctctttttttctattcctttaataaattaatagattttccatactgattagtactccctccgtactcgtaaagaaagtcgtttaggataatgtttaagtcaaaccttgagaatataaatcatgaataactctcaagttgttgagtttaaaaatgtgaaaattaaatgaatagatttatcttgaaaaatactttcataaaattatacatatatcatttttcaataaatgtttttaagaaataataagttaaagttgtgttttgaaaaccgtgtcactgtccaaaacgacatcctaatacggagggaggacctgacaataccatgtgacaaaccgagagtagcatttttcttgtaaagcaagcactgtagcattattctgaccctaaattctggaggtgattagagcccctaaatggccggatccgattcgtccatctctgcatcgtgcggtgggcaatccctttcacatccagtcatcaacaacaccacacacaccctcacacacacgcacacgcagagaaaaagaaaaaaaaaagaagaaaaaaactaaagaactagtcgtagcggccacactacaatttacaggaaagaccttataaaatccaagagaacggtcaccgcttgcttccaagccgagcccagccagcgaagcccaccaccaccaccacccagatccccacctcgccgccaccaccaccatgcggggctccgcggcggcggcggcggcgaccgtgacgcgggtggctcagcgggtggtggccccatcggcggcgacgcctgggggcgcgctcccgctgtcctggctcgaccgctacccgacgcagcgcgcgctcatcgagtccctccatgtcttcaagggccgcgccgacgccgccgtggcgcccgccgcggcgatcgagcgcgcgctcgcggcggcgctcgtgagctactaccccatcgccggccggcttgcggagcgcggggatggtggggagctcgtcgtcgactgtaccggcgagggtgtgtggttcatcgaggccacggcgagctgctccctcgaggatgtggactacctcgagtacccgctcatggtggacaaggacgagctcctcccccaccccacctaccccgcctccgagtctcaccccgaagactcgctcatcctccttgtccaggtaagacaacaatggcgaggaaatttctcgagcgattcttgtggtcaacgggttggttggcaatgtcatggcaatggcgtgtgattgagctgtccgttccccaatgcaggtcacgcagttcgcgtgcggcggcttcgtggtcgggttccggttcagccacgccgtcgcggacggccctggcgcggcgcagttcatgacggcggtcggggagatcgcgcgcgggcgggcggcgccggcgctggcgccggcgtgggggcgcgacgcgatcccgtgcccgccgtccgccgccgtgggcccgctccccgtcccgacggagctccgcctccagtacctcgccatggacatctccaccgactacatcgaccacttcaaggcgaggttcctggagcagacgggccaccggtgcagcgcgttcgaggtgctcatcgccaaggcgtggcagtcgcggacgcgcgcggcggggttcgccccggggtcccccgtccacgtgtgcttcgccatgaacgcgcgccccgtgctccggcgcgcgctcccggacggcttctacggcaactgctactacatcatgcgggtgacggcggcggcgggggcggtggcggacgcgtcggtgaacgacgtggtgaggctgatccgggaggggaagaagcggctcccgggggagttcgcgcggtggagcggcggcggcggcggcggcgaggacgacccgtaccggatcacctccgactaccggacgctgctggtctccgactggtcgcggctggggttcgccgaggtggactacgggtggggcgcccccgtccacgtcgtgccgctcaccaacctcgactacatcgccacctgcatcctcgtccgcccctccgcccacaagcccggcgcccgcctcatcacccagtgcgtcgccgccgacgccgtcgacgccttccacaacgacatgatgcgcctcgactaataaccgagcgagctcaccgtccgccgccaccgacatcgccggcgcaatttgattcgttctttttttctttttttttttgggttttttctctcctctcgctgtacgcacgccatggcattcattcgccgtagtagactagaagaagaaaattatatatatatcagattaaaaaatacgataaatatatatgtatacgcgcctgtaatgcgaagcatttgtgcttattccttcgattaattattgagaccgggttcccctttgctgcgaatttgatgttcttttaaagaagatttcaataagtttcagaaatgaacgctcaggtaattaatttaaaccgttcggcagggccttccatgtcaccgtggcaaaaacaaattcgttcaaaaatcaaaatatggcatgacaaatctttggcaaaacattgttaccacgtcataaacagtgagctgtacaggtagcacgagcttgccacgttacgattaagaaattcagagagatatttataaggctctcaagcactatccaatttttggtttttgaacgaatcaaaaagaaaaagaaattaaagtagcagtaaaaattgttgtttatatatgattaagcgggaaatatgtaatgcaaatttagataagtatggataaattttagacgtttattttttattctatagtaatttttagatttgcacagtatatttttctcacattaaggccgagtttagttccattttttttctttaaacttttaacttttacatcacatcaaaacttttctacacatgcaaacttccaaattttccatcacatcgttttaatttcaaccaaacttttaattttcacgtgaactaaacacaccctaagcatacaaacatagtttgtatgtatgggggagaagttaacatttgtggtgttctgctggaacgactagtaggtggggagcaactgtctggaatctcctcttgcttaagcaaaggggttgcgagagggcaagcgaggtgtggtatatgcgtgatgatgcatctgttatttgtcgctgcatccatatgctaatgtgctcatgtcaagctcaagcgtcgtctacctgcctaaggggctaggcgtcgccatctcggtttgttgagctccggaatcgtgtgcgcttcgcatagattgcgttgcggacagggtttctcgctgctgctgctttctcttggcatgtcgtgcactggggtttgctttaccggggaagaggggttactgtaccccaaacgagggtaactccgactattgttatttaagaatggacgcacataaatcatatcaatatggtactacttcatagtatataaattggtcttatctgtggaagttttagcaaatgcagcttcttaagctcctcaaacaatttagatttttactactatcttcgtcctaatatacagcaacatgtgaatctgaagataattatattaagattcagggtctgttcactttgatgtcattttcaaccttaccaaattttggtaaagttgctaaaaagtgcatatatttagtttgctgccaaattttggtaactatataagaaatcatgtgccaaaattttggtaatgccaaaatttgataaggttgaaaatgtcattaaagtgaacatgccctcatagttatagaatgatctaatctcatcttaagttactgtattttaaaattgaggaagtataatctagaaaattaattagaaatgagaagttaataaacactggtctgcttctcataacgtcatgctcttctaatacaagacgtttatccatggctaaagttgcatttggaaacatggcagacatttaaaatagtagtgtaatgcttagatcgagtacgatgatcaatgggcttgtgttcgttggattggtaatttggatggtgggcaggtggttgaataaacaagtcgttgtgttcatgttctagaagctttagcctagcccccttgatcggtgcggtcctgcagagtcttggagcagcaaactcttcctctttccgactgtcggtgcagctgaactagttccatgaacaatgaccttgcaagatctggaccatccaatcaggatctaacgatgaacaccgggcaatcaaaactgtggcacgcgtaaagcaaggatagcacacggcatgggggagcagcagtccgttgcaagtcacgtcacatcacggttacgcaccatcgtcttgcgattttttttaattttttttgaacattttaatttttaattttaaaaataaacccgtccaaaaacttattttcaatatctaacctcttttgacattgacgtgacaacaatattgtcacgtggctcccgctaggatgacaacgtgatttgaccacgccagcctcgctagcgtgatttaaccacaccgctctcgctgacaagtgtcatgtcgtccactgcccatagcgtgctagtgttggtttgccacacaggcgggctagcgtgaccaaaaaaaagttcagattttggaaattaggttttgaaaaaggtaaaaaaaaaagtttcaagaaacaaaaatttctcgcttgaacctcaaaaagtttggagcgcactattgggcagctggatacggcagtgccaaaaaaccaaagtagcagcctagcaggcatatgctcatggcatcaagttcttgctactacatgtctactgctacaccatttgcatacaaccagcaactacctaagcggctagtagtaacacttgtatttttatctgggtggtgcagttcgcatgatatataattacatgaactgcatggtagacacaaagggagaatagggggccaaaaacatcggatgcttgctgactcgcacaaaggtaacgtagctactgtaggttccaaggcatggagccttggttcccagtagcgtagccttggccactaccgtcaggcgtcgcggaagtgcagtactgctgcacgacgttgttcgccggcaagccggaatgcgcggcgccggcggccagccactgggcggtggtctgccagccaggctgcaaatgagtcagctgctgcacgggcacggaatgctgctgtgagtgggactggacgtagtaagcctgggacaaggtgttctgcgattcctgtgttgcgtgatactgctgaatggattggtaatgctgctgctgttgctgatgctgctgatgatacgcgtgcatttgctgatgaacaggtccgggtggaggcaacggtggctgtggaatagcatgccgtgtttgctggagattcagattgctttggtttggatcccattctggtatgtcatcatcgtcatcatcctcccagggttgggctgcggcagcggatctgctaccatacttgcgaaccatctccctcacatggtctaccgggcggcgggacgcggcctgagaatgctgctgctggctcctgtgtgcttgtcgtgatggtactacgttggcagctgcgtttgggacggtaacaaaatcgtattcaggtaggtcatcgtcttccctaacaacaccagggccaaagcccggaggaacatcatcagttacaacatcctgaccgtggtgctgacgctcattggtaggcttggaagacaagggcactgcactggcaatcacggcatgctgcttcctcgagatggattggtttctggagccatcgttcctggcgggtatcctaggtgaaacatggggcctccgccacacgacgactccaatagctgatgttcctgtcacggttaagctgctcgactgctccttgggtaggtgctctgcaagtatctgtgctgccttcccttgagaagggcagaggtaaagctccactccatctgcaggcttcactagtcctactctctcgtctgcaatatatgagtcaatggtctgcaggaaaaattagaggtggttagcagatcaggagtcccacaatagcattacgctgagcccgtgcaaaaggtaacagatgacaagaattaagggagtaacccgcaagagatgctggcgcccactctcaagagagccctccttccaacgcaactcagttacctgtaaaacgagtaacaggttcttaatgaaataacatatgtttcaggagcagaaataatggaagattacccatctggatggcacaaggtaaatcattttccatcagatagcatctctatatgcacaaatcaacatttaatgcatgaacataacctatttatttgggctaatcaggtatatgaaatacttggggtgcagtcaggaactttaagaacaagaccttgtatgtgctaattgctaggctctaagcaaaagaaaagcaggttcaaatgaaaattgtggatttctcatagcgtggaatgtggaactacttcctccgtttcatattataagactttctagcattgcccacattcatatatatactaatgaatctagagttctatacatatatatgtatttagattcattagcatctatatgaatgtgggcaatgctagaaagtcttataatatgaaacggagggagtatatactaagcatagtgaataatcaaattcaagagcacaaaagtacatatgcaattccgaagtacataatatttctatcattcatgaatcagtgcgggaaccatagcacaatccaacattcaggctataatacggtcatagtcttcttattagggcattccctttttttctttcatttatttgtttctccaactaacacttaaagtgtaaaacattggcaaaggtccatgcctcaacataacattagtgcaactatgcaacccatttcaaaaacattaatacctagtggcctagtggaccaatacgagtaataaattgcataaaactccaggtacaaatacaaccctgtgtaccacaaaaccacgcgttttaaaaatattttcacataacacacgtcaattgaagctagtaaatgaaacccagagttgttgcaatccagaccgaaaaattcattgtggtatgatgttaggtttgccaacagggcacaacatgtgtccagtgcaaggttggggcacccgttccatgtatccagtggcttggccttgtagaccctttttctggaatgtggccttgtagaccttttttctagaacactggtctagtgtgggcctttatggaattcttaagccatatttgaatggctcacgtatcaggacagaaggttgtgttatggcggttgcctaactgcgtagcccaacagctgtccatcctgacaggctgacatgcgaacgtggttctagatttacaccaaggacccacacaagatggatgtagtgccacactacagccgtgtttagtttcccccctattcccaactttccattacatcatatcacatcaaaaactttcctacacacataaactttcaactttttttccaaactcccaactttcttcaaacttccaactttttcaggaacataccctacagcaaaaaggccacggttgggccgaatgtccacatcacaatgctatattcgactatggggttttctgtaactatcacccatctatctgcgattttgtgtcagaaggggccacaaacatgaggttttctcaaattcactcgcataatatctaaagcctaattgcatgtataacagtataaggtgttttacactgtatttggaaccacagtttcaacatattccacatgaactacccagttcctaacatagtattgaaccctctttgaacagagctttttttttaagtgtattctgatttttttcccttgattttgtggtattttttatgtgttcgaaaagagtcaaactgggagtgcaaaaagggttaatacagaaacacagtgtcattttggagcacaaagaaatagaatggaggttcgttcagtggtaaaaaaagaaatatctcgttagcagatgtatattatgtatattaacttttattaagcactcaaaacaggccctttctcaggatactagttattttcgtggctttcttctgttgatctgcgagggcaatttgcataggcaaatccatgtgcgcaacttgtttttgctaggtttgtgtaccgagtcccataaggaatcaatttgctgtaaggacaacagaggcgacagtccattccactgaaggtatagcactatatctgcagtgcacttcaatgcaatgtgtagaactcaattaaaacacaaccagaaaacagtgacattgaataacactctgcaaaaaaaaaaaaaggaaaggaattgccacagcatgtcatgttgacccagtatttcttttaagggaatggctaccatcattagatttatggaatcccctgaacacggagttcggaatatttatgcaaatgcctaacgttaacaacaaagattatcttacaaaacaaaaatgtgtttccgtagcatcttacaatcaatcattcagaagaagcagtagatgctactgctagcaagtcaataggtacaactgtacaacatcgatgtatttcacatttccatactgtggtaattgccaattttaattaaaaaatatagtcatccaactgagaatagcaaatgagaaataactattaccattatagcacggctcctggatttaggaagttgttcaagaaattcttgaaaagcactgagcctgactcttcccttgatatcaaggaaatggcgccactcgtttgtggatgtcttttcaccgctacagaacagacaaaacaataatcgactgaggatatataactgaaatattaatttgtcaagttgtgcactgttctataaaatggtaccatgtattgtgctcaagatatagaaactagcaagagaagtactttcaatagtgaattgtatatacaagagagataagcagtgcagaactgcggatgaaacaaaccttttgaagatcgcaacaacatttgtgagtgatgacaaggaaagttgaattgttccctcccatacactgtcatgtgtcagcaaagcatcaggagctgatttacaatccgtgatagattcagggatcgactgactgccagtatcaatgttttcagcattggccttttcaggggaggatttgactaacagatcttcctttatttgttcaactggaaacaaaattgagcctgcgtcttttttgggtgactgtaacttggactcaaacttatcttgaggagataatgtttgcggatcaagttgagaatctgatgcagaagcactatccacatttttggaagaatcttccgatttcaatgaaatgtcagttttctcaatagaattaggatcatctttcacagtttgagtggaatcatcttcgaaaggtggttcagaatcaagggtctccatgaattcgtccagtgacataattggtggaagattctctgtatctttcaggtcatctaccatcagttcctgcatcagatcagttttctcattttctgtatgttctaaattgcttggcatgttattgccgcctgtcacgataactccatcttgctcactattgtctgattctttttcttccgtgtgtacacttttatcatcggttttggtttgaccttcagtaggtcttgatggaacatgcgaaagcaaatcacccccaattccaacctccacagagataccgtcagtttcttccacctcaacttgaaattctcctttgtgtgttttcctcaccaagcgtctaacatccacttctttactaggaagaaccaccatctttgcaagctcttcagccttagccaaccgccagtctgaaagttcctttgaagcgagttcttcagtagtcattgaacataggcgtttgggtgttatatctccagacaagacacgtcccctcagtacaggattacttttatcttttaagttgaacagaagtgatcgacccttctccttgtatttcttgttaactcctcccaataaagtgaacagctcaccttcaatttcaaatgctaaaatttgggccttttgggttacactcttcttttcttctgctgccccatcatcagtctttattcttttagactcatgctcaatcagagatacatcaacaccttcatcaatatcagattttctgactctgtctggatcggattgagaaatagtttcagaagctccaacaacgtcagaagaccagcaaagtccatggccttgcagaagctcatctaaagtgcaagaattgttatccagtactttattttccaaaggaacatgtattgattgctgctgcatatcatcactcaccttgatcgacatgtttgatgccgaattgctacttaacatgttatgttgcccgcttttcaaagcactagtctctgtgacagaatcaataccagcaccatcggcttgcttgttctcgctagcagatccaacatgtgacacggtttcaacggattgcggggcacactgttggtcagaatccatattcagggcagcagccagagtctctctgaactttgatctcacggactcaaataattgcggctgtgccttgggcagcagttcctgcgcaggacgcttgctaccagcagaccgaaagggcacagacttcagcatctgaaccttcggcgacgctgccatcttcttacctgctatcatagacggcgatggcatcatcgcggccataccaggcaaagctgtctggacactcagcacctgttgcggcggcctaagcgacaccctactcaacggcctggccccggacccggagaggcccagcgcgttgggcctgggcacaccaacctgcgccggcggctcgctcatgggcacgatcaggtagctgctggccggcacctgcgcgccccagttgccattgtagaacacggccgggtacccaacctgcgtagtgtgggtaatcgccccaggcaatgtcggcggcgtccccgccacccgcggcggctgcccctgcttggggatctccatcacggcgccctgcccgttcccgcaccacgccacctagggggatccaaaactagggttacatcagcacacgttcgcacgcagataaaaccctacctactcgacgtcaaaccgcaatgcgggttcccgggggg

SEQ ID NO: 35225 - DNA, 4650 bp, Oryza sativa
gtggcgtgacctgaccgaccaggcggccagatttcataattcagagataaggaagaaaaggaataagttcacttcaggtctctctctaattttcatccattaatcacaaaatcgggtacgacgggtccctcaacttacaaaaccatataaaagaggtccctcggcagtattatgcccagttttagatcacgtggctccctttgactaggacctcatcccacgtggtattgacgtgaagtttatgtggcaattggatcttgggaaaataataaaaaactatgggacccatgtggtcccacatgtcagcctccctcttctctctatcccccctctctctcccctacacggcaaaggagaaggacgagcggcgacgcaaagggggtgacaggcggagcgacggcaggcggcggcgggtggcagcagtggcgctgcgcgttcatcatcgcccgcgccggcggcgaatcccacgagctccgcgtcaacattgctaacgcctcctcggcatccgtcctctctcacgtcgtccaccgcagcgccgccctcccgacgctgacactggaggagcagttcgtgacgctggcgctgccgccgaagcacccgccgttcgtggagtcggtgcgcggtgcggggtggacatggacgacgtgctctgcgcggtgttccccatcgggtggttcagcggcgagcttctacgagcgaccgctgcagggcgtgacgctggtggtggacctcaacaaggaggaaagaagcgaagggtcggcgggaggaagtggagggcgcgcactcaccggctggcgaggaaggatggtggacggggaggagtcagcgtttagggaggagcggctgcccaaggtcaggacgggaccgagagcacgaaaggaggggcggcggcgacgtggtccgagatctgcaccgaatcaggaagctgcggcgttgtcatcgtcctcacctccaagatgtacgcacagatcgagacgacccgacggcagcgcacggttgcagcggcgaggggaagaggaaggggccgctgcgggcctctacccgccaacctccaagagcccatcacccgtcgccatcgagcccccactcgccgcgtgcctctcctgccgcccgccaccgtcgagcctccacccatcgcgcgcctctcccaccgaccgccactagcctgtcccgctcgaacggccgctcgtagccggccgcctctcccgctggaacgggtgctcatcgtcgacggggagaggtgtgttgctgttggtggtgtgtgcggcggtgaaggcggaggcaggcgcggcgagcgacgaggagagggacggccggccgccgacgttaggaccatgggggcgggagtggaggaggctgcgcctctccatggtgtccttatcttcgccggcgagatgaggaagtagaagggagatggggagagccgaggagaggaggaataagaggattggatttgatcatttgagaatgacatgtggagccaccatatttttttggtgtagctgacatgtgggccccaccatatttttttggtgtagctgacatgtggggccacgctttttattatttttccgagatataattgccacgtaagcgccacgtcaatgccacgtggaacggagacctagtcaaacaaatcacgtaggcgccacatcagccaaaatcgctgagggactacgtttacctggttttcgtaagttgggggacggatcatacccagttttgcggtcgagcgacgaaaatcggacagggcgacaaatagagggacccatagtgaacttattccggaagaaaagggatattcagcggttgggcggttgagcctagaaggctagaagccgaagcaatataggccttcgtggtgcttggaaaattgataatgggccttcactatgcctaacgtttgtgggcctcaatgtccggtgcataaaatataggaataagttcactatcagtccctcaaatatagatcggatctgattcgcatctctcaaccataaaactagttataaattactccttcaacggttaaaaccgtctaaaatcactttcaagacattattgaaggtggtatctgctgacatggcagccgaccaccacagccgcctgttgatccgctccggcatcgacctgtcgacgctagcatgtctgacaaggttcgtgctcaagcacggggtcaccggagacaacgctgccatcctttcccttcgtctgctccatgtccatctgcagatcaatcaacaacccaagttagcaaacaagcgatcaccagaacagacagtaaaatatttcatccgtatttcaaatgtacgacgccgtcgacttttcgaccattcgttttatttaaaatttttatgcaaatattaaaatatttatgtcatacttaaaaaacatttaataacgaatcaagtcataataaaataaataataactatataattttttttaataagataaatggtcaaatattgaaaaaaagttaacggcgtcatacattaaaataaaataaaatatgaatgtagtaatggtcaactcacatcggcttggcccttgacaacaagtgcaacatgccggcgatgtgcgaccctgccaccggggaagcctaccgcggcgtggccagtgccaacgactaaacgacacgccatggcgcgccggcggtggcagcgaaggagctgctcaagtgctcagcgccatggttgtgcccgccattgctaactcacaccgcagatgaaatcaacacaacctaacttagctagatcactctactgaaatcaactcaaaggcccagtgagcatgcacacggtctcactgcagccgccgcttcacctaactatatggagtagaatatatgggctgaaattctatttcaatcctgggctagacacttgagatatgtttttttttaaatgaatgttagataagcaatttacacttgggatatgttttgagctcaactatatttggtggacagaacgcatgtgcgatgtgccgaagaaaatgtctaccagaggaatttttttcatttttatttttttaatattttcagaaatattataccggcgaaaatatttacaaaaatagaccttactgcctaagtggagggtggcaaggtgacgtggcacacggcaccgtgtgtgcattttgccctgaggtggggtgaaatgcaactttcgccgcatgtaaaatttgcatgcccgctctataaatattttcgtcggcataatatttctgtaaatattaaaacaaaaatattgaaacagacaggaggaattgcctgccagcgcaaggaactgagattattctcctagtagtactgtacaaaataaatcgtactactagtatagcactatagtagcaaataatcagtagtcgcgcacgtgtgtcatttcgccaggctgtgacgagagagcatctgtagccactcgccatcaacgtccacagtggtcaacccagacggctgcctctagtagccgagttttaatcgccaaaatggaaacgaggcgtgtggagaaaagcccagtttaggtgaaaggttggtttgtttggtggccacatgtggtagcctccgcctccacaggatcgcaatgctcggcgtccacgcgcgcgccgcgcggaccggaaatgtaatgcccgagagcgcgacatgcaggcaggcaggcagcgcagcttaactggatttgcgtgtggatggaggatatgatatagtatgtgtattattagtgcaaaacgtgcgcgacgttctggtttggaggattattgcacgtacgtgtgtgtgatgctattgttcaggaaaacgggccgacaaaacaagggtcgtcactcactcaaaatctccaataaagagggaaaaacacgggccgggtaatcgtgagaagtgtgtttgccgcaagttccgctcctatctcacaaccgattgccacggtacacggttgccatcccatattcagcgcatgtttagcgtagctttagctcagcttgtatcttcatccaaaataagagaattaaacgggttatggagctctcttgaaatgaataatcaaggtgaaagctgggtacaaactacttgtaattttacttaaatctagaagttatattaaaggcctaccaaacacgacctcgtattccctacttctcgcgatcgatcacgtacacgctgcatgcacgttccatgcccagaataccgtcgatcgcccacttgctttcctcccatcccaacacacgcacgtggcgcgggcggcacacgtacgtctctccgtctctcaaacacgcctacgtacaccggcacaacccgtgcgtgcgcacgcgcgtggcatgcatgggtccccggccaactcccgtcgctcgacgcggcccgatcgaatcgaatcaaaacccgcacgcacacgaattcgcaaacgaagcgcctcgcattgcgtacgtcacacacggatatggaatcatgaaaagtcactactacaaacatggtttttgcatacgggcgagaagggggcgcaaccgcatgcactaaatcgtctgcgaaaatcacgatctttgtatgcggccggcgcaaccgcatgcgaaaatctgattttcgcatgtggacgcttaagacgaccgcatgcaaagagaaaaaatcgcgaaaaaaaaataaaattccaaaaataaaaaaaa

SEQ ID NO: 35226 - DNA, 28742 bp, Oryza sativa
ctttttcagttgaaatcatttagtatttgaaaatattgtttgaagttttgaaattcaaatttttaattgataaaacaaattcacaagaaaaaatggccaaaataatagcagtaagaacataagaacatcatagagcatgattttagaaattttttggaaaaataatcgtccaatttggagttcatatgagtgagatacactagtttcaaaattttcaaaagtttcaaaattatttttgcatacggctgcttaagatgtccgtatgggaaaatggccctcgatttttgcagacgccactagttacggtccgcatggaaaaatgatggggcctcgtacagaaaaatcacttttgcagtagtgagtgaaaacggtccgaaacaatcagaaagcagcctcaaccatttccataaccatattttcttggaaacaaaatcgaaaacagtaaaatcagaaatgaaaatgatatcggaaatatcggaaaaccaaatacggaataatacggatgaaaagatatcggtacgtatcagaaaccagtaacaaaataaaaaacactaaactataaaacatatatttaactttgcataagtatgtaatacctataaataaattcaagcttagactatataaattataaattaactcattttagccatgcactcaagttagaaatttgattaaaaaagagtcgatcaatctttaaaccgtggttcaaatagagaacactataaatatcgacatatttaaaagaaaaacatatgaattatcctcctgaactatcgtggtcgaccgaattaccccatgaaccacaaaacctaacattttacaccctacactatttataccggacgaataaccccttgtcactgctttgagaggttttgatcaaaagcttacacacgtgatgtcaacgtggcaatccagccagcaaaaacaacaataatgaatttgtagggcccacttgtcatatcttttctccactctctctctctccctcttccctctctctccctctctcttcaacggttggatggaggcaacgacaacgacgactggctggaggaggcggggttcaagatgagggcggtggctggccggggacaaggctgggaatggagaaggtggccggtggtagagacgttctgggtggtggcggaggatttccggagtggtagctcgttcggtgttctgcagcaggaccacgagcgacagtgtgggtgcctggcggcggcaggaccctggggcggtggtggtgggacagtggggcgacgacgcgggtgcttgggggaggatgagctcgtgatgtccatcttcccgctaacattctccacctacgcgtatgccgtgggcgccgagcttgccgcgctcttcccaacaaatccggctacatcatagcgcctcgagcggaaagaggtggcggcggcagaagagggattgatccaacttgctcggcgacaaggagggagaggagagggagggagtggccgagcgtcctccagcggtggcgttgttgtggcggtcgagcgtctggtttgcagaggcgacaccgttgcaacagccgagcatctctagctacagcctgtagacaaaggaaaaaggagagagcagcttatatgtgggcccactagctacataagagagggaggatgaggtggaggctgacatgtggggccggtgccatgtgtgcggtcacgtaggactaaaaccgctccagattgagccagggggttattcttccggtataaatagttcagggtgtaaaatgtctggttttacggtttaaggggataattcggtcgaccgtgatagttcaggggtaatttgtatcttttccatttaaaaatacggtaattaccatattataagaaggtaatttccataaaaatacgataaatacggaaatgattggtataaagcaaaatcacttccgtttcaatttctatacttttactatcttcattttcatttttagttgattaccattttcacatagctcaacggaaaacgagcaccggctggtcgggaatttctaatactgttctcattcgttccctagggttcccaactcccaaccctcgttttccgcgcgcgcgttttttaaactactaaacggtgtgtttttttaaaaaagtttatacacgaaagttgctttaaaaaattatattaatccatctttttaaaaaatagctaattcttaattaatcacgcgtaatgcgaacatagttttacgtgccaggctcccgaacacagccaagtcgtcacaggcgggactccatcgaatcctcggtccggcagcggcaggtcggtctgctcccccctctcgctctcgcacctctcgcatttgcgtatcgcacgacggcaacgagatatttgcgtggacgtcatccgcgaacccggtggtggccggtggttgcgtccgcgacggatggatggggaaggcttgattccgcgagaaggacgggcagcggacgcggccggcgcggggcttaaaaacgggggcgacccaaccagccaaccaaccaacaaaccaaccaaccggccatcgccccaactagacggaacgaatgaaccgcctctcttcgtcatctcttcatcttcatgtcatacgcctcgatcgatcgcgaccgcgtccccgcgctaattccacgtgtggtcgccgctatatcatcgtcatctctctagcttaatttgtcatcgcaaatgccgtacccgaacaggacgttgctcatgatcataatgatgatgatgaccaattaatagtaatacaaaaccaatggctgcatgtatagctgatttgtacctaaacaaacaccgtgccttatcgagatctcgtttttatatcttctaatcattagatgcatgtctgcgtaaatccttgtgattgttgcatggctatagatagtactcctatttggcattgccagggtaattacgggtagtataagtatactccctcgggtacaaaaattattgacgtttaaaccttgtaagcagtaattgctaattattaaaccttgtaaggagtatattggaccgctttaccctgcatgcatgcaattaaaaatcgagtaaaacagctaaggaattggacctttagctcgcaccgatacaggtgattggttcaaaccaacgaggtagcagcaggtgtagtgattatcgttagcacaagatcatatttaatatggacaaaatagtaagttgacaccctaaatcaccttttggtatgtgagatcaggtcagaaacgttaacaattttggaaccggagggagtaactacctatttatacggatttaacagaaaaactatctaacggcatcccgtagagatgggatagtagtgctgccttatctcatcttcccctctctctgtgtcgctttccctccactcgctctctctctctctctcttccccttcactcgatctctctctctctctgtgactgccacccatgagcacggaggcggcgacagcgacgacggcggtggcaacgacagcgacgacgacgacgatgccgtcaccaccaacccccgcggacgacctggacgacagccggcggggctcccgaccaccacgggcgacggcagccgagaagcctccccatcaagctcctcaagcggctcctcctcttcgtcgttcttgtcgttggcttcctcgccgctgccgccctcctcctcctcggcggcactggcgcctcctacggtcggggagcgggggacgcggccaccggggacgagcgcttggcacaacataagcgacgaggagctgctctaggcggcgtcgatggagccacgggttcggcggtttggagcgaggcacgatgacaagtgacagaatggcacaaggtaggcaccagatctatcgcctcctcttcctcttcctccgtcgccgccccgctgctcgacctccccgacccgcgactcctcctcctcctcctctctcttgggatatcacgctgatacccaggtaccaaggcctgatacctaggtaccaaggcctgatacctaggtatcagctcgatacctaggtaccaaggcctgatacctaggtatcagctcgatacctaggtatcagctcgatacccagggtaccaggtatcagtcgatatccaggtaccaaggcctgatacctaggtatcagctcgatacccagtgtaccaggtatcagtcgatacccaggtaccaggtattagtcgataccggggtaccagctgataccagtatactaggtaccacctcagtaccttacccaaggtaccagggaggattggataaggtggaatcgcaggatagcgtgggcttccccacgaaattgacggtgcgtattaaatctctcgggatttttagttatcccgtgactgctaggagcaacggaatcccgtggggtagcagccctctggatttaaagggattgtttggatggtgaccatactttgccacaactttggcaagctactttgactaatttagcctagtgtttgcttgattgccacatctttgtcatgccacactttttgattttgtgaccccacttgtcataggcacatacctttgccaacatttgcctaacttgtggccaaaaatttcttagccacataaattgtggcatgccacatcttagctatagaactttgataaactgaagcaagtatccaaacagccccttacacagagccgcaagtacacaggaaaggcagcatcaacccgcaacacagagccggcagatttaacaagctagaaacggggtcgacgagctgtcgagggcgtgacttaaattgggcgccggtgcgcgtgcttttcagcgttaactgctgctcttctcgcctgaaccagctgccgctccttcgctgtcgcaccttcatcaccttgctctgctagcacttaataccactatactagtatcaaatagatatcgtgctatatactcgctccattctcgtaaaggatattattttggacagcgacacagtctttaaaatacaactttaatttcttgtttctataaaaatatttattgaaaagtgatatatgtatacttttatgaaagtatttttaagataaatctattcatataatttttacatttgcaaactcaacaacttgagagttattcataatttatattcctaagatttgacttaaacattgttctaaacaatttactttacgagtatggagagagtattatatatgcgtgcaatcaagtcttaaaagccttaaatgattaattagttaaaagaagatattgcagtctgaactgagaaaatgatactagtagatttgtcgtgaaaagcacatttatatggttgtattttaatatcttttataaagatatagttagaaaaggtagcagttattgacactatgtcaatgttttaagtgacgagtaaaaactaaaaagtaaccaagttagttatagctatggctatggctatgtttagatctaggggtgaaaagttttggcgtgtcacatcggatatacggacacacatttgaagtattaaacatatactaatagcaaaacaaattatagaatccgcatgtacactgtgagacgaattaattaagcctaattagtccgtcattagcaaatgtttactatagcaccacgttgtcaaatcatggagcaattaggtttaaaagattcgtctcgcaaattagtcgcaatctatgcaatcagttattttttagcctatatttaatactttatgcagatgttcaaacgttcaatgtgacagggtgaaaaattttgggtgggatctaaacaggccctatgtcaagttaggccctgtttagttctcacacaaaaatttaccccctatcacatcgaacgtttgaacacaaaaaaaactaattgcacagattgtgactaatttgcgagacgaattttttaagtctaattgctccatgatgtgacaacgtggtgttacagtaaacatttactagtgacaaattaattaggcttaataaattcgtctcgcggtttactggcgaattatgtaattagttttttttattagtatccgaacacaccatacgataccctatgtaataattgatgtgacacatcaaaactttacaccctgacccaagatcccctatactttctgcttgtcatctaggctggttgccactcacacacacacagccactgaggagcactttagaaggttcgttgtgaatcccttttgattattccgtacataacgcatggaaaagaattggagtaggggcagtctttagttcacttcaaactttaaaaaaattcatcatattaaatgtttgaacacatgtatgaaacattaaatggacaaaaaaaaccaattacatagcttatatgtaaattgcaagactaatttttgagcctaattacaccatgatttaataatgtaattctacaataaatatttgctatgacggattaattaggcttaataaatttgtctcgcagtttacatgtgaaatctataatttgttttgctattaatctatgtttaatacttcaaatatgtgtccgtatacttaaaaaagttttggcacccgaactaaacccgccctagtactagaagaatagtgttatggttctagtgcattcaacccttctcttttcttgacatgttagctgaaatgatgtatcagtgctagctaccaatacatatatttggtcaatacatactacgcccttattagttcctaacatttttttcaaaatttcaattttttcattacatctaaacttttctacacatataaacttttaattttaatcaaacttttaattttagcgtggaagtaaacacactcgtagtaacactcgtagtatttggagagtcagaaagttggagacgctttgcatagtttgacagctgctctcttttgaccagctcaacgggtcatcagaactaggcaaattcttttgttttttcggttgtaatggcatgcacaatgtatcttacctaactagtaaataagatgggccccatgactaggaggtagtaagctgcaactcttctcacaatgcttatatgagtgtagtggtaaacaaggtggggtccacctgaaaaaatctatccatcccaaccctccattacctgaatcctatcagaatcttcatattttatttggttgttgccggcaatagcgcaaataccaggtagtaactactatctcttcccacaatgcttactactggatactggatagtaggcttaaaataaatgcttgttacctgattttttgttacattgtggttgctcttaagtcgtaggaagattctaaacgaatgttgcattctagaacaagagagaattctctctgaaaagtagtagagaaaagtggtactactatggaatttctcccaagaaaagcccatgttggaattcccaatctgaagctccgtttcttcctggaagcacagttgtctacacagttctccgaatagagcggttgttccggttttgccaaaaaaaaacgttgtttaaaccgttgactagcagtgtaatcggacgaaaatctattaacttattaaagaaatagaaaaataagcctccacgttcgctctcaaagcctagaaattctcacattaatcggagaaaaagaaaagcagagtccatatagaaatacaatttagaaatagttaaaattcagaaataaaaaataaggaatattggaagaggagactagagtatatgccgggatataatttagagcttatggaaattcggaattaaaaaaatattgaaagaagattatagagtcataatttagaaataactaaatttcagaattagaaaaataaaaaattaactgaagttcagaactagaaaaataattaatattgagaagaatagtatagagtccatatagaaattcattaggatataatataaattcggaattaaaaaataaagaatattagaagaagagactagagtccctataggaatgtagaattaagctaaaattcgaaataaaaataataaaattaaaagtagagtttagagtccatatagaaatacaatttacaaataactaaaatttgaaattaaaaaaataatattggaagaagaaccaagagtctatataaaaatacaatttacagaaaatgaaaattcgaaattaaaaaataagaaatattgaaagatgaatctagagcccatataggaatacaatttagaaataactaaaatttaatattaaaaataattaataactataacgtatatacaatacagtatgaatattacacattggtatttgctaaagtaaatacaaaatttagaattatgttgtcattttaatatattttaataataaattaagaaaatatatatgctattatatgagaaaatataatgatgctagccgtacaatatgcgatgaccaccatgctagtttatataataatttgattttttttaaataaaattgattagaaaccgtgcgaaccgaggagtttgtgttttcaagcttggttcacgaaaaccagctggtttctatctgttttgtaaaccataactacaaaaaggcaacgtgtgaaagagttaactaggtagcataattttgagtcgatgtgaaacgagtgagtgccttctggctggctcacagctgcataagggcacgaccaatgcaagctacaccatctgagttttcttgaaaaaaaagaggactctacgtcgaagaaatcattaaaaagtcatatatttcacagtgcatgatacacttgatttcttactaggactggtatggatttttttttgacaactatctgacagtgaggttctgtcaaccacgtcggtctaaactgagcaccgagcaaccatgtagagacacgacagagtgcgacgtggacaaaatcttttacgcggcacctcgaatgcacacgccatgtcactgctctgtgaaaggcctaacagtatagcataattctgaacagtagtagtactgcatttgggcaactgtcaacagggtagtagtatcactcgcagcaacaggagagtgagtgagagtgcaactgggacgaaagggatgtccaacgagaccacttcaattcccccaaccagatcaccgtcgtcagagactcagagcttaccaaagtcttcggagaaacgaaaatcaaagagctttccgggcttctgcttcacaactttgccgtctacttaaatgggtacttggcatccacttaccagttaaccacttcctactttgcagtacgtgtacgtcatcgccgacgccttcaagttttgccgtttggtacatcatagcacagaacgatcgagatggtgcgcggtgcttaattgggctcttgggttctgtaatactgtgattagattgtaactgttccttccattttataaatcgctttgtatcttatattaaattaaatttattttaaatttaattgagtttataaaagaatataataatatctgccgtatcaaattaattagttttattaaatttaacattaaatacattatggtcgctgtttgttctatcttaaaaatattgctatattatttaaaatttgatcaaacttagaaaaaaaattttagaagagaagatctagaaaatatcattgataagcgcctagttccaagaaatattatcgataagtgcgagtttcataaaatatcattgtacatgtgactttgtcccaaaagaccattcctgataggatttcgttaacaaccctccgttaagtgctacatgatgaatagtatatttaacgtgacggtatagatgaactctgacaacgacgatatttttatgacaaaattgcttgtacgatggtatttaatgggattcacgctagtcgatgatatttttcggacttgatcgtttgtcaatgtcattctttagattttctctcaaaaaattaaagccttataatataaaataaagaaaatagtactaaatgcggttgaatttggtaacgtttcctggaatcgcactttctttcattttgaaaggtttgtagacttttctttcgactttgacgggtttaaaagaacagtagtgtactttagagtgctggagaagttgatagaaattattgcatatttaaattacgttatcacataaaattcacgatgatgaaaaaaaaagaaagaaaaaacaatttgattcatggattcttggaattaaaatatagttttacgaagtgaattagctcaactgtttaggttgtttgtgttaaaatatagtttgaattacgaagtgaattagctcaactggtgagtacgcacgtgttataagcatctacgtttctatattgtgtttctctaagaaaagtcaaaaccgctactaagagtctattatgtaaattgcaccttccattcatatcgaaacctacaaccacgcttagcttctgaagatctcatactccaagagcagatagcgagatcttttttttaaaaaagttcacataagacctgaatatccaaatcaaaacatcacaggtattcaaacaactgaaaaaaaaaagctacgggctcagttcaaccctccagatgttttatgaaaaaaagtgtgtttcatcaactttcaaaggaggaaaataaattcataggtgatagaggtttactaaacaagctgtcactttttttatagtactggctgaagataaaagattaagtaccgacaaagctattaacgtgtgattagtgattttttttattttttttggacttttttaattttttaataggccttttcaaaaaatatagaaccttttggccacaccagccgagtaacttgtgtagcagctttgttttgtcacgccaaccatgatgacgtgacaatagactggtgtggcatgacaacactgatatgccagctgcacatggcgtgataaagtgaattggtcagacggatggcgtggccaaaaggttcagatttagaaatacttttcggaaagttatattaataaaactaaaaaatatctaaaagtataaaattaaaaaaaatcatgattagttaggtgtaaattattctatacttaaaaatagttttatctaatattttaaatcaacttatagaaaattttcttacgaaatatactacttaacaattaaaaaacatgctcacgaaaatcgagataaaatctactatatcttaaaatgaattgactagtaaaagttgagatatcacttaacactatgaatctggacactaaacacaatctaaactcgaccttaggttcataggctgtatttagttcacgctaaaattgaaaatttggttgaaattgaaatgatgtgacggaaaagttggaagtttatgtgtgtaagaaagttttaatgtgatggaaaagtaggaagtttgaagaaaaactttggaacaaaacacggctatagttttaggtgatctcttatcttttattgttactatctctgttctataatatagatttaggactataaaatattactctgatttcaaattagaactactatatatcatgggacgaaagaaatacattttaagacggggatattatttagaactggcctatttccacgtttctcctcgtgccccgcactacagacctacagtatagtttattctttctatatgtctcatcaaagatgtcctttttcacggtccatcccagccgtcggatccccaggcggtggcaggggcaggacggtcattgcacaccccccggcgccacgcagagaagaaaaagcctcggtttttaaggtcgccgtggccagcagcggctgcgatgcgatgcgagcctgtgttgacagcggagaaagcagtgtaatccggtcccgccaccgcagccgcctccacctctcttcccggcgccaatggccgcgtcgtgaagcgcagcagcagcagcagcagcggagacagcggcagaagctttgcctaaggtcggtttgcctccccgcctccgccgcattccggttggagttttgtccgtgttcgtcggcggtttcttggctggccggatgaattgttgtggggagggggagggggaggggctctctcacgcactcgctgctggatttcggttaggtttcgcggctgggggaatcgcgggggaattcaggatctttgttttgttagttcttctttcgggcggggttggatctcgagtaatctgcgtcgtgttatttgccgcgagatttgggtgttttttttcttctctccgcatcttctctctcgttccttcgtctgtacggtctagtggtggtctacgggctacggccgtggtaaaagtttctctagatttttggtctcgtttttttctttattttaggcggcttgctttgcttcgcctgctttgacgtttgaccagcggtttatcctcgattattcttcctcgtgagtcgtgagcaagctatgatttgcagctaatgatttttgtgcttggattagataaaagatgcttctcactcttcgtttgtttccattttctggaatttgtgatttcctggtgatgataatgttgtgctcgtgttgattcaggttgggatcctccctattcgcgcgcgtctttgatttggcgcgtaaagttgtaatccgtactccggatggccggctcaatcgccgcctcggcgttcttgccggggtcgccggcggccgcgccgcccaagagcgtcctgggcgagcgcccggacagcctggacgtccgcggcatcgccgcgaagccgggctcctcgtcgtcggccgccgccctgagggccggcaagacgcgcacccacgccgccatccccaaggtgaacggcggcagttcggcgctggcggatccggagcacgacacgatgtcctcctcctcctcctccgcggcgccgaggacgttctacaaccagctccccgactggagcatgctcctcgcagccatcacgaccatcttcttggccgcggagaagcagtggacgctgctggactggaagccgaagcggcccgacatgctcaccgacacgttcggtttcggcaggatgatacatgaggggctcatgttcaggcagaacttctcgattaggtcctatgagatcggggccgataggacggcgtctatagaaacgctgatgaaccatttgcaggtgaaatattgtgaattttcaggcgtcggattgctcgggctgggcatcagaacattgaaatgtttttggttttgatgcaggaaaccgcactgaatcatgtgaagagcgctgggctgctaggagatggttttggctcaacgccagagatgagtaaacgagacttgttctgggttgtcagccaaatgcaggcaatcgttgagcgttatccgtgctggtataatactataatttcacatatcagcatgttcttggttttgttttcttacatagtttgagctccaaatagggtgttgcttttctgctttcgtgttacatgacaattaggaggcacatagatgtatggttggctgtcacagtacgttactgtagttatagtagctatcatcttgcttcacagcagtcatggaataacaggtttaggtaaatggagttttcaagttgtttggcaatgaatatgaaaaagattttcccaagtgtttgtatcaattttaaatggatgagcaactcccatctcttaactgtttttgctatcggcattaaatatttgtgcaactggtagactttcagtaaacgatgatgatgcagaagcctcctgtgctcttaatattattgatcatgtatcatattttctgtgagatgttataattgttcgtgtttgttacctgaaagtgccatgttgccaataattaacttcttatctgtgtgcaggggtgatactgtcgaagtagatacatgggttggtgctcatggtaaaaatggaatgcgcagagactggcatatacgtgattctgtaacaggccatacaatattgaaggctacaaggtttgaattattgtcactctcataaatactgatgatcatgaaaactgtattagcatctgctattcaacttcctacccatcttattaccactgtttgcatatgaagtctagaagttctgtttcttctgaacatattataagctgccttacagcaacatgaagctacctatttgtcctaattgtttgctcaatgtgcagtaaatgggttatgatgcacaagcttacaaggaggctagcaagaattcctgatgaagtacgtactgaaatagagccatacttttttgagcatgcttctattgtagatgaagacaaccagaaacttccaaaactgccagatattgaaggtgctaatgtagccaaatatgtccggacaggcctgactgtaagttttgtggaattatacaagattacagtttacaagtatacaaaatgtgcatgtttttctttcattttttacatcttcttctgtctcataatgcagccacgatgggccgaccttgatatcaatcagcatgttaataacgttaaatacatagggtggatcctagaggtaaaaaaagttcccctattatgttcatctttattgcccttgctaacacctcttgcctagatgattcttgagggaaaaaaatgcttcttgaagttcagtatgttactttcagaaaaaatatccatttgtttttatttactgtaaacactccatggagttgctgttaggcatctttgtcgcggtattcattattaagttgtcacatggtggagcataactttgtgttgctttacttgcctttttctctttgggcatacatttagtactattgatggtgctacataattcaaagagattcatttatctcgctatatttcccatatgttatgttccaagaatttgggaataaacagtaatcagaagagtactggatttgtaggtactttattttttgtgtgtgtgtgtgggggggggggggggctcagatcatgcctatgattaggcattactgtaggagtttagataaacttggtcaaggtcccaaaagggtgtgcctatggttctacaagtgtccacctaactttatcctcaagcacgcaaccacttatctggcagctttgtactctttcaagctatacgaaaaatatctgttgcactagttggagaagtaatgtatcctagcagattttactacattaggttggtcacctacgtacctaaccctgtacgcttgttgcttccgataaagagcttggctggaatacttatatgcaatttgatcacaagtcattcacttaattcaattttttttagagtgatcaacacctgcatataatgcatatttgcctggttgacaatctgccgtgtgtatgtgtgttttggaagaaggggaggggtagtcatgtatgtatttatccagtggaccacataatgaggaaaaagaaattgttcaggtgacctgcaacctagatgggcccaaaacaacccaaaatattagggaaattaacacttcaggcatttcctaacatacagaaatatttattaccaacatgcgcacatgttgcttaaccctacctttttgtccttttttcccctcagagcgcaccaatctccattctggagaaacatgagctggcaagtattgtcctggattacaagagggagtgtggccgagacagcgtgctgcaatcacacactaccgtgtacactgactgcaacaagcactctggacaaaccactttgcactgtgagcatttgctgagcctggaatcaggacctaccatcgtcaaggccaggaccatgtggaggccaaaaggaaccaggccccaagagagtatcattccgtcttcgtcgtgaagcgcgtaaaatctttcatgtgttgattttggtagcaacaacttggttaaaccaaggacaagtggacaacaacttgtgttctctatggaaaggcaaaacctggatgaacataacgacggggacgtaagttatttacagacaaaatgtatggatttggaggagttcaaaagaggggggggggggggggggcaagatggaggtaaaatgcagaaaagacagaaggcgtattgtgcatgatttgttgtttcagcttttccttctatttttcctttccttagcaaagatattcaattacacagatgggtgttgtaagtattgaaattgtagctactgctgtacaatgggaagtgaaatgcttctcatgcatgtttctgtctgggctatgtctatattatgagccctcgaaagcagattgcctggtccgaattgtttgaaattttaagtttatatattgtattgattgatatttattttgatttttgtaagtttcttctcttctcaattctcatgattgccaaaccgtgttgaaattttggatctgggtctggccttgtccaatcttgaaacaaactatattttgtcagcaactttgacttgcttaactgaagtagacagattgacgtaagcaatgacagattcacagatccagtttgtattttaaataacttcatcctgagatcttcccacatggtcatgttactgctttttttaaatcctgctttaaaaaaataattgggcaactgaaaccacactggaaaaatggaagcctcggatgcttggcatgttaggaaactaaagcgaaaaaatgattccgtcaattaggttattattacgattcaacatactcctactcaggggtattaaaactactgaatatactaccaacgtcagagatttagaggcaaattcagaagagtagcagaagaattcacgtctctgctaatggtccatgatatattactactttggaagaaatgaacagctaatagaaaaatgtcaacccatgagtgattagtttcttgcttacaactacatggaacggtgttctttgtttggaatttagaggaatcatgcatgtcgttttcttccaagttcgtgcagaactcctggacaccggacagaagtataaaaactcaagttgattgcggaattcgcatgcgagtgtatggcattgagattgactcaaacataaggtgttacgttgatcaaatgctgaacttgtttattgtcaatgtgttgttgttggtcacttggttgttcgagttgggttacctaagttgatattgatgggggtcttaagcgaagattgtaaggaggaaagacggataagcaatgatttattctttcagaagtcttctgtgttctgctacgaggattgatagtagggtactgcattggtgaaggtttcttagtcaccaatcttttttttataaataaaaagataatgggtagaaatacagcctttatgttcataggtgaatatacgaaaccaaagattacatgaacatactgaattcagtttcagttgccgagttatgttttctatttcagagcttgttcttcttccgttgtgtcagtcagcaaatctggcactgttgcttctctgatcgttgtgtagttcagctctgtgttgccagtgttaacaaccaaatttggtaatatcggtatcggaaaagaagattagatcgaagtggagttgaaggcggagatcggttcgagaacaaagcaagaatcggctggagtccagatcggctacgattaggatcggctgggtctgagtcgtattaggtaagctgatgcagccgattccgacaatacgacttgatgtatgacatcgggttaaatcgaggtacttctagatgattgccgcacatggatagagtcctgagaaaacaattgtatctattaattaggatattttatgtaatttccttagagatatgtttgggcaaaagtctgccgcaaagacttatagtatcttagagtttgttagagataagagtcgtatccggtatggacatagtttgtaattttcgggtataaatagaccccgaaccccatttaatcagggaacacacatgttcaatacaatttcggcgcatcgccaccttttgcttttgttttatttcgacgagttcttgctttcgggttgagctgcattggtttcgatcttcaacaagaggtaaaacttgttatgatggtttgcgttctcgggattagtgcttccatcttcatgatactctaatcttgtttatgtaattcatcgagttatcatatatcttacataatctctagcaatatcgttatctaacctataatcggctaacatctgttagcagagggcagccggctaggttagattttgacgttggtttagtttatataagatatccaccaccctatgaaacctccagcggcttgattgtatagatattgttcttcttttcatacttaatgctgcatcagttgagtttgatctattaagtcgtgcttagaatatcaatctctagcctgccttctggttgccgattagagtagcatcggagtttcagccgatcttatctgatttaactatatttgctctatatgcttcattgatacgttaaatatgtcctttatgtcaagatattattgcatctaagtatattaagcttctgtttggtatattctgcttgttttaaaatcttgacacagagttgtatcggagtattagccgatacatgctagatctatctgatcagctatgttatgaacatatatagtcccattattaatatatatttcgatctaagtgatttatactgtctcggcatggcgaccgatctatcccaatcacttgatttaaatatatatcgatataagaattatatattgttaatatctttagccgatcgagtagatttagttctttattatctatttccaactgccgatcgatctacatatgacatcggctcagagataaatgatatgtcatcggcacttagccgatcggctatcatttatagatttaactgcggtttctttgtctatatttcttgttgattgcaggatcaaatcaactggcacgctaacacacccgaagacgagttttggacatgcactggagttaagcagatctcccagacattgtgttttacgtcaacagccagaaacactttgtatgatcttactagatgagtacccgcgggttactgcgggataattatgtgaggctagaaacaattgagataatatggttccataatagaagagagaattaacattaattatacttagtggagattaagtttacatatatatatatatatatattgtacgattttctttcatatgctttatatattttgtatattaatcaattattcaaagattataaatgattaggttgtatgttgtggtttatgagagaagagaggcaatttgcattcttggtgaaatcatccaaaggctaaaaacaattaagatgatgtgactttataaaagaagagagagttaacattacctatatttaatggagataaactttatagatatataggattacaagttaagcagttttatatttcttgcataaggaaacatatcctctaacttaaaagatacggacatataaccccgctacataaaagaaaagatcttcttcgcttgcacttaccatgcggcagacatccaccagtacattattagtactggatgtagtggtaacctctgaattcagagcggcgccaaaagaacctaaacagcatgactgtggaacattagtacattgatgattcatcattcagtattcataaacggatcagatcgtaacagcatgattgtggaagacattatgcctacgttgtactatttcaggaccgtccgcatcagttgcacagcacagataaaaggtatgaccttttcaaagcaaaaattggttcacaggtaggctcggcaggggaaaaactaatgatgttgggccacattttgtctactctcagctaggcttgggattagtccggttgactccctcgaatatgagtgtaatctgatttgtatccctcaactataatactagatatctagactccccaactataaaaactggtgcaactattaacttctaaaatagtattgagagtggtattcgctaatgtggcgttcacatgtcatcccagtcatcaaagaaaattaaaaataaagtaagacccacctgttatattcccatctctctccctttccttccttctctatcccacatactctcttaacgatgttttctccccatgtcaagggagctgggcggcggcgacaacccgatgtgtggtgcccccacgaggagcggcggcgtggaacggtctccggctcttcgccgacaccttccaccaacaataaggagcggtagcgtagagtgaggatggcggcacggagcggggacgaggagcgactgcgtggagtggtctccaccggcgccaaggagcagcagcgcggagtggggatgaggacggcgacacggagcagggacgaggacggcggcgtggagcagcaaagacgagagaagacgagtagtagcggtgtggatcagtctctgcctacgctttccaccgacgatgctgagcggggatgaggagcggtggcgtggagcgcgctccccatcttccctgatggccgatgccttccaccatgttgttccgtctccgccaccaaaattgtgccgtgaatgaggaggtgctcagggtggctgatccaagcctcgtcgaggcaccgcttgatgcggaaggcctgcgatcacatcaggttgcagccaccgtccaactcccttgccaccgttgtgcactcctcaatgttccatccccctgtcgtcgcccgcccgctcatggtggagaaaacattggggagatagtgtgtggggtagacaaggaaaggaaagggaaagaaaagggagcataacaggtgagtcccgctttattttaagtttttctttgatgactaggataatacgtggataccatgtcagcaaatactgctctctgtactgccctgggagtcaaattgcatcggttttaatagttggaggaggatcaagatatctggtattacggttggaaatacgaattagattacactcatatttaaaggagtcaaggtgaaattattgagctaggctttagcctaccacaagagcatcgtgctattgtatttgcagccctgcccctcactcgtgcacgtggtgttttattttttctttccctcgtttataaatctcgaagcaatgtataacggtccaacggtctaaattttgacaaattttctatagaatttcaattgacaaatatctagcaaaatacaatttcttttatttaccgataatgatgagtagtacacaatattagtaccaacaggatgcagagtagcattaagcatgctacagcgacacaacaatccgagacagaatccagatatagagattgtagatttggctatgatatcgtttgttagctcagaatcaagagatgttgatctaatagggaggaagtatttttttttaaaaaaaccagcttaagaggtgccttttttttgacaaattgaccctttacaaaaacttatttcaaaaataacccctaaaaaaaacttcaacaaaaaataggccgtcggctccgcgccaatgctcttggcgctgagcttatacacagcaactccaactggtctggcgctgacatcgtgccaccatggcggccgagccgatcccccagccgacgtggcagggacctcagcgccaaggcaattggcactgaggtggccaacgtcagcaccaagcgcattggcgctgacttttggaacttagcaatgtctctgatgggtgctctacctggcgctgagatttgaaatctcagcgtcattttgcttggcgctgagtttgcagacaacacagcaacctgccggctatctgcgccatatcaatagcccaggcaagttacaaaagcagcataggcacattttgtcataaattcaacatagtaagccatttcatcaaacatccatccattccatccatttcaacacacaagcatacattgcagcacaggaacacaactttcagaaaccatccatccattccagcagaagcaaacattgcagccattccatccatcaagtccacacatagaaaataaaagtcgtagtccataaacatccatgcactttgtgaaaactattgaggcaatctacctctcgtggaggctgttcaagtcattatataccagacagagatacaacaatagtacaactcaagaccgaatcgtatattactaacctatacagattctacatacacaaggaaaacacctatacagcatcgaaaacgaatcagttatgcagtaacgtaagcagcagcatctctattgtttaacactccccctcaatcataactttgcacaagttaagattgttcctgaaaatttgcaacttgcttagagattgtgccttagtgaaaccatctgctaattgatcaccagaagatataaaccggatatccaacaaccgttgcgcaacccgttctctaacaaaatgataatctacttcgatgtgtttagttctggcatgaaacacagggttagcagagagataagttgcaccaatattgtcacaccaaagtactgcagcctttggttgtgatactccaagttccttaagcaaggtttgaatccaaatgacttcagcagtagcattagctaatgccttgtactctgcttctgtgctagagcgggaaactgtagcttgttttcttgcactccatgatattaaattggaaccaaggaaaatagcaaaaccaccagttgaacgtctatcatctgaacatcctgcccaatctgcatctgagaacgcactaatagtagtggagtctgatcttccaatttttagaccaaatgtcaaagtgccactaacatatctcaaaactctctttaccgccgtccagtgcaaagttgttggtgagtgtaaatattgacatgccttattcaccgcaaaggctatgtcaggacgagttaacgttaaatattgtaacccaccaacaatactcctatactttgtaccatcttcttcactcaacagtactccacctaccgatgaaaacttttccgaaacagcaagtggagtacttaccggtttgcaattccttaacctagctctactgatcaactcagttgcatatttcctttgtgacagcaccaaacttccttcagatgacggcgttacttctatacccaagaagtaatgtaaattaccaagatccttaagtgcaaactcagcattaagatctttaagtaaagcaggaatagcttgatcacttgagctaaccacaatgatatcatccacgtagaccaagaagtatataaccacattacctttcctatagaaaaacaatgaagtgtctgccttggaagcactgaacccaagttggcatactttgtcatagagacgataataccatgctctaggagcctgtttcaaaccatataatgctttgtctaacttgcacacataatatgaagaagacttatcaacgtacccaggcggttgcttcatatatacttcctcttccaaaatgccatgaagaaacgcattcttgacatctagttgacgtatactccaacctttggagaccacaagagacagaacgagacgaatagtagagatcttaacaacaggactaaaagtatcctcgtaatcaatgccatacctctgcttaaatcctttcgccaccaaccgagctttataccgatcaattgtaccatcagattttcgcttgatcttaaacacccacttgcaatcaataatattttttcctatcggtgcaggcactaaatgccaagtattatttttaatcagtgcattatattcctcatccatggccttcttccaattttcatcagctagagcatcatcgaaacaagtaggttccttgtcagaaccactatacataccccatctaatcgttccatctgtacgagtaagtggcttacgaatattactttgaagacgagtatgaggccgggacaccacaacaggctgaatgttctgttgttcaccttgctgagccatagaaggtccagaatccgcagaagattcaagagataaagtctcagtagatccagacatctcaccaccagaaacggacaatcccggcgtagactccgaaccggaacctgccgcaccactcacgtgtgacccaggagaacaagttggtgatggaggtgcagattccgaaacatgcgacacttgcggtgaccccgaaacagatacttctggcatatgagtagaagaagctggaccaatgccagataaaccaccactattttgatccagattatcatcaccagaatcttgtacgtacaggccagcactagaagcattgttaggagcattagtctcaaaagaaaaactattaatcataccccttgatgataacaaagattctggaagaagagaaatttcagctcgaagttggtttccagcattggaatgaagatcaacaaagggaaaaacagtttcgtcaaatataacatctctagatatatagacccggcctgtggaaatatctagacacttataccctttgtgatgaaaactatacccaaggaaagcacacttttttgaacgaaattggagcttacgtttgttataaggacgaagatttggccaacaagcacaaccgaaaactcgaagaaaggaatagtcaggcttagtatgaaacagaagctccaaaggggtagaaaagttaataactcgactaggtatacggttgatcaaataggtagctgtgagaaaggcctcatcccaaaatttgagaggcatcgaagcatgagcaaggagagctaatcctacttcaacaatatggcgatgtttgcgttctgcagagccgttttgttgatgtgtatgaggacaagagatatgatgtgctatccctattttctggaagaaagagtttagacgatgatattcaccaccccagtcagtctgcatcgtaagaattttcctaccaagttgtctttcaacaagatgctggaaattagtaaaaacttggaaaacttcggacttgttctttaaaagatagatccaagtaaatttactataatcatcaataaagcttacataatatttgaatctccccacggactgaggagcaggaccccaaacatctgaaaagacaagctccaaaggagcagacgaccgactgactgacctagaataaggtagttgatgactcttagcttgctgacaagcatcacaaactcgctcttccctcgactcactaacagggatattatgttttctaagaactctagtcacaaccgaaaaagaagggtgaccaagacgactatgccacctagactctgcagaactagtagaaacaagagcttgacgtccctgaggtgtagtagacttcaaaggaattggatacagaccaccccgggatctaccttgaagaagagtgctcttcgttgtttgatccttaacacaaaagaatttaggatgaatttcaacaaaggcatgattatcataagcaagacgatgagctgaaactaaattctttttagcctcaggaatataaagaacattattaagagcgagatttcgattaggggtatgaaaaatagtccttcctatgtgacttatactcatacctgcgccatttgcagcatgaacttgctcattaccatgatacctttcctttgtcataagtttctcaagctccccagtaatatgatctgtagcggcagtatccaaataccaatttgtatctaccccataagaagatacggctgatgccgactttgcttgctgatggtgctgctgaaagattacatcgtctccagagaacgatcgatcaaaacgcttccagcatgtatgcactgtgtgaccttccttcccacacaattgacaggaaggtcgagaaccatctccacggccacggccaccacggcctctgccaccaaaaccactaccgaaattgctgccaaaaccacctcgtccacggccttgaccttgtcctcgtccacgtcctcctcgtgacgcgctgttagccgacgagtgatagcctccttcagattgattatttagatgtgcctcaaacgagagtagctgggcatatagatcactgagtgatatgtagtccttggaggagaccgaggcaaccagaggattataatctgcgtcaagtcctccaagaatatatgaaacaatatcatcatcatcaagtttcttcccagctgcagccatctcatctgctaatcccttcatcttagtgaagtatgcagcagccgatgaatctcccttcaattctcgagccaattgcgcacgaatctgaataattcgcgccttagattgcgaggaaaacatctcgttaattgcagtccagacttgtctggcactctcaagatgtgcgacttgcaccagaacttctcgcgaaagcgtcgagagtaaatacccgagtacttgttgatcatgcgcaatccactgtgaataggctgggttgttgacggattccttcaccaaatcgtcgcccacctttttctccaccgtgatctcaggtgatggcacctcttttgtgccatcaagatatccagtaagctgtgctccacgcacggccggcaaaacctgcgctctccaaaccaggaacttgtctctggacagcttttcagagacgggatgtcctagcactgccaatgaagacaaagtcgacgaagaacttgatgccatgactagatgttttgtggaagaggatgctctgataccatgtgaaaactattgaggcaatctacctcttgtggaggctgttcaagtcattatataccagacagagatacaacaatagtacaactcaagaccgaatcgtatattactaacctgtagacccccgattttgaaaatcggaaatcttctgtgtttatccgtaccaatccctggatcagtagttggtacacacatacatagttggatcacaacatatcacgaatgaatttaggctaaaagagttaaacacttacattagggccaggtaggccaacaactatcagagaacaacagcggaagacaaaataatataagggcccggttaacatgccacaggcagtcgactggggaacgagacctagaacaagaccgcactccgatcatcttgtgggatacacaagcgtaccgacaagggcatctcttcaacactctcctaaaagatatataaatagcaagggtgagtaccaaccgtactcagcaagccaccacaacaacaatgcatatgatagagggtattcaaggaatggttttaggttcttttgcataaagctgcgttttgcaaatattttcacaagcctaagacctatcatagactgatcaaattttagtttcagtgttcacattaaacaacgacggttctgtccaccatccattgtgatcccaaggatagcttcccgccattgagtcgtcatggttttctgaggacgtccaccttccctccctctcaggaagtggctccatcagcataaaaatcaccatgcaatatcccatcccacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcaaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcaggggtacaaggattttaagggtaaacaataatcaaggcatggcataatcacaagtaggacgttcatcattgcatgcaattttatttgtaaacaagacaatttcgcaattaggatcaacatgttcaaggaatatgtgatgacttgccttgctcaagataatccttattattgatataatcttgatcaaccttcacctcctggaagttgcagacgttgcctcacgactaaccgatacacaaggtctataatacgcgagaaaaaccaatattcaaacaacaatcaaatatgcacaaacaaaatatatttgctgaggtcgaacctagggttgctcatattattcgcgcttgctaatggactctaatcaagctaagagctaaggtttcttagtctttctcttgtcatggtggttcagtctagctaatggctaaggaaggattatggttacacatgcatctatctaaatagaacggttatacactagaggttatgttgccggatggattttggatcggtcaaataattactgtgaatcatttgtattattattttattaatggaggctttattttaattatgtacatatttcacttgtcaaaataaattataaaaggttaacaattacccatgctttg

SEQ ID NO: 35227 - DNA, 5734 bp, Oryza sativa
  unsure (1)..(5734): unsure at all n locations
ctcgcggcgcacggcgatgacgacgcgacggcgacggcgtgcggcgcggcacgatggcgacggcgatggcgactcggggctcaaggtgatggaatggcgatggcgcgacgagacggcgacagcgcggcagcggcggcacggggcacaaggtgacgcgacgggcggcagtggcgacgcgacagcgggcggcgcagcgcggggtgcgatgacgcgacaacaacggtgatggcgacgcggcagcgacggcgatggcgcggcgcggcacggggctcggcgcgcggcgatggcgacagggcggcgcggggctcgagacgacggcgacatgacggacgcaacgcgcggcgtggggcgcatggcagcggcggcgcgcggcgcgaggcagagacggcgacggcaggcggcagagagagggggaaagaggagggctgggttaggggaccacgtcgagcacctagagtgcaatgaacagtgccattttctatttaacccgattttagtttatttcccatataaatttaattctataatttctaaatcttgcataaatgaagtttactcaatatttgtgttattctaaccaatggattcaccctagattaatattactcatattttatttttatataatttatttgagttttaattagggttaattcttattccatcgtacttaaatttaattgatccaaatatggtcgcgataatattttatttatttctatccacacctaagctttattttaatttgtatttactccttagcatttgggtgaccatattaagtgttcaaatgtgaatttgcccaaaatttaatattgtccaatatttaaggtttattaaagattctataattttctaatgagaccgttattaacacaatagcacattagctcaatttatttatatgttagtttattttatatggagaggtttaatatatcaaatttcaatccctaaatgcaattaggaacttggtgcaatatcgatctacatatcgaattaaatactcccgtaattctattatatatacagagagctcagtttatttgaatgatcatcatttcatgtgtacacctattatggcacccacctacattatttaaatattttaatatttgataaaataggttaataataactttttcttttatttgattttaatatcttgtgcataattatttgtaggattaaatatattcccgtaaatcatatctattgcttaaatgtagttcttttctttattttcttggtgatcatttacggtttggcaagcaatagcaatcataacaaccagcatgatgcaaaagttttaaaaagttcgaaattttcgtgattttcattgtcttgaattttcaggatgttacataacctatacagattctacatacacaaggaaaacacctatacagcatcggaaacgaatcagttatgcagtaacgtaagcagcagcatctctattgtttaacacacttaatctatacacatcaactccggcacatccatccatacacttacctctccctacctctagtgcgaggatgaggcacatcgggagtgaacctccactcttgggatggagctcgcctacgtcgtggtcgagacggcccagcctgtgacgatgactcccctcacttttaagttagttaatattctcaatcgtggcttggttaggccttgttcggttacacaaggattcattccgggccgagaatgataaggtataacaagaaatttataataggcacaacaaaagaccgggatttattccgggtcgagaaccaatttactcatattaggtacaacaaaacatccggattagttccacacttcttgactagtagattgattcccgatctcttattgtccctatcataagtaaaatagttcccggctcggaataaatcccggtgtcttgttgtatctatcataaatttcttactatacttgtcatttccggcccggattgaattcttgtgtanccaaacaaggcctcaggaagctctcgcaaatgttgatttgggtcgtgggggcggcgagtagaaggaaacaaccggtgacggtggcgatagctagtagtgaccgatggaacggctttgcatgggtaggtgtttctacgagagagggagaagagagaaaaggctcgtgctcactctggcgactcatagggctagtttgctttgtgacctaaattgaccttaccaatttttgttaatgtcaaattttggtaagttttggcatagctaatcttggcaaggtaaagttatttttggattgaagccaaaacagcctaatttcactaatgaaatggcctatttctttaggcatgccaaaatttagtttctaaccaaatagacactaaacactattaaaattgataaatattggtaagaccaatttaggccacgaaccaaaccagtccatagtggctactgtcctcctaaccttgaatgaccgatgaagccacagttaatatattgaccaggtttaatttgcacacgtacggcttgatcatgcatcggcagttgattttttagttctgatgggagtcgggccatgccgggttggcacggtctggcccattcttcgtgcctaatgggccgtgctagcctgtcacggcctgattgtctatgacattccagcacgccctcttcaatgaggaaaaagttcactccaagtcccccatctatggtcgagtgcgtccctcaaccgcaaaatcagatataggacgtttttcaactagaaaaacagtgtaaatcaagtcacaacagttttggatggtggttttatcatacgtggcacattggcctagtcttcgtccgacatggccttacgtgaaatttcagtcaatggaaaaaaaaacatatgtagtgggacccacacttagttgtaattctagaaaaaagatttaaaattgtgtacccacatgtcagtcaagaaaaaaacctctctctccgctctgttagtggctgaggcgtggggacggtgtggacgcatgccgaggatagcgactggcgaggttgaggcggatgcggttggtagcatcaaagaagagggagaggagtagggcatcgtgggagcttggacgttgtcgctagtgtttacaagggtgaggaggagggtgtagcggaagcaggcaggcagggcgagacgcgcaaggacgacccatgtagaccaggccgatgacggcatggccaacgagaacgaggtggatacatccaacaatgtcaaagacaaggacgaggaggatggggatcgtgggagctggcaaacgtgggtattggcgcaggaaaggaaagcccaaggacagcgtgtggaggtaggcttaggaaggagagagggcagagatatcaagggggtgatgacgtggcccccctgcatttttttttaatttttatgcaaacaccactgtattttatcttactccctctgttttttaatagatgacgccgttgactttttcttacatatttaattattcgtcttattcaaaaattttatgcaaatgtataagatataaatcacacttaaagtattatgaatgataaaacaactcataacaaaataaattataattacgtaaattttttgaataagacgaagggtcaaatatgtgagaaaaagtcaacggcgtcatctattaaaaaacggaggtggtatattcttactgtatgtgccgcataaatgttacgtgggacagaaatctaaaatctagtcagtacgtcagtacgtcacgttagtctaaaatagtctcgatattgccttggaattatatttgctcttgatttgaaaaataaggtacgtccaccattacatgagagatataaagtggaccttttccctcggtcacggaaattcccgatcaactgaccgccgtttccgtataaggggtactatttccgaccataccgtttttatctatttttaaattttattttttctaatttctttttcatcgtattaatatcggtactgagtagtttaaatgataaatataatctattaccggccgtttccgaagagatgctaccgattctgacatttttttaacgactcacacaagaaggtgcgaagttctattgatagggcaggaaaaaattacaagattacaaccctagagggtcgtaaccaggaaaaagaaaaaaaatataccgccacccacacaccgacagcgtcaacacacaaaaccgggagaaggttaacaccggactggccgccgctaagcgtgaccgaccgccgctagacgacaaaggaatatagacgagattgcccaaaagaacaccctcagaaccaatgcaaagccaactcctagagcatgcttgcaccgatcgagaggcttcggctaggggataccaaaacaacgtcttcaagaagagaagcgacggaaaacagccgccaccgtccgtcggggctcaaaggagccaagactgggttttcacccggcaaccacccgtgagggatgagacaacacgacaacgccctcaggagggggaattaaccatcgttgtcagtcaggccaaggccatgctaggttttcacccactgctcaccacctacgaatccatggctgaagcaccgatgctccaccaccactcaacctctgctgacatgtgggaccactgcaccggcgccccccgccggccagccttcgtgcgccgaagaccgcgccacatccaccggcagctcctcctcgcaccaaggacgcctcctttaccgccggccgcgcctctcgcgccaagacggcctccatctccgccgcccgcgcctctcacgccgagccggcctccgctgccatcggctgcgcctctctgcgccaagccggtctccgaccctcctccaaccgttgccgcgtcggccaaatgcagccgtctgccacgccctcgactagccgtctgaggccgccatgcctccttccaccgccgccgccaccactgccgtcctttcgcagccatcatcgcccgtttcgggtcgacgacaccgcgttcgtaccccggtcgcggcatccttccccgccgccatgcatgtttctccgcgctttccccgccgcggcatccaccacggtcgccagtcgcctccgccagacagggccgccaccgccgagacggtgcctcgccagctgccaccacagcagccatccggctgccaccacagctcgccagccgccgccttgtcaccagccagtgcatcagtagccgccaccaccgtcactgcctcagcagtcatcatagcagccgccgcctagccaccagccgcctcctcaccagcagccagccgcggtcggcagccgcagtccccaacgcggacgccatctatctccagtcgcctccagccgccgccgccaactccggctcagccacgtcgtctaccaccgccaccttccttccccgccgccggctgccgctcccccagatccgactagcaccgcgcggatctgggcgccgccaccgtcgagcggcgtccccagccgccacctcccacatcgcatcgtccaccgccgccaccttcattccccgccgccgactgccactcccccagatccggccagccatggcagatctgggcaccaccgtcgccgccgagcggcatccccagccgccgggcgtgaaggggagagaggctacacgtctgtcgtgtgattttttcttaggcatttcacgtttttttagtcgcaccatatgtgggccaagatttatgcaagaattggtggggctgcatgcatggataaggcagtgcgttg

SEQ ID NO: 35228 - DNA, 40826 bp, Oryza sativa
atttgaaactaaaatataaaattacagtcctatataactaaaattacatatgtaaatttagttgacatgacatgtaagtgcactgtaattttgataaaaatgttatgtaagtaaatttgtattagttattttatttaaaatataaaattacagtcctatataactaaaattacatatgtaaatttagttgatgacatgtaagtgtactgtaattttgataaaaatattgtgtaagtaaatttgtattagttattttatttcaaatataaaattacaatcctatataactaaaattacacatgtaaatttagttaatatgatatgtaagtgcactgtaattttaataaaaatattgtgtaagtaaatttgtattagttattttatttcaaatataaaattacagtcctatataactaaaattacatatgtaaatttagttgatatgatatgtaagtgcattgtaattttgataaaaatattgtgtaagtaaatttatattagtcattttattttatagtccgttggatgcaaatccaaagaaagaaaaaatctaggtgattttttatcatccgagtgatgcataggcggttccgtagcaaaatcgtgttgctacacttgctaaaatttattcgttgacttccacacgagacataaaatgaacatatttttcagctcattgtgatttttgcagctcaggttctaattaattacctcgtaagattacttcctccgtttcatacatacatacatacatacatatataaatatatatatatatatatatatatatatatatatatatatatatatatatatatatatatatatatatatgggcaatgctagaaagtcttataacctgaaactaaactagtaattaatttgtacattatttcttcactttatccagggttcaatctattgaaaaagaggaaaatgtttgagggccagcaaaattacgaaatttccgaaatatttcaaaatcgaccaaaagcagagtttgaattcaaacaacaaaaatgagaaaatttgccctagagacatgccatttctgggtgtgttcggatctcccagctcccaactccttcttttgttttctacgcgcacacagttaaacgttgtgtttttttaaaaaagtcgaaagttgcttaaaaaatcatattaatctatttttttaaaaaaatagttaatactacctccgttccaaaataagtgcagccgtggatattcgtgcccaacgtttgaccgtccgtcttatttgaaaaatttataaaaaatttaaaaatatttagtcacacataaagtactattcatgttttatcatctaatagcaataaaaatacaaatcataaaaaatttacaaataagacgaacggtcaaacattgaacataaatagtgtaaaactgtacttattttgggacggaaggagtacttaataatcacacgataataaaccgctccgttttccgtgtggagggattgaggtcccaaccgcctcttacgaacgcacgtcactacgacgaggacaaccgaggacgtgagacctcattgcccctgacgtccagatatcgaaagggccactgccgtcgacattacctgagatttgccatcgtcgacatcgccagagaggctgctccgccattgcgcaccaccgacaagtcgttgcgcctgcgttggagagtccgctccgccgctgtttgtagccaccgccgagaattgtggcgagccacctttggtgccgggaagctgtcgcgtcgctaggatcgaggcatacggactgttttgatcttagaactagggcctaaacgcgtggttacatgggatatacggacacatatttaaagtattaaacgtagactagctaataacaaaacaaattacagattctacctggaaactgcgagacgattttattaagcctaattaatacatcgttagcaaatatttactgtagcaccatattgtcaaatcatagagcaattaggcttaaaagattcatctcgcaatttacacgcaatccgtgtaattagtttttttctatatttaatactctatgcctgtgtcaaatattcgatgtgacaggatgaaaaatttttatttgaaaactaaacaagcccttatacggaccgaccaagttgttataacgaagtgcaaaatttgcaaattggtgtaccaatttacacccgccatacaagtttgtatagcgtgaaagcaaattacttttatctctgttagggataaaaacggagtggatatggacggataatgctcatataatattcgtttttatatttaccgtatacggaaacaaatacagatagcttgaatacggaataagaatcaaatatgaccagacatgaatacgaaaacaattttttctcagaacacgaaaaccaacttaacttctaataaaaataaatatcaacgtacaacctccaaatttaaatatatgacgccgttgactttttgttcaacgtttgaccattcgtcttattcaaaaaatttatgtaattatcatttattttattgtggattgattcgtcatcaaatattctttaagcatgacataaatattttgatatttgcacaaaaatttgaataaaacgaatggtcaaacgttggtcgaaaagtcaacggcgtcatacattaaaatacggatggagtatataattagctcactttatattaaatgtagtataatttataaatatttttaaaaatttaaataatattaatagtgtggactagtgttaagagataaaccactattaaaatctaaaaatgtattttaaaggtcatagagttataaagaaacggggtatgtctcatggcttctgcggatatccgaatagtaatgttcaccgaattattatccgtatccgatggaaactccgatgccatattcgtatctgtatccgaattatccgatccgaaaggtatccgtattcgtttttccccggagcggacagaaactatccgctccgttttcatccctaatctctgtacacaagctccatagatctgctggtagcagtccacaaatctgctgccgtacatgggcattaggcctcaatgagctagagggaacattcagcccattttcttcgtaagaatgagccaagcttgatttgctgacatgcttctatgttacggagtaacttataaccagcatatacttttatgatgacaacattacttatagctagcgacataatgaccattattattcgtaaattatttttttgatttaatttgatgaaaggggactgtgcggttgatgctaaaatatgggaggtggcaacaagtgtacatataaattaatgaggatatttatcccactattactaaatggatttttcctaacagccttgtgttttctacggtggccagcgctgccgtcaatgatcaataaccaatgaaaatgcaccattttcactagcaggtaaccttgcctagccgccagcggaaatggttttcgcaaggagctaggttaagctggccatctatggaagtttgactttttacaggtccaccaacatagatgaattttggtaataaaataaaaataccatatgcatgcagctacccatttccacataacaaacaaaaaatacaaatcaaatcgtttacattgtcactacatcaaatggatctgcaaaagggaagaacaaacacataaaaattcaccacttcaaccctagctcccaagcatagcccccttcaatttacaagaaccctagacagccaccgtggacgagccgccaccagagccaccccctctactatagccgcgaccaccacccctgattttggagaggagaggggaggggagtgggaagccgttgccagtgccccctcttttgcttctgccatcaccagtctcctcccatcccaccatcggatccgcctcccatcgctgtcgccgagagcacctcgaggctagagggagccactgttgccaagagcatgcacctggaggctggatctgggacgagaggggattgtaaagctgccgctgtcgctccctgtattgatgctaccgccgccgccggcctcctcccatcctgccatcggatctgggagaggggagggcagggtcaccgccgctgctccctctgttgcgccaccgccggccattggcctcctcccatcccgccaccggatccgcctcccatcgccagcgctgtcgttgacgcggtcgccgttgccatcaccgtcgcacctcaaggcgggagggatcaatgactaagatgaggaggagttgagaagatatatctggctgagaggtatggggagaagtcgctatttaatactacctccgtttcatattataagtcttttttactttgtttctagttaaacttttttaagcttgaccaagaatagaaaaatatagcaacattttgaacataaaccaaacgtattgtcaaaatatattaaatattagttttaatgaaactaatttggtattatatgttgctaatttttttaaaaaataaacttgatcaaacttaaaagaagtttgactattaaaaaaatcaaaacgacttataatatgaaacggagggagtatggtgatttttttaggcagtcctctttaacagtcgccaacgaaaaatcaattttcactgcaaggggacctcttaaatgaaagtgatttttgcctgtagttcgtgaccggaaaccctctgatatatatccgccggtaaaagtaaaagtgtggtgtcttaaacaatggccttttatagtgtcctttcacaaacaataacttttttttattccccaaccaaataataacaatggcaataacaattttattaataacctgtagaaacgaatatgtgaatgctggtcaaatagtgcttttattctcctaacatgaacctattatataagaatacaattactcaatgatagtatggttgctagatctccttaattagtccttgccctaattattttgctcgcagcatcttgcttggatatatacttggactgagcatgtgtacaagaatctaataacggccggtactctgtattttagtatggggattaccgattatatatttgtgatatactttagatctcggcaggcagagatcgatgtgcttataatataaatttagccccatgttccattgtctgttgtgcatgtgagacaagagatggttagcagtagaaaagaacacaaggatactttctctaatgcagaatcagcaaacaatcatttcttggatgctaacagaactttgcatacatgcatggagaaatctcttccaagctccattatatatatattgatccaagttctaactgacaattccctcttattagtttctgttgtaatgagaataagtatatcaaaatatcatggcctcctggaaattaaaagaaaaaaaaattaaaacaggggtaccataatgttgcaagagctaaattctacattaataaatgaggcatcttaatttgattggtgactaattaggacgtttgtttgcaacatactccctccgtcccaaaataaatcaactcctgtaattcgaactttgtcctaaaataaatcaacttctacctttctcatccactcttggttagcaaatcgaaaaattttattccttcaataccacttatctacctatcgaccaatactaatatgctattaataagggatattttggttatttatctacctctttaattttatattgggaagttaggagttgcttttttattggacagagggagtatactaatatgtttgattggttatgcctagctagcagcaggctagatatagatactagctagtagtacctactgaataactaccaaaggcatgtttagttcgcgaaaagaaaatttttagatgttatatcgaacgtttaaccagatattagaaggggtttttagacacgaatggaaaaattaatttcataactcgcctggaaaccgtgagacgaatcttttgagcctaattaatccgtcattagcacatataggttactgtagcaattatgactaattatggactaattagtctcaaaagattcgtctaacgatttcccctctaattgtgcaattagtttttatttttatctatatttaatgctccatgtatgaatctaaagattcgatatgatgtttttgggaaaaacttgttggaaactaaacggagcctaatcattgtgcacatcgcataatatcactacatgatcgatactccggaatagtagtaagattattctttgttgccacaggaattaagttgagacctatagttagctcacaagatatgatcgattgacagggtacagttataacgacaaccggtagcttgcctgttgttaattggaggtttgttaagggaagaggtcctattctcgcaacccgtattattgatcacagcaaaaaaaaaagaaaaaaaagaagaagaagtacatattgtcatgcactaatgccgcagattcgcatgtccctagagtgcctatcattatttctggtgttatatggagtatatatgctaacaacactattgctatcattgacagcccccatcagtatgatcgaggagggtgtgtgatcagtgatcacactaacaaacaattttatgtgatgtattatctcaaacatgtacacctaactctcaaggcattcctgtgctatatagcttgaacatacaccaaattatatgcatgcatgctacaattcgaagacaaccaacaaaaagaaattatcatgtattcatgtgtaaagcgcgctagctatagctttatatctttgaatccatctatctcacacctaaaaacacatgatgactacatgatagtagaagagaagaaacaatagagcgtcgaggaaaccaaatatcactttccttggcacttaaattaattaactagctactttcctacttgcttaattaattagtagcaggtacaataggaggctataagccagctataaacatattttaaagagataaaggaagagagagaatagtaacgggctacagatctgtagtcaactgcagcatagactccaagacgtaatgtgtgtatgacaagtgggaccagataatagtatagtgagtaactattgtatgaattgactattacattggttataaatgatttagagttagcagtgggctatacaattaaatttgctctaagcgacgttaattagaaatcagaacgtcagggtcgacgtcgtacgtcgtggttttacccgacaagcatatcgataagcatctgcgtaatctgctaaagtaatggggaggcagaggctccgaatgatgcttagctacgctttcggccaaaaacgctgcgctttggccttagtttattgccggtcaaatctccccatgatcccctaaacccatcctcgatctcctccattatcgtcttcttgcccacacacgcagcagcttaattagtttataatctctctttcttctgttaatcttctattagggttttgagagagatcgagcagtgattcatgcatcggacatttcctcgtgcccactatctagggtttccgcgcaggcagtactacactatagctagctatgtatagcgctagcctttgccggaatgccattgattggctggatgggctggatgtgttggaagaagcttcaaaggttttaaaaaatggtgaggcctacaggggttagggtttgattgatttcgtgggaagattccaacagaaaggtgcatgatcatggacgtttttcaggaatggggcttctcatttgtgtgaaacttaacattacacacatcagaacttcataagtgcatgcattgccatcaatatatatactatcaatcagtgcgttaacacacggtgcatttcgcatctacagcggtaatgcacaataaatcatgtgctcatcgatgagttgtaacttgtaactagagctactagcaatcttgcagttcttcaacatcttgacatcttgtacggttgtaccatggggttatacagcaaattaatggatcggatgggcaatgaaaaggaaaggtagctagtagctaggagaaggagatcataaccagcatgggggttgtcagcgacggcgtgatgattgctccggccgccggcgactcgccggtcgccgtcgccggtgaaggaaggagaggacgaaagggagaggcatcatcgatcggggttgggttgtcgtcaaaaggcgagcaaagagggacagcgcgccgacatgccaactgccccccaaccccgcgtcctcccgcaccacgccgcgacccgccgggtgcctacctctagtgacagacaagtggggcccacgtgatggtgcgggtcacttgtcagtgggtgggggattgaggtggcaggggagcgctgggtaggggatctcgtcgtcgatccctgtcctttgtcttctcttgtactgcagccttgtttgttcctgggttttccgttgtaccccctctgagtttctgtatttgcaatttcatatatgggtgtgtttagtacgtacaaaaattggaagtttggttgaaattagaacgatgtgacggaaaattaaaagtttgtgtgtgtagaaaaattttgatgtgatgaaaaaattgaaagttagaaaaaaaatttggaactaaactcggcctatatatacaagcagcatgatttgatttgattattatagttgtagtaatgtttatgcagtgtcatgcaccaatgcattgcccatctctagctcgaatggttaggcaaaatggctcaggtagtacttaaccgtcacactatttataatgcaaatgtttgattttttttttcaatcatacatatagaaaattaattgaaaatgaatacacgagaaatctatcggtataattttaaataaaatacttacatagtgatttaagattgtaaaacttgactacactactggttgaaccattactacatgagtaattaagtattaattattttaatcgtaaaaatagattaatatgatttttaaacaactctattatagaaacattttttataaaaaaatacagtgttctgcggctcgaaatgtgagcacgcaaaaaatgggaattctctcacatacgttgctcactaagatggtgtttgaaactggtgaagatgaagattaagttagcgcacgtaaaacgagaaaatcattagcacacgactaattaatttttaattattacaaacttgacaaatgtatatatttgatattttaaaacaacttctatatagaaagttttcgcacgaaacacactgtttatttatagtttaaaaaacatgctaacggaaaccatggtaaattctgaatcttttacgctgaccactgatgtagagagctgacaaaatttttaagcagcaagcactctgtcttagggcctgtttagttcccaaacaaaaattttcacgctgtcacattaaatgtttggacacatatatggagtattaaatgtagacaaaaaataattacatggttcgttaggaaattacgagatgaatcttttaagcctaattacgccatgatttgacaatatggtgctacagtaaacatttgctaatgacggattaattaggcttaataaattcgtctcgcagtttcctggcaggatctgtaatttgttttgttattagactatggctatgtttagttcccttcaaacttccaatttttccgtcacatcaaatgtttggatatatgcatggagcattaaatgtggacgaaaaaaacaattgtacagtttgcatgtaaattacgagacgaatcttttgagcttaattacgccatgatttgacaatgtggtgctacagtaaatatttgttaatgatggattaattagacttaatagattcgtctcgcagtttacaggcgaaatttgtactttgttttgttattagtttacgtttaatacttcaaatgtgtgtctgtatacgtcaattttttttaccaaaacaactaaacatggcctatgtttaatacttcaaatgtgtattcatatgtccaatgtgtcatgtagggattttttttttttttgccaaaatatgtttggttttatgggacgaaaggagtactgtggaattctccgcacccacgaggaccttaaaccaaaaaccgcccacacgcgcgcggcgcgcgccgaaccgaggacgaggcagcacagcaggtagcgcgcggtgggccccacccccaccccccgaccgcgcgcatctttataggcagcatccgcgcggccaccaccacccaccaccacaccccttgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaagtacgtatagcttatgctctctttatggagattcctacgttcccgcgggtttctgacctggcgatcgatcaatgcgtgtgcgcagggcccgggcggtggggtggcccccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatgtaagaacttgcgatccaatccactataataatccaataacattacattaccaactatactaattactgcaacgatcgatgagtgaatgacatttcgattctgaattttttgatgcagcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgtcatttctgtcaggcttttgatgtctccttttgcccatttctttcgatttggtggtgctgaatgttgttcttttggttggaaaattgcgagcttggttaggtagatggtggtgattgcggctgtggaaatcattggcagtgggaataaccaatccatttttgcgcatggacaaattcatccactgaagagagccagtgcagaatctgaacccaaaaagggaacaatccacgaatgcacgaactgatcattgaactaggcagctagcggttgcagtccataaccagcattttctcacggctgggaagaaatctactgcctctctaatctgaaatactggcctgttcacgtgaattgtgatctgttgatgcatgataatctgtggcccgatcaggccgcctgcaaattcagtttctgcacatattagttgatgctcaatcgctacaacgagtactgttgggttaaatctattgatgatgacggtattttatataggtccgacacagataactgctatcggtgacggtatctgacctgacacagataacttttcacatcactgaccaataatacgtgacgtagcctccctccgacacagatgatggttcctgcctcacacatatgtcctgttttgcactaatgagtgtacacagaatactgtataccaaattcaggtagtccacacactaccgcatagacaaccccattctgagcatgtttacacttgcggttgcccaaatatacatgtcagtactagcagtgacatcctgacagcatgtcagaccgcttgctctgcatgttactgtagttaaggaatcaaacttgcgatgcagcatatgcggaagtaaaattgccctggacggcaggacccctgtggtgatgatacatgcgctaagtatgtgtgcccatagtagatggtgtacaagaacccgtactgtatgggttatctgctgtcagttgagttggagaaattggatagataatacagcacgcgtgcatcccagagatgtggatgtgttaaaagaaaaaaaaactcgaagcttggctcgtcctagatggattcgagccacaaacgagtcaagctcaagcccaaactaaagctcgcgagctttgctgagacaagctcaaagtttataacgagctggcccaacctcatatatgctgtagataatagcccaccatagaaattaggaagcacactagcctaaggagaggaagaggcacacattcctgaaaaaatttccgtcgatttggcttccttccgtgtgatcactcatagctgttcgcctcatcgcctattccgtcgcccttccagccgcgttgtcttgttccgatggtgcgacctaacctacgcagcgtagctacgtctacgactgcgagccagagatacctatgcgcggctacgcgtcgacgacgtcgtgctctgcggcagccagcagccgattgcaagtctctccgtttagttccgggaggtatctaatttagaagaaattattagatgaaattgatattgatgccatagtgaatatgacttcgcatcagtaaacgttagaagaaaattttaaggtaagatatataactcatttaataagaattgtttttatgcattacatttattagaaatatcgttatattattatggttgtattaaaggaccttttttctagatttgctccagaccactaaattgaaatgaccgggcctggtaaacccaacgagttcaaatgaaactaaggatgatttacaaaatttaccagtgctatttgtgatttagcggaacgtgctaccggaactcccatcacgtgcaccctgatccctcgcagcactcacagctcgacacgtgtcccgcatcacgtgtcctccgcccgtccactgctttgcgccgacccagcaaaacagcgtgagacccgcacaccggatcacgcggcccacaaaaactaaccaccacatcctaatccagattagagagcgcgattagtctaaaccgcataataatttacagaaatgcccctcacctcccctttttattttattttttttctattttttttccgcagccacctccccttctcctctcttatcgcaccacgcgcactgttcacactccacagtatgttcgctgcgacgacgcagctccaaatcggaaccctaaccctagtagtcctcctcctcccgcgctcgatccgaggtcgtcatcccgctgattccgaggctctctactgcggcggcggcggcgatggaagagcataggcttggcggcggcggcggcggaggcggaggcggggggaggccgccgatcccgggggcggcggggaggaagcttccggggctctcgcggcacgcctcgttcgtgagtaacccccgccctaatcttagctctttctcggcgttgtaaacttggttttggtgtggtttggttgggtgcttgctctgttcttcgctgggaaggcggcgaggtgtgatatatatatattttttttttggctgtggaggatttggggataatgtcggcatgatgtgatgggcgatggagtctaattcggggatgaggggagtgaggagaaggaatcttgggctctgaaattgccggtacatccttgttgtacttgggtagtacaccaacctggggcgagatgtttggatccgtgcggtttatgtggaagcagcgtattgggaaacattgccttgggttgtatgaaatggttggttttatcaaactgtacacagagtgtcctagaatgttttgcataaactatgttagtgctttgtactatcagtgtattttggcggcctgtattcttttttgcagaatttggtggtgaatttgatgttttaactttgctaactcattaggtatttcttccttgaaaaattgaggcaacaatttttcagggcactgtaaaagtgaggggaaaggggatcagactggtaattttctgtatgtgtcatgaaagtgtcttaattcttttggtactttttgctcttgtcctgactacatggacccataacatcattgaaaagaaataaattgaaaggtacttcgatgtctctgctcaacagtaattgcccatttaagttgtccacagtcaaaaacagcaaagctgttctaaatgatattctgtactccttccagtttcaaaattcttgaccttttagacataatctcacataccaaggagtgatttattagggtgcctaatccttgttttgcccatattaaatacggtcttgtcctaatagaaatcagaaactcgtgctgttccaagtggtttgggcctatcattagcgtctgtgcatgccgggttcgagttctattgaggctattttttttaaaaaaaaatcatagcgttatcttggtaatttttggctcgctcgcgcttgctttagcacacaacggttgctacatcatcactgtcatcacacccgctctcaacgagcaagcggtcgccgagagcacggcgccagcaagcagcccaagaagccaacaagcgattaattaggagatgagacaacggcccgcgtgtgatgtttaatgacatacacgacgctagaaacaatgcgttggatttttatgcatgcatgcaggagcaagcaggtccaagatactttgcttcaagatctaaaacgtcaactattttgatactggagggagtaaggggttggcaaaagtggtaattgacttgatatcattgccttgctgattttggtttcaatctcgtcattctttccggtattgtttagattataacagtggatcctttagatctacactgcacattgttttttcaatagaagctagatatggtgatacacatagtatgcttccataacaaaatatatgcacttgcctgtccatttgtagttatgtacttgtctgacactgcatgttgcttggtaatttctagtagatcacattatttgagcaaggagggaaccattataatgtcacacttaattcacatgggaggggacaagaatagttgtttcatagttacaactaattgcaccgcttttgggcatgtggtagggcaaacttaactatagttagtatttgctataaaaattttctcttcaatccttgcaattaaatcattttaattgggcatccacggacgagcctaggcagccattgggccatggatcagccagtgagtatgagtgatattcactttcggaagaaccgaatgtattccctctgtcccaaattataatagatatattttttacacaatctttaataacatactttgatcattaatttatttcatattatgtcatcaacaactataaaattattatcacatgaaaatgttttaaaatatgaatctaatgatataacatacataatacttggtgtagatattgttagtgtaattattagtcaaaagttaccgagtttgatttttctaaaaataagagtgctctacaatttgggacagagggagtatatgacagtgcaatttttgtttttgccttttgttggatcaacattgttaatatatgtatgagataatctggaaaccctttttgggtcatggtagtgcaacttcaaaatgaaagagcatacaacatagattctgtgcagtatggttaattatttttttgtcatgcttggcattggttttgcaggtgaggagtcctgcaaacagtacaaaatctggaactgagaaaacttttgaaaacatggatgctgttgcatatatgcctgttgtaaggtctggaggttgggctgatattgggtcaaggcacacaatggaggatgtctttatttgttctgataacctcatgaaagagtttggagttgaaagttttgaagatggtccgagcgcattttatggggtatgcttttattctactgtattcaaggcccagacttgtttcttgatgtatgcgatatatgttagccatttcatgactagactaacaataacaactttcctttatgagtaatttcatgcccctggcaggcattttatttatatatacccttcatatgattttaatgtcttaggtttttgatgggcatggtggaaagcacgctgctgactttgtgtgcagcaatttggcaaggtttatcgttgaggatgaggattttccaagggagatagagaaagctctgtcctcagcgttcttacagactgatgctgctttcgcagatgcttgttctgtgaactcctctcttgcttctggcacaactgctcttgctgctcttgtggttgggaggtattggcctaacttcttaaactgtaaagtgttgtactgactactgagttcctggcagcatatctgtttaactactatttgatgattgtcattacttattaatggtaggagccattccccacccccaccctgttatggccatgcagttcctgtttcgttgcctgtggccttgtgcaaattataagtcttcagtgcactcaattgtgcatgaacagacaggggcttcaaaacttatttctctcatgaatagacagcattgattcttgatctttgtttctttgcaatcgtgtgaagtgcatctatagcctttctattttgactatcttgtcggccacggttaatatcagcgtgctttagcctattgcatgctacagtattctctttcatgaaagcaattatatagtataaattttggtacccaaaaatgggactgtgtgcccccttttatagtccattatgtagttctcctttctgtctatttcagtctctgctttctgtcttgctatgatctctgagagaattatgcttccacttgggataaccaactttcttgtcttaaccgttttgccatttttcataggtcacttctggtagcaaatgctggtgattgtagagcagtactttgttgtcgtggaaaagccattgaaatgtccagggatcacaagccttcttgcaacagagagaaggttcgcattgaagcctctggtggttatgtttatgatggctacctgaatgggcagcttaatgttgcgcgggcaataggagactggcacatggaaggaatgaaggcatgtgatggtcttggacctcttagtgctgagcctgaggtgatgatcaggaatctcactgaggaggatgaattcctcatcatcggttgtgatgggatctgggacgtattccgcagccaaaatgcggtagactttgcacgccgaaagctccaggagcacaatgatcctgttacctgttgtaaagaacttgttgatgaggccatcaagaggaagagcggcgacaacctttctgttgttgtcatctgcttcaactctcggccgcctcctgtcctaacaactccaaggcctcgtgtacagaggagtatatctgcagaaggcctgagggagttgcaaagctttcttgatagcttggctgattgacatgaggcttcttccttgatagaagcctgacatactgtcgctagtgtacttccattgcttagcatggaatttttaggtttagtgcggctattccaaggcttaatgccagctatctcacaaattctctgagatagcagctgttgagtgattctggtgttgtaatgtattatgcggctaattctatctgcagtttaagtatttattggttcagggatatgctgtcttaaagagtctggaattatcagggaacatttctaagatatctgaaatggcgagtgatgttgtctattgactgtattgcaaattttgacatactatgggaacaaatgcatgtttatttactgtggttggagcacagtgattctgtagtgtctgcagtgtggtgctctgaacttgtatggtcagtcttgcacttgggtaagatcagttacacagtgactgtgccagaagaaactctagctccacagtccacactacagtcaatgtgacctcagatggttccaacagcatgttttttagtatgttctccccatgacatcaggtgcagtagaagctgaagctctgcatgtgcactctgccatccctgcttctgaatctgaagacggagaccagcaacgatgaggaggtgatgtcgaagacgtgcgaatccatctactactcccatcagcagctgttgtcggatgatgaagcctctcgccattatgaacgctctagccatcagcaatctgatcctgatatcactacctctgaaactggagtagtaggagaaaagaaaagctggagaacaaccaatcaatcattcatgtgtcctgcgatggaaatccagatcggcgaatggctctctgaagattgtttttcgattcagattttttttattgaactatacggagatcagtgatcaatccctctagcttcgctgaaacgaatccacctactctctctctctctctctctctctctctctctctatatatatatatatatatatatagcgataaatcactagtcacgctaaaatgaaatgaatacactcctaaaacatgctcaaagagactatggacaaaggataaatcctgatctcgctacgctagtgcatacataattttcgtgaacatcagaatttatattctaatagatagaattatgcaccgccacatcatctgtgcttcctgcttctctctgaatattagtggcatactggcatcgtaggatcaatcaggctctacccactccctcgctttatcgtgagaacttgcagcttttgctggcccataatcgcaaagagatcgatgctggcccattgcaaatggcagccggggcccctgcctcagtcactcagggcctaggtcactctacttcggctacagttggatgatctgttctctctttttacctttggagatttattatggtgttggtgtgggtcactgggtgctctgacactccaacatctatgctccatgttgggacatttcactttgtcctgtagctctagctagtaactaatctagatttgtagcttgtttccccgaaaaaaaagaaaaatgtagcttgtttaggacttccctaaagaacatcaagcaccctcaaaatgtgttttgagatttaggtaaaaaatggtagggttacattgggttcatgtcatctaagtaaattaaccatattcagatgctaagggctagtttggttctctacctaccaattcactaccaattcattggtagtgtaaaaacccatgtaaattttggcactatcaattactcctagttggagggtagaattctcaatttgtttggatttagattgctaccaaaaatgccaaatctaactagagtataaaagaaggtttggattgctaccaaactgagcttgggtatagccaacgatttggctccaattcaaacgtacatgattactattcaagctatcaaatgctactatttggtagggcaacaaaccaaaatgaccccaagtttgccttttaccaccgtcacccactcctctcacctgaggttatgtttgaaacacagtaattttgtacacaacaatctgattatgttagaaccgcaaccaagtgtttgcaattttgataatttcgctccccaccggcaagcacatatcgtgcctgaaatttccgttttttttctatttttttgtgaatttggtcaaagtttattcaaattcattcaaaatctattatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatttgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttatatatatatatatatatatatatatatatatatatatatacctataagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagtgctaccgttgttattaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttataagggagtttaaggccctattttttccctgattccatcttttgaattttcgtttgcacgctccatgctttcaaagttactaaatggtgcttttcttaaacaactttttaacttttcagaagtcaattcattcgtttataatctcaaatagctatcacataaatcagataattcatcaatttcagttgtcatatcccctaaagtacatatttttttcatgcgagtcatggtgataagtaaattggtgatcaacgcataatcaaagtcataagataaatctgttagaacaactatgaccaattgtaaataggtgtcaaaattaattgctattaattaaacaactaatggcttgctagcaacatatttaatttttctctacatgtatataaacatggacgaagctaaaacgaatatgaacatacatcccatacatatatatattacatcttaatattctaattacatgtggtaagtccactaaaatttcttaaaatgccctcaagatgtcacgtggtgctctaataaattagagaaaatattagaaattctaagaaaaaaagcaaagtatctattacttgattttcacttgaatcgatgggtccaatattataaaccattagattaaattgatcttagaacaaactaaatactacgaggtcccacctctccacctttggtacgcacctacgtacgtgggtacctacgcttccccacccttttttttttatttttccctttcttctttttctccatgaatatgcttccctccctttcttactatatcatgcaccttcacgagacgatttaatctatttacttaagaaaaaaatatgattcaaaagtcgtaagtacttaatccatctcccactcaaaagcttgcgaatggacttttaagataccttaacaaaaaaaatagaacccttaaattattacaaaataacagtatccgaactttagtttgcccttaatctatgtgataatttttttaacaaacaataaaaatcttacctttcaataatatatgtgcccgcgcatacgcgctggccaccttcctagttcataaaaaaaattaaaaagaaccgaccaaaaataccgaaaattctgaaatttaggttcttttagcccccaccggcaaaaacctttgtttcaaaattgcaaaccctgccggaagctccccgttctaaaaaagatataagtttaaaccttaaagtaaggcgtgtgagaagcacaactctcattaccacctactcccttccctccgtaccataaaaaatcaacttatggagatgaacctagacaaatatttgtccaaattcatccttagaagttatctttttttggatggagggtgtatatgatttgcgtattcacggactaaccacgaaactttgaacggcgaaattgatatttctctcttctcaatcattgatctacactatggctagatgccacaccacaagctcttgagtgaacaccaagcattgacattttcccttgttgcaccatatgtgggactcaagtcactcaactccaagggacccatctccaccactaaaaactgccaactcccctgcatgacaccacacatcacggcccaagaaatttctccatcagccattgccatcacatcgctggccgttaactgcatccctgcaagcaaaagccatcccttctctctccattggattcttgcttctactactccacgaaggaccaaattaaatcaattcacacactgtctatctctctgaagcagcctggtactactagcagcgatatgattagatcctgggccttagtttgtcgatcgtctgaatttttttcacagtagctcagctgcaggcatttgcaacttcagtaaattaatggcagcagaggtagtagttactgtagttaactctgatggtttcgtcgacggcaacgacgtcgacgcaggaggacgaaaaggactagacctgggcaggcaggcaaccttgccgtgcccgccattgtcgaccatagtgggggtggtggcccagctagcaaaagccccatcttggatgcagtctcggatggctgctagcctgctacacgtagacaccaccacatcatcttcgccaactatgcgctgttgcaaactactcgctttcaaattacttatcgttttagctttgtcatatgttaaacattcataactttaaatattgatatatatatatatatatatataattcactgagaaatgttttcttaacgatgttaaactatatgagttctataaattaatggtcgaagttaaaaatgtttgattcgagataaatctaaaacgataagtagattgaaacggatggagtagtgccaagaattcagagataagccagtgctggtaaaatatgtgtataggtgttgtactgctactagttggttgagcacttctgagctttgcaattgcgccctggagctggagcagtatcttatcagaatcagcagcaatggcgccatcgctttccttagtggaaacatcaggtttttcaggtcacaggcatgtaaacaaagaacaatatatactttcttttccatggtttaaccatcaggcaagagtggcaagcggccatgcatgcgtctagtagcagctagtttgatcaaaagctcaaaagcaattctgctttgtgggggacgcgttgttcagagttcagagcagtgaaggtgatggaggagacctcaatggagggccggcctcctttggtccatgcgtccatgtctccatagggtaccatggctaacaccatattatatgagtgacagtggtatcatcaacaggacatcttatgttctcaaccctcaaacatcgagaaagagattagaggacatggaggtcttagctagcacgcatcataatgcaggtatgtgttagaattggtgttgagtatatgagttgtagtagattattattggagctcaaattgtattatttgtaagtttagggtagtaaacgaacttccatctaaaatttagggatgtatttgaactttttcctacaaacaaatatcatagttttgattgcatcatttgatatcttaacagatcaataactatacagtagggagactgtttgatccacaatttcacaacaacgtggagtaggaaaaaaaatcgatttagggcttcttgatacgaaaaaatgatggaatatgagaaacacgtgaatttggtaaagatggtgtttgattacttcatacgaacacaatacaacggatctagccaagtgtcttataagaaggatagagccgtaataatggcagccacaagaattttgaatggaatacttcatttgaacatataaaaaaagagagataaagagacaagttgtatttgacttatcaaagaaaatgtaaaacacgagcttttatcaaatgtatgtttgaaatactaaaaagcggaggaaagaaagaaatcctacatgaatttttgaaatatatccctacaacctaaaagggcttcatagtaatttttccaacaggttttcaatcctttgaaactcctaaaatttcattgtttccagagaagacctttaaatattgtatacataatattttttaaaaaagggttcatggaaggtattgtgaggtagagatacgtacattgaaaatgtcaagcttgaaaatacttattttagaagatttgtttggtctatctatgctacttcaaatatgccaccaccacacttttcattggcgtgtaggtccacaatgctggtattgttggtgtttcatcctatagttttctcgctctagctaactcagtaagcatccaaaaaattgatggcgaaaatggctagataagtagacatttttaggctttgaaataaatgctaaaggtttgttttttttttaagatttcgtggcaacgcacgggtaaatcaactagtagtttttttacccaccatgagaaactgagaatcaacatataataagtcgtgcaaatgtaatttcattacttaataacatgcagcaataacaatttaccataagatcatttgccgaaagacaggattgtagtatagtgatcatttgccgacagcggcagtacagcagtagtagtacgtatactcgaatgtatcggcactttggcaggtgaacaatgatcataccgtcctctactcacccatacatatacaaacatcatgaatatacatacggccccacatttcgatttttctggtactactagtagtaggttgagcctaggaaatgacgatatggattccttatatctgggtggtctgcaaccttaataattaccatgataacaccatcaacctaattgctgtactttagcctctgattgcaatgatgaggacgagcaagatttggatcatgggagaataatcataaattctctctgccatggcattgaagctttgctatgatttgcatgcttggtttgatctttctggtgggccagattggccgtgcaaaggacatcatctccatgaatgcactggaaagttttgagctcttgtgagtaaataacttatttttagttctgacgaagaatcaaaagatttttgagacaaatgcttttggttacatatctaaggagcttcaataatcaatcagattacccagacattggtggagtattgtatagcacactatagctagtgcttggtctactcatctgcataagagcaagtttaatagtatagcgaactactaattctaaatcatctgtagccaatttaatagccaattcatacaatagttgtttactgtactattaatacctggtcccacccatcatacacacgttgcatcttgaagtctgtgctgcagcgggctacagatctatagcccgctgctcttctctctcatcttttatctttttagaatatgtttatagctggctaatagtctgctattgtacctgctctaacggtgcgattttggtggatttgtttagctggcatctcatatgaaataattgtcattaattgtcaatatgtataattttctattacatagaagattatgcacatatacacacagcattacatgctcgtacatcttatgacacacacctgaatgcatccttaacacatgctcgaagagatagagtccaacaacaaatatgtaaactcattaatttttatgcaaagcacatctacatcagtagacaccgtaatttaaaatcctaacgagcccaccacttcatcaccttacactagaggagaagtgagcttttgtaccggttagtaacccctttttaccggttctagcaaccggagataaagtaaccgagactaaaatttttgatctttagcaccggttgaaataaccggtactaaatatgcatacgaaataaaaaatgagggttgtggaattcgatctaaagatctctcacctcagctctcacgcgcataaccattccaccaactctacacatctaactaggatagaaatactttcttttatctaaccctggagacatcttttgtatatttagtccggttggtgttaccaaccggtactaaaaatattttaccaatcggaagcaaagatcctccagcattaatctggggactaaagatatatttttagtaccggttggtaataccaaccggaattaaaggtgtttttgtgactttgacttttagaactggtacttaaaaatatctttagtaccggttcttaatttaactgagatatttatgttttgggtaacgtgataaaagatcagttctccattagtgatataaatggtgctttcctaacatgtgcaatttttcctgtctcctaagtttgtacttcctctgtttcacaatgtaagtcattctagcatttcccacattcatattgatgttaatgaatccatatagatatatatgtctagattcattaacatcaatataaatatgggaaatactagaatgacttatattgtgaaacggagggagtaaaaagcatgtcacgattttgtgttaaacatgttaagcgatcaaatccggcaacacaacacaatgaatattgctatggacaatgattttaaggttgggtgtacactcaacaactacaaatatcctatttttagtgtttggtgggttagagttcaaagatttaaggtaattggctattggggtagaagtggtatgacgtaagaggctacgaggaatggatttgttagaggaaaagaaagtcaagactgaagtattatatccagtttgagtatatacacatgttacctacctacgtatattgaatttcgccgtaagttttctgggaaaaaaactttcaaatataactacaactatactaattcctatgtttttcatgcgctttatccaaacaacaattcctgcagtttcctatgttttttcaatccataggatttaagatgttaattagggcatttggggaagcaccagtacacgaatattggacacatgtaggtgagttttcattatattttagtgagattaggaatgtgccgccggcttttgtctcgtagggtatgtgtttggtgggaaaatatcctaggcacactccatgcataccaactagcaaatgtcacgaatttttttttaaaaaaatagacatttactaaattctcatattcaaatccattatattttagccataaaaaaattgaaaatctaacaattttaaggataaaaatatgtcggattttttgactttttttacggataaaatagtaatgaatttgaagataagattttacatgtaggtgtaatactattggaagtatgtgtccaattttttctagaattttttgtgcatttgctagttgatgtacacggaaaacttgtatgcataggatatgttactgtgttaggtggtgtatttgcgagggtgtgagtgtagcgctacgtgtatagtggtgtgtctgcgtgtgcgtctatcatgcaaacagaaaaaaaaaaagatgttatggcatttcaatcatgtatttgttttccttgtttctgtgtgcttcagaatcttgagttccaaaaaaaagcccaagagtcttctcatgattatgacaacaaatcaaataaaaatctaacttgatcaaactcgctaaacattaagaaaaaagtacggcgaattctgaaaattaaataaacctaacagcctctgaaatagaaagatattttagctcaaagatagggaacaacactcccaaaaatatttttggaaggatcgatgagaggttcaactgaaatgcatacgagaaagagataaagagtgaatccacgtagacatgacaggaaaagcatatctctctgaagttctgtcacgaccgagaactgaacgctgaacagtcaccgtatagtgtctgggtgtgtttagtcggggaaaaaggaaattttttgctgtcacatcgaacgtttgactggatgtcggaaggggtttttggacacggatgaaaaaactaattttagaattcgcctggaaaccgcgagacgaatcttttgagactaattaagccgtcattagcacatgtgggttactgtagcacttatggctaatcacggactaattaggcttaaaagattcgtctcgcgatttcctctataactgtgtaattagtttttttatctatatttaatgcttcatgcatgtgtccaaagatttgatgtgatgtttttgagaaaaaaatttggggaactaagcgggcccctagacgacctagaaaagctttggctcttttccttttgtttttgcacaaccccaaggctggctgcgtgtgttgatttgatttaggaccaaacttcctgggagcaagctccaaaatggaggacgacatgaacaaactaggttagcttcgcctttaccactttacataattacatgtagatgagcatgcagctcactcagcagttgggggcctggggctagttttttttgcatgcataaaacaagcatgggtcatatgggtgagtgaagtgagtgagtgagcagcatgcaggtggtacagagattgtagaggaggggatcagacgttggtgggccgaatcactccgcacgaactgaaaattattccaccatcaaaagaccccagtcaactcatcatcgacgctctcaactctagatgggctccctttctcgtacgcttgtcggggccacgggacagtgacaccctctggagcaaaatttgtacggcatcgatctgtggagcaaactttggagttaccacgcatttcggccgttggtaatccgatgcaagtttgggtcttgctatttgctactccctctatcgtaaaatataactagtggtaaccttaaatattaaagacagaatattaaagacagggataaaaaaactttgttgccttttcaaaataggtgaggcttaagtttaggccagtcacaatggaggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccgcgccacgcctccttcccgcgtgaacattcctccttcccgcgcgagcgattccaccatctcccccgtccggcgcctacggagtacaccgcaaccggtcgccccaatccggcgcctagaccgtgacccacccgccatcttccgcaagaccgaatccccaacccacccaccatcttccgccgcccccgtccccgtccccggccatggatccgtcgccggccgtggatccgtcgccggccgtggatccgtcgccggctgctgaaacccggcggcgtgcaaccgggaaaggaggcaaacagcgcgggggcaagcaactaggattgaagaggccgccgccgatttctgtcccggccaccccgcctcctgctgcgacgtcttcatcccctgctgcgccgacggccatcccaccacgaccaccgcaatcttcgccgattttcgtccccgattcgccgaatccgtcaccggctgcgccgacctcctctcttgcttcggggacatcgacggcaaggccaccgcaaccacaaggaggaggatggggaccaacatcgaccatttccccaaactttgcatctttctttggaaaccaacaagacccaaattcatggtacatgtattttcttctttttctgttactttcaacctacggtaactctaattcatggatgagactactgccattgtgcagttcaatgctttttcttcatgttatatttcgtccagctgtgagttatggtttgaagattgctgtggttgtttcattgctgagtatgtgaaagatagatggatgaaagagagaattatattttagtctgtaatcttgctcatccagttgctcatgtatgaccttggttctagaatgttgccctgactgtatgcttaatgttcagagaagtgatgcctaaagcagtgagatcagtgggatcagattagctatcgacatataatattagctatctcagttgtgaaagagagatgggtgaaaaggcaccccttggattaattctgtagtatcaaattctgcaccttgtctgtccatatgttctgcttggttggtgggtgcagtgcatttgtaaaaaatagtttgcttctgatccttaatatatgtaacagggaatgaattttcacccatctcagttgtaaaggtactgtcttgctatgcaatatgtgtaaattgacaaacctgaaaatagtctgtttggaatttgcaaaagcaattcgatagtttggaatttccaaacctcagtcagcagtaggcaatccattttagttcttgctatgcacaaaaacagtacacctgatatgctcattttaatacaacttttttgtctctgttacagtttggtcaggggttatcctccaggagggtttgtcaattttattcaacaaaattgtccgccgcagccacaacagcaaggtgaaaattttcatttcgttggtcacaatatgggattcaacccaatatctccacagccaccaagtgcctacggaacaccaacaccccaagctacgaaccaaggcacttcaacaaacattatgattgatgaagaggacaacaatgatgacagtagggcagcaaagaaaagatggactcatgaagaggaagagagactggtattcatcggatacttttacatttccatatgtctttgttttgactaatacttgacaggtcattaactgattcttgtaggccagtgcttggttgaatgcttctaaagactcaattcatgggaatgataagaaaggtgatacattttggaaggaagtcactgatgaatttaacaagaaagggaatggaaaacgtaggagggaaattaaccaactgaaggttcactggtcaaggttgaagtcagcgatctctgagttcaatgactattggagtacggttactcaaatgcatacaagcggatactccgacgacatgcttgagaaagaggcacagaggctgtatgcaaacaggtttggaaaaccttttgcgttggtccattggtggaagatactcaaagatgagcccaaatggtgtgctcagtttgaatcagagaaagacaagagcgaaatggatgctgttccagaacagcagtcacgtcctattggtagagaagcagcaaagtctgagcgcaatggaaagcgcaagaaagaaaatgttatggaaggcattgtcctcctaggggacaatgtccagaaaattataaaggtccacgaagaccggagggtggatcgtgaaaaggccaccgaagcacagattcagatatcaaatgcaacattgttggccgctaaggagcagaaggaagcaaagatgttcgatgtgtacaatactctattaagtaaggatacaagcaacatgtctgaagatcaaatggctagccaccagagggcaatacggaaattagaggagaagctatttgcggattaaggtgagttttataaactgaccactattttctgaaatgtatgaattctgaaatttatatacaattgtgtaaacatggaaaattagataatgtatgcatgatgcacaacatgtgcgtgcagcactatttaatggcagtttcacaagtgtgaaaactgaccactatagtactattgtggtgtgaaaactgaccactactattgtggtgtgaatgctactgtggtgtgaaaactgaccactatagtttcacattcctggatgcagccctcctctatatatatagatacagtcctcatctcttcctggcatacacacagccctcttctctaattcctggacgcagtcctcatctcttcctggcatagacgcagcccttctctcttcctgtttagttcaacaacattgaggtgatctgcctttctttgaagtttctatcttttttcactgctgtgaatgattatttctctgctgtgaatgattatttctccaatcttcctttgttcaccttctctctttctctgctgtgaagatgtctggaaatgaaaatcagattcctgtgtccttgttggacgagtttctcgctgaggatgagatcatggatgagataatggatgatgttctccatgaaatgatggtgttattgcagtcctccatcggagatcttgaaagagaggctgctgaccatcgtttgcatccaaggaagcacatcaagaggccacgagaggaagcacatcaaaatttggtgaatgattatttctctgaaaatcctctatatccttccaatatttttcgccgaagatttcgtatgtacaggccgctgtttttacgtattgtggacgcattaggccagtggtcagattactttactcagagggtagatgccgctggtaggcaagggcttagtccattacaaaagtgtactgcagcaattcgccaattggctactggtagtggtgctgatgaactagatgagtatttgaagattggagagactactgctatggatgctatgaaaaattttgtgaaaggaattagagaagtatttggtgaaagatatctcaggcgtcccactgtagaagatactgaacgactactcgagcttggtgagagacgcggttttcctggtatgttcggtagcattgactgtatgcattggcaatgggaaaggtgcccaactgcgtggaagggtcagttcactcgtggtgatcaaaaagtgccaacgctgattcttgaggcagtggcatcacatgatctttggatttggcatgcgttctttggagtagcaggttctaacaatgatatcaatgttttgagccgatctactgtgtttatcaatgagctgaaaggacaagctcctagagtgcagtacatggtaaatgggaatcaatacaacgaaggttattttcttgctgatggaatttaccctgaatggaaggtatttgctaagtcatatcgactccctatcactgagaaggagaagttgtatgcacaacatcaagaaggggcaagaaaggatatcgagagagcatttggtgttctacaacgtcgattctgcatcttaaaacgaccagcccgtctatatgaccgaggtgtactccgtgatgttgtcctaggttgcatcatacttcacaatatgatagttgaagatgagaaggaagcgcgacttattgaagaaaatctagatttaaatgagcctgctagttcatcaacggttcaggcaccagaattctctcctgaccagcatgttccattagaaagaattttagaaaaggatactagtatgagagatcgtttggctcatcgccgactcaagaatgatttggtggaacatatatggaataagtttggtggtggtgcacattcatctggtaattatgtttttattttgcattattagttatctatggtactaagatatgtacaagtttctctaaattgcactaaatctgtggttcatattggatatgtgtaaactatgaatgtagcctgactaaaaccatcattcatgctgaactggtttttgttttgtatatgcaggatgaaacaaggaactaggtttctgaacgcattacggactgaaggttgaggggcagaatgatccacccagttgcttctatcagatcactaaagtttcatttcactgttttattttggacacttgatgcttgtgtgcatccgatgaatgtttaatttggtcacctgatgcttgtgtgcatccgatgaatgtttaatttggtcacctgatgcttgtatgcagttatctatcttatttgttaatgttgctggtactgaggatttttagaagtgaaatgcacaagttgctgtgttttttgactgatccttgtgtgcacttgacgttgtatgtgacaaatgatggttcccagttgtgcacctgattcatgattcagttattcagtttaaattgacgttgtttgtgtgcaccttttgtcagttagccagttacggctggaagttgtgtaagtttgtgtgacgcctggctacaggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagactagttaaagctataataaatacaaggggtagtagggatagtatggttaatttaggttgcgttcattctttatacttcccagcatgaatgcgtatagaaaacggagcggtctattagcgcatgattaattaactattagctaatttttttaaaaaagaattaatataattttgtaaagcaactttcgtatatatttttttaataaaataccgtttagcagtttgaaaagcgtgcgcacgaaaaacggcaggggagagttgggaaccagctggaacaaacacagtcttagtgtgtaaaagtcattttttgtaagtactaggtttgctatatttcaaatgaaatttaaactccaaaagttgttgtattttgggtcggatgaaatatttacaagttgtatattaatattttaatactttttttactctagtgtagatagtatcaagatttatggtgtgttcgggaggaggggttgggaacccctcctcaccggcacgcaaaacgaagtacgtattattacatgattaattaagtattaacttttttaaaaaatggattattatgattttttttaaaacaactttcgtatagaacttttttgcaaaatacatactgtttagcaatttgaaaagcgtgcgtgtggaaaacgggagagttgggttaggaaaattggggaaagaacccagtcttatggacacacctaactctacttctgtcctatttaattgtgcctgacgtttatctcgactccacgcgatcacctcatcgttatcgaagtcactcctcttcaccaactccgacgagattcctatgcccaactctcctcccctaactttggcaacttgctttgctggatatctgttgtcgtccctgatcaaccgcttgtttcttgtttttccccaccacatccgccatccatcacccctccttcgtccctacgggtttgatgatgacatcatggttttctcctacttcaatcatccctctaaagctactctcaccgtaaatctactccatctcaccgcctctaaccctaactatctaatcgagtgagatctcaccatctctatccctctagagttcaggtgtcatcctcatcgtcaatgagacctcaccatctccatccctcttctttttttttcctacgcccccgctctagaggtcaaagacaatgctcggggcactgaagatgtacaaaaaagcatgtgagtcttttttatattaccacttatcgatgttgagtatatcagcttaaaagctacatccttctcctattgagttggagtagccttttattgttttcattctagcttatcactcatagccaaaattttaaattttaaaaattaaatttagacagttaatttcgagttattttatcgaagtttttagcatctacttttaaaatcgctagaaatcttaactaattaaaatattcgtaattttccgttcgccacaagacggatgaaggcgccttcgtccgtcggcggtgcgccttcgcagcccccaaatcccaatcgctcttagaattggatacagggaaatactttctaaaatcggcgcaaccaaaactcaaccactctgtcacaaaaaatcaaccacaatcatcataaaatcacaaaatacatcacaaaacttcacaaaaatatacataaaaaaagaagaacaacaacatacatcacaaaacatcacttgcctgctgccggatccaccctcggccatcgccaccgcggccctcggccgttgccaccgccgcactcggccgtcgccatcgccacccgatccatccgcggtagccgccgacgccaccaccgctgccggagggagaagagaggcggcggaaggagccgccgctccttatccgcccacggacgccgccaccgtcactggatctgctgcgggaggaagacgagaggggacggagggagccgccgcagctagatctgcctgtggccaccgccggcggatctgccacgggaggaaggctagagggagtggagggagcccaccgccacaaccctcggatccgcctgcggccgccgccaactctccgccatcgccgctgtatccaccgcggaagggaggcgagacagggcggagggagcggccgccggctagggaggtgagatggggcggagagagctgctgtcgccgtccccgccgctcgcgggaaggggggaagggcacactacaaccactcggggggagggggtggagggcgctaccaccgctgctcggtgggggaggtcgccaccgccgtcgtcggttttcgattgatcgagagagagagaggatcgggggcgggaagggtggaaaagaattttaggattagggtttttgctgcagacatttatattggttgtgatcaatctagaccgtccattcgatcgaacggctccagcttctcgcgcatcgggccaccggactattgggcctccgcattattgggcctacaaatgggccgcaattaaaataaatgttttctctctcagtaattttaagcaactttctattttcaaaaatagcaccattttaattatttatgactgcttattaatttaattccaactaaattgaataaactagaacattggctagatttttctcatgatatggatttatttttcgactaaaaatgtaattatttatttgtcatgatatagaatttaaatttagactaaaattaaataattttaatttttaattctatatggactctattcttcttccaatattcctatttttttattgttctaattagtttctatatgaactctaaactcttctttcaatatttttattttaaattttaattatttttctaaattgtattcctatatgcactctaggctcttttggagaatattctagactcctcatccaatattatttattttataatttatactttatattaagtcgtattatttatatagacagattaatctatccagtgtagggtttttttttgcaaaaagatttgttttatgtagatatccgattggacaacgtgattttttttaaaaaaaacaaaatgaaagagtcctggtctacaatgagttctccttatttttttatattttactccaattaatatgagaatttctatttgagacttttctagcaagcaaaaataccaaagcagtgtgaaaataacttcggttaaaaacaaatatttttagtgttattacaccgtagcgaagcacatgcattttgctagtacaaatataaactttttacccatagttatttggttccttttttttgcctcatcgcagggagagaacgacgaggccgttagttttgtgatctaacggcgacgatgcaattatgataactagtatggtggcccgcgcagattgcgcggctagcatcattatattttctctcatataatagcatatatgttttctcattatattattaaaatatattacaatgacaacataattttaaattttgcaataactttacgaaactactaatgtgtaatattcatattgtattttatatacatgttagttattaattatttttaatatcaaattttagttatttgtgaattatatatattcctatatggactttagaatcgtattttaatatttctttttttaattctaaatgtttattatttctaattgtatttctatgtggactctaaacttatctttaaatattctttaatttttaatttcaaatttcacttacttctaaactgtattcctatattggctttaaactcttcttcccatgtttttcttaatttcaaattttagttatttgtaaaatatatttttatatggactctaaacactacttttcattttattatgtttattccgaattttagttagttttaaattcttatatggactctatactctacttctaatattccttatttttaattctgaatttctatttttttcttaattgtatttctataaggactctaaacactacttttcattttattatgtttaatccgaattttagttagttttaaattcatatatggactctatactctacttctaatattccttatttttaattccgaatttctttttttttcgtaattgtatttctacatggactctatactctacttctaatatttcttatttttaattccgaatttcagttatttcctaattgtatttctatatggactctagtctcctcttctaatatttcttatttttttaattccgaattttaactatttctaaattgtatttctatatgaactctagtctcatcttctaatattccttattttttaattctgaatttcaactatttctaaattgtatttctatataaactcatctttcaatattctttaatttttaatttcaaatttcagttacttctaaattgtatttctatattgactttaaactcttcttcccatgtttttcttaatttcgaattttagttatttataaattgtatttttatacggactctaaactctacttttaattttattatgtttattccgaattttagttagtttaaaattcctatatggactctatactctacttctaatattccttatttttaattctgaatttcagttatttcctaattgtatttctatatggactctagtctcctcttctaatattctttattttttaattccgaatttcaactatttctaaattgtatttctatatgaactctagtctcctcttctaatattccttattttttaattccgaattccagctatttctaaattatatttctgtataaattcatctttcaatattctttaatttttaatttcaaatttctgttaattttaaattgtatttctatattgactttaaactcttcttcccatgtttttcttaatttggaattttagttatttgtaaattgtatttttatacggactctaaactctacttttatttttattatgtttattctgaattttagttagttttaaattcctatatggactctatactctacttctaatattccttattttttaattccgaatttttattttttttcttaattgtatttttatatggactctatactctacttctaatattccttatttttaattccgaatttctattatttcctaattgtatttctatatgaactctatactctacttctaatatcccttattttttaattccgaatttcaattctttttgactgaaattgcgaatttcagttatttcctaattgtatttctatatggactctagtctcctcttctaatattccttatttttttattccgaatttcagctatttctaaattgtatttctatatggactctgctttttttctttttctccgattaatgcgagaatttctaggtcatgagagcgaacatggaggctcctttttattccgaattttagttagttttaaattcctatatggactctatactctacttctaatattccttattttttaattccgaatttctattttttcttaattggatttctatatgatctctatactctacttctaatattccttatttttaattctgaatttctattatttcctaactggatttctatatggactctatactctac

SEQ ID NO: 35229 - DNA, 8394 bp, Oryza sativa
tttagttagttttaaattcctatatggactctatactctacttctaatattccttattttttaattccgaatttctattttttcttaattgtatttctatatgatctctatactctacttctaatattccttatttttaattctgaatttctattatttcctaattgtatttctatatggactctatactctacttctaatattccttatttttaattccgaatttcagttattttctaattgtatttctatatggactctagtctcctcttctaatattccttattttttaattccgaatttcaattatttctaaattgtatttctatatggactctagtctcctcttctaatattccttatttttttaattccgaatttcagctatttctaaattgtatttctatatgaactctgttttttttctttttctccgattaatatgagaatttctaggccatgagaacgaacgtggaggctcctttttctattcctttaataatataatagatttttttaagaaaaatgctcgtgttatacgtgatctgagatacacttgatacgtaagtggtgtgtggtttaaattctgagatcccgtgttgaattttcaacacgctcgtaagttcttctaaaaaaatatttgaagtgacgtctctctccaaacctttttttttttggtggggtttagacaggatctgaaccggacctgtacaagttgaacctgatgagacgagatactatgcatgcatataaacattacacgatcctaatcccaccaaggagaaaaaaccgatccttggcgaggcagatcctgacatatccttgtcctcccgaccaccacagttgatcgtagccaccctggcgtgcgtgcatagccagtttagccacacgaaactgtagctctctcgacccaaattccccgaacccacctactagctactcctgcactgcaacagcaaatgcaaggagaaaagcaccgagccagccgatgagactcggtgaccgtgccccggcgccgaccgccgcgtgtgcgtgttcgcccaggcaaaagacacagcgcaattgcgcgcactctctttcgcaggccgcgccgccgccgccgcttcgctttgcaattgcatgcgcccttttgccgacgccgcctagcttatcattatccttcctcgtcggccgcggttttcaccgtcctctctcagctcccctcgtgttttcaccgagcgacgcactcgtaaaaatacatcaaagaacgccgcggtaaaagctacgcaccccgtacgtacgtaaaaaagtgggtggtaaaaaaaaaggatgggttggtgtactggtctctgcgtacgtgaaaagactagctatcgatgcgtgtatctctgtgcgtgcgcgaacggaagaggggagcagcagcgagaggctttagctagtctcgcctttttctttttcccggctttatataaggctcactcgctcacactcactcacttgtgtctagtttacaccgatcagtagtagtgctactaccactttgggtcggatcgagcttgttgttgcctgcaaatctgcaaataatcttagctccttcagctaaagagcaagcaacggctactagcttccctcaacgccctcgtcgcttgcctcaccgtcaccgtcgtcactcgtcattcaccaacactcgtcaggtacgcttctcgcagcttgtagtatggatatgtgctgcagtgtttagcttctactggtgtgatgattaatttcttgggcttcttccgatcctgtgacgaagtcgcttgtgataatttggggcttattcagctcagacgaccagatgcaaagcctgaaagtctgtcgtctgctaagcctgtagccgtagcacgtcgtcttctcgtgagcctctggttggatggaaccttggagaggagatggaagtatggtagtagtgtcgtaccagtacttgtgcctgctgctgctcgctgcacattgagctgcgtggcgtatgcgccgcgcattttgctgcctttgcaaaatgctcgccgatgcatatgcatatggtctcgttctcctcttctttcgctcgctgctcttttgaggagagagacacaagcgaggccggctttcttttgcccccaaagctgcgtggccatggcgtgcagccaaacgcttcacatctctcttttctctctctttggcactgtcgagataccagtcacgcatcacggccatgtacgaacacgtctcctcctctgcagcaaacctgctcttctttctctctctatctatccaacgctatcaaactgtagccgtaggcctctggcgaggcattaaatgcaagcgaggcattaaaacgcaggcacagctcatgattgcgtcgcttgttggtttcctcctcgtcgtgttccaagcttcgacctgcaagctcggacggacgacttgccttcttgccgtcgcaaaagggtgccctaaaaactgatcctcggtcctttccatgtcacccacgacgaagaacaacattgctcgcacagcgtaggagtagctaccattccttgtcctgtcatggaacatcaccgaggaaaaaacgagtaatttatgtctactacagaatcttggctggctgatttctatagctacctggacagcgcattttcgagtactagtataggagtatagtactctatgattttgtggatagtagctttttgcatgtttgggtgtgtttagttcacgttaaaattgaaaatttggttgaaattaaaatgatgtgatggaaaatttaaaagtttatgtatgtacgaaagttttgatgtggttaaaaaattgaaagtttgaaaaaaaattttggactaaacaaggcctttgtatctttattttacaaactttgtgctgttggagtagtactagactactagtaggagtaactttgtattgataatactaggagatgaacgtacttgtaggtaatggtactaacagactacgaaagattccaacagcatctatatatgaaaaaggggaacaaaggagaattctgaaaaaagaaaagcacgcaactcctctctttgatttttttgcttttgtccatccatgcatcagccaacggttaaaaaaccccgtcgttgcatcatgggtccgcagcaccaaaagcccctcatcctcctcccccttttgcagagcatttcttcccttttcccccagcaacgagggtaaaagcaagctagtatcctactatggtctactccagccaggctaccactgccatcctgcatgtctcccgtccgtcgatcgtgccatcatccgcctgcagcgtcacgcgagtcgggttcgccgtgacgacgacgacgacgagagatcataatagtagatggaagactaccaccagcggtagcatagctataatagtaacttcttcatcatttacagttaatttaatagtcaatagtcaattcatataatagttatctataaatatatactatttctacctgttatacacatattgtgtcttgtaatccgtactatagcctattgcttatctctctttcttcactgtgtttatagctggcttatagtttaagaacggtggtgaaatgctagaaaagttactataggactaatctcgcctttgctccaaaaaagaggggcagaaagaccggggcgtgctcgtgctggaccatccgccgctctcgcgcgggaccaaaccaaccaaccagccgcgcgcgcgcgcgcgagcccggcagccgagctagctagccacgcccaccaattccaccgtgcacgcgcgcgcatgcgtgcatgctcgcgagaacggtcgggtcgggccctcggcgtgggatcgagttgtttggttgcctttcccgtgctcgatagatagcgccggacgacgacgacgacgtctttctggtctttttgggtgcacacacgcacccgtttgcacgtcgcgtcgctgtccctcgctgccacttcggctaaaagtcgtgcgacgacggggatcatatccgtgtgtgtttgcgttcggttcgacacgtgacacggctgttgtgtttgattgtctcgtatgtactatatttttcacctccctgaagaaaaaaaatgggaaaactgagattagtaggggaaggagttttttttttaatcttgtgggtggcctttgtgcatgcgatgcgattcgcaccgaatcttgtctggtcaggtagcggcgtcacgtacccatgttacgtcctttccagcttcaacgccgccatgattgcactcagtcgcagcagccgcgcgtgctcggctgcgccgtcaataatggcctcgtatctcctccacccacaaggccacacacagcccagtagtaggccagtagtccaccggggtcaactcctccttcgagtgcaacctctgccagtgccagccatcaaaccaagacccccccgaattagccccaaatgatctctttttcgtgtcaccttttccctttttttttcgtcctgcgatcaggctagagtacgtacgagtactagtactagtgtaccaggcaacgagagccatcgatggcacgcagcgctagtccactcgattacggttgctcgccgtacgtctcggcgcgacgcggccgtggtccctgcgtcgcgcgcgcgtcgcgtcgcgcacgccacgccggcgctcgcatgcgatcatgcgcgagctcgtcgcaccggcttggccttttgccgcgcgccacggcttttctgacccccaaaataaaagaaaaaacggctgcagccagcggcggccggtcagccagccggccagctacacggtgcgcgtacgtacggggggaaacacgcactgtgtggggggaaggaaaaaaactcgttgagcagactgggtggctctcggttcaaaattgtctccattgatctaatttttaaaaacttttaaagtaaaaatatttatttttaactaaagttgcttacacgctactctcttcggtctaataatacttgcccttttatataagggtaaagtcaaactttagaatctttgattatgaatctttttaaaatatttgtccttcaaatatgatgattacatgtatagattagtcttaaaaaataatttaataagatcatatatttgttaatacttttatacatgttataatgaaaaataatggtcaaaattattttttggagatcgtatccttgtccaaaacgacaagtattatcaatccggagggaatactaacttagctcattaaacaaagaaaaatataccccctacatccataaaagttacacatattatttatattatttttgtcaccaagaccaaggaaaatttaaatcatcttggatgttacaaaatcatagagtgaatgcaagcatgtaaccaatgagtgtttagatgcctccttgggttctaatcaaatatttaatttgtctccttatttaagtcttgaatgcataaagactgcagatagaaataacttatttgggaaaaactcaaatgtgaaatatatttaacttttgtggttgaagggagtaataaactataaaaacagtactactagctagcgtgtgatgatatctagatttccgtttacaattataaacgattctaaaatacttttataatattaaggaagtagcaaaacgataaatcatagtgagtattatttaatatatttgacaataaactagaagtagtaggggagaaataaacaatacaaaagtcgataagtgtaaaataaactaatagaatactatgccttgggattacagatatcttatgtttataataaattaaaataatataatctcttatatttatatatcgagggagtacgatcatttagcgtattgtgctgtacgctagaaatttcttacgtctggttcgtagaaccatttgtgggtgtgatcttaagcgagggtacctgcgtacgtaggtagaagatggggacggggatatggttgagagaacgggagtggtgaatgccgtcctgaatccacggagcagcgtatggagtcacgatttgttacggtgagctctcgctctcgtcatggcggaggtggatcgatccatccattttcacgccggtcgtggtcatccatcaatgctcatgtatcgtgccagcgagattgcaggtgatgtcttcatcatctaatcggaaattcagcaacctggggagaaaaaaaaatcaacaaatcgctgagcactgtacctaatttccgggacgattccgtacgagccccctaacagtagtgtacttactggagtactaagtgcaatgagctaatgccatgtttgccattactacttgcaagcagtcaatctttagggcagatgagacgatctgatccgtccgaagaaaagagagggggagagggacccagccgtgttgtggtgtgatgatggcgccttttgagcacgcaaaagaggagtcctagaccgacctgccaatgccgtgcccgtggcagccggcaggtagtgggttggcactgcctgaccccccgacccgactcccctgcctcctgctgccgctagctgcgacctgcaccggcgcatgccgcagcacaacagcagcagcggctcacagtcacagcttgtgtgtgcgtacgtacaacccgagcacgcgcacagtgccgcaccgcagcacgcggcacagcagcggcattaacgccacatgctctcataaacgtatgagtatttcttcgcactttttgcaggcttgcgatgcagcgacgacggagaacgcggcgccgcgcggcgaagggcgagacgaggcccggggttgggtgcgcgtggtggtggtgccatgcacgggctgatcgggttggatggatggtcccccgtccgtagccgtaagggtggcccgcgtgtggcaggtggcgcatgcagcagcgggcgcagcggctgctgcttgctctgcttgttcccctccccaagcgccgtgttgcctctgaccgcgccacgcgaatgctccgctttgtccctcgacgccacgccacgcgagtagcgccacgcaccgcccaccaccccatccatccatccatcgggccgtgcgccgtggttggcggcgttttttcttggtaggttttgtattggacgcacgcactggtagtggacggctagtagcctagaactggtgtaagtcgttaacccgtaaaacctacttaacctgtttggattcgtggccgaccaattacacccctacctaaaactaagatcggtgctgctgctgcttttgcccgtgcgcgcacgagtaaaaaatgggtttgggccatgagggaacgagggggtgtgtgtgttgtgttcttctattctgcaatggtggagcgccttcttgtcgggggcacgcacgcttccaaagttgtaccgcacgggcaccgaggggcagggcagggcaggttctctcggctttgggacatttcttgctgcgtcgctggtggtgtagcagtggtggtagtgggagtagtggcgttcaaggccaaaggatgttgcgtttcgatttctctagtgcttgggccatgctgcatgaggcttaaactaaactttgatcacactttggatgcatgttcctgcacaacaccaaaaataaaaaaaaaataaaaatcctccaaaaatagcgcttggtaggatgtccgtcatgccagcaatacgcagttgaatcagacttaagtgcctgtcagcattgaacaaagttttgtaatgtcaaaagttccattattatacacacaatctgcctctcaatgatatttacaagtactactagtactagtactcccatggtaacataacaccacgcgctagcggccagccacacgaacatgtgatacacttctcaataaaaatccccatccattctcccttccttccatccccttcgataatccacccccatccgttggaaacctcagctgcactaccctctcgtgtttctcgcgccccaattaatccacgggccacaacgttttacctaccgtctccccccacctacaagaaatcatttctacgacgcctgctacctttggtaaaaaaaacggagcatattttgcttcttccctgttcaatcttaccaccggcaggcaaggcgaggtctatttatttatttaccgcgcgaggcggccactactactactaggaccaaacagggtcaaagcagctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcaaggtggtggtggtgcgcacatgctcgaggtgctggac

SEQ ID NO: 35230 - DNA, 8592 bp, Oryza sativa
tttgagcatggaagaaaggtgagagcggttttcttggtttccgtggcgcggcggcggcggactttgcaggtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacggtgcgcgcattatttgcccacagcccggcgctccattcttctccggccatgtcttaaccgtcatcgcgtctctggctccgcagggagagggagtacagggtcgccatcaagttcgccgcgcgcgccgacctccaccaccttcggcagttcatcgccgggcgccaggccgacgcgccgcaggaggctctccaggtgctcgacatcgtgctccgtgagcttgccaaccgcaggtacgcacacgcattgctcgtcgtcttgtgttcttgcaagggaaaagaaaggaaaaaaactaatactgattggccccaatggtaggtatgtctcgatagggcggtcgttctactcgccggacataaggaagccgcagcggctcggcgatggcctacagtcatggtgtgggttctaccagagcatccggccgactcagatggggttgtcgcttaacattggtgagatgctcgcgaatatttggtgccctcatgcatgtatctttcctggttgtcatgtgcttgctgcttacatggtggatgatgttgatgccagatatgtcatctaccgcgttcatcgagccgctaccagtgatcgaattcgtggcccaaatactagggaaggatgtcatatcgaggccattgtcggatgcaaacagaatcaaggtaaatttatgcttgcggggaaggaatagtctagccttgttactgtagtgggatgtaagatgtgttgtttggatgcttttggttaactgatagatggcttaattgtgatgctttgcatgattatctgatttacctgtggaattcgccaattccatgcagatcaagaaagccttgcggggcgtgaaagttgaagtcactcaccggggaaatgtgaggcggaagtatcgcatttcagggctgacaacacaaccaactcatgaactgatgtatgttatagtgtaattcatttctcgtcatgtactttcaattgtcaaatgtcttgtaccgaactttcacgaaagtagaagcatgcatgttaagcactccctcttgcttctaaatctgagtatggcagaccaaatagaccaaattaactatcaatatccatatttcatatacgttagctactaggcattgtgttaagctatggaactgattttgtttgttttaacagtttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggttggtattaatctcatcaagtcacaaatttcattagctggtcaattatgtaacattcaaccttggtaaaagacatcatcattttgagatatttcttaccaggcctgtaagattgttgagggtcagagatatacaaagaggttgaatgaaaagcagatcacatcattactcaaggttacttgccgtaggcctagagaacaggagatggatattctacaggtctagttttttctcctaatcggattataacattttgaaatatatggattacatgtttgtcaggagtaaatgtttcaagtattttgtcttactaaattggatgataaatccaaacaccaaatcagtgcattagaatttagaagatacgcatgctaatgtacgttaattgttctatgctgaagtctttgttttcattacccacttccaagtggtccaagcattccatgcaattgatgttcaatagctacccacccaataagtgctactagggtttctcttcacttgatcagcactcttgttataatggttcaagactaaaaaaatttctttccagacagttcaacaaaatggatatgagcaagacccttatgcaaaagaatttggaatcaacattagtgagaagctaacctcagttgaagctcgggtccttcctgcaccttgggtatgatttgcctttgttaatctcagtagttggctaactgctctcagctaataatttgggtatgaaattttgtggctttcagctgaaatatcatgatactgggaaggaaaaggagtgcttgccacaagttggtcagtggaacatggtgaacaaggttagattccccgttttccgcagctgtatacaacagacgtccttttatatatcatgatgatggcctgatcctgctagttttccactaattaagcattttttttttgcagaaagtgataaatgggtgcaaggtgaatcattgggcttgtataaatttctcaaggagtgtgcaagaaactactgctcggggattctgccaggagttggcacaaatgtgtcagatatccggcatggtatataactcttaacttcatctaatggttttgcataatattggtgcttttataatgttatttgttggctgcatcttttcagttttatctctgctcttcttgcaggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgagtgtcggtttggtaattgcatcgcaatttttccttggaatcctcatattgtgtgaaatgcttaagatgtaacttaatatttgcaggtgatataaaacgtatatgtgaaactgacttggggttgatatcacaatgttgcttaaccaaacatgttttcaagatcagcaagcagtacctggcaaatgtctcacttaaaatcaatgttaaggtaccaaatacttataaaccaagcagttaatacttagcttgtctacacaaatgtagtgtaatgcagtaagcagacttgcagcattgctaatgccttgcatttcggagttgtgatacagatgggaggaagaaacaccgtgctgctggatgcaataagttggaggattcctttggtcagtgacataccaactattatatttggtgcagatgtcacgcatcctgaaaccggggaggactctagcccatccattgctgctgtaaggctgagcatttctatggttacatggccatcattttttttttaacctcttaccctctctaataagctgcatgcaggttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcaggtcttttttgaggaacaatttgttcttccaaccaaaattaattgatgaagcctcctattaaatagtttagggttacctcctaccgattaacttatttttggttctggtcttgttgtgtagggagctcttaatatccttcaggaaggccactgggcaaaagccattgagaataattttctacaggtatgctactgcaaatactgtttataaactaacgtttgtagagtacagtagttagatatttgtggaatcaatttaatcctatgtatcttcaacaagtactgaacctagtgtttttgttcgctatttgaagtatgaaagttgctgttataggcttctatttgtatatctgctaatagtatcggtactgcttctcttctagggatggtgtcagtgaaggccaattctaccaagttctcctctatgagttggatgctatccgcaaggttagatgcatttgtattttctttactcagatattttgtccactttattaggttgcctgacgaaatgttttcttttaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggtaattactattcatcacctcttaaggcatttcattggatctactgcagatgataatgcaaccaacatattgcaaaaatattttttttattttaactaaaaccctcagtttgttggtagaactgtttcagtgatttgatacttgttttcctattcatgatatcacattcacaactgtttttcttggattattaaggtatcactttgggtgaactaacttttatatttactgttattcacttgatttctgtaattgctcatgtgtttgctaaaaaacaggaactgttgttgattcaaagatctgccacccatcagagtttgatttctacctctgtagccatgctggaattcaggtaagaatattgtagtggtccttttgtaaggctgacatatactgaacttgtcgttactctggtccccatgtcttctgtgattaagtatttgaggagacttcatattgtcttttcaaccacaagcagtgtagtacttcctccgtcccaaaatgtaagcatttttgaggttggtacgggtattaagaaagtaggtgagaatgattgaagaaggtgtgtgattgattgaaaagagaaagtaggtgaaaaagaatgattgtgattggttgagaggagaaggtaggtagaaaaatagcttcattttgagacaaattactgtgctagaaatagctacattttgagacagaggtagtagtatcacagtagctagttactgtagtacctagcaaagggcacatctgcacatgctagaacaaacaaacttactataccatggtcaaatttttaatcatgtgattgtacattatagtacttggatcagcaaatattctgtctgtagtagcgctggaatataattccccaagtttgtcctccatgtactgaaatgactgatgtgtgtgagttttccagggaacaagtaggccagctcactaccacgtcctttgggatgagaacaatttcactgcagacgaaatgcagacattgacaaacaacctttgctacacgtacggcattactgaatcttgttaagtttatcctttgcactctgagcttctctctatagaaattgtctgacttggtacatttgctgatgcagttatgcacggtgcacacgctctgtttctgttggtacgttcttctgaaatgatctgaacatttttccatcattttctttgtattcatgtgttattattagttggacacgaattctgaaggtgaatcttgcatttcttttttcctggtccaacagttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactcaatacacgaatccattatcaggataacaccaacaattttcacttatagaacatattcgaaaatttctgagaataggctaataattctcaaaataaaaataaaaataacctgcaggatgagcatcattcgttgctgccattaaggacagtaactaaggatataatgctgaatatacgaatctagttaagacggcctgaagcaggtccacagaacccgacttaaaatcattgttagttcagattccgggccacattgtatttttactgtgacttgcagatgaaccttcttccataaataaatattgcattcacttcaaagtgatgttttatgtgttagtgagttttgagtggatatgctgaatacatcaacaagagcaaactgaaaatccaagtatagcatttttaacaagctgacaaatgacagaatcatgctgcgatgataatgttcgtccatccattgttaagaagttatggttgcacattagatataatcatctgcactgataggcataggcaacaacagaaaaaaaaatactactggcattggtgtctaaccttgttttttcatctgcagaaccgtgttccatttcctggcaagagtaaaaaaaatccagctctgctacaagcctgaaacaagctagctgaagttcagtagtcctcaaattaactaactgtacaagcctgatcactcgaatgtctgttcagacaaggttcttcaaaattgctaatgaaacggcttccagtgattgatcatgcttctgttggtccagtcaaactaatggatgcttcaacaattcctttgtccaagcattatatgcttcaacaactcctcagtaccccttcacctcaatcaagctacaccctgcattcttcttgacagtagggtgtgccatcttgccccgtacccttatcacatcctcccatctacttgctgttgcatatacattagacatgagcaaattcacatcagtaatttgggaatcttgctcacagattcgtttggttaaccgttcactcatctcaacattcccatgagccttgcaagcagtgaggagtgcaccaaacagtggcatagcatccttgttaattggaacgtcaccgatcaacctctcagcttcatctagtagaccagcacgacctaggaggttcacaaggcagctatagtgttcaactcttggttctatctgataaacctccctcattgcatggaactgcttccggccttcatcaaccaagccaccatggcagcatgcacttagcaccccaataaacgtaacaccgtcgggcttaactttacttctctgcatatcttgaaacagttcaagagctctaccagcctgaccatttgtggccagcccacagatgatggcagtccaagctgtggcatctctgccttgcattcgccagaagacctctagagacttctcaatgtgcccacatttagaatacatgtcaatcaatgcggtgcctaggactgcatcgatcttcattttcctttgttcagcatactggtgaatccattcaccttgatcaagagcgccaagattggcacagcatgtcaggagagtgacaacagtgaacctgtctggctcaacccgttgcatctgcatatctcggaacaatgtcagcgcctcctcgaagcatccgtgttgcacacacgcattgatcattgcagtccacagaattagatccttctctttgcactggttgaagagcactctggccttgtccagctgcccagcaaggccatatcccgacacaagtatggtccaagaaattatgttcctcgcaggcatttgctcgaacaatttcaccgcctcttccaagcaatcattcttcgtgtacatgtccagcagagcatttgcaactggcagattgaaaccgaagacgttatccatgtacacatgaatcctccttcccaagctcaggtcccttgctctagagcacgccgtcaccgccgtcaccaacgtcaccctgtcaggtgtgacaccgcttctctccatctgttcagacaaagcaactgccgccgagtaccacccgcacctgatgtagcacctgaccatcatgttccacagcaccagcgccctactcggcatttcgtcgaacaccttccgcgcgatgtccacgcgccccagcatcgtgtacatctccatcagcgagctcccggtgtaggcgtcccaccggaacccggtcttgacagcggccgcgtgcgccttgcgcccctcgaccgacagcttgaggaccccgacggccctgagcacgaacgggtaggtgaagctgtccgccacgagtccccgcgcgcggaggtcgtagtacaccgccatgacgcgcgcgaagctcccccgcctcgccagcgtcctgatcagcacgttgcactcccagagcggcatcccgtggcccctcctcgccgccgccattgccatcgcgcggggtgggtggcggcgacgcgacgcggccaagacgtggggggggaatcttttcctatatagagagcggaaagtcacagcctcacgggagagaagggtaggtgtttgtgtgtgtgcctctctctcgagtctcgagatggtggggaagcgagtggcggtggtggtgggagggagcgtggcggggctggcatgcgcgcacgcggtggcggaggcggggtgggaggcggtggtggtgga

SEQ ID NO: 35231 - DNA, 2610 bp, Oryza sativa
acgaaggcggggaggacgctgacgagggacgaggggttcggcttcagggcggcgcactggggcgacctgcaccggcggctgcacgaggcgctgccggccggcgtgaccgtgctctggggccaccagttcgtgtcgttcgagatggcgccggaaggggacggagatggcggggtcgtggtgacggcccgcgtgctgcgcaccggggagacggtggaggtcgccggggatttgctcgtcgcggcggatggctgcacgtcggcgatccgccggcgattcctccccgaactcaagctgaggtcagccagaggttctagactactgaattgtttactggtagtagtattattgtttagtcgcatgattttttttttcaatttagctgctccctccgattttgaataacactcgcaccttctccacctcctcgagttgggtactactactaattatcgtgccatataattttcttacaactctaattgggaatataaaaatatgaaacatacttagcagagtgaatccaagcccggcctgagacccacgtgcccacgctcgactcacgccgcaaagtctattggacaaaaccccatgtcggcatgcccgatgggttcgcgttgccagccacctcctagtcccgtgtgctgccacgtcgctagccatcaccgcaccgccagccgtcgcttgcgcccttgcacctccacgtcatgtggccaagctcccttcccgtgcaccaccgccgccgcctagtgtagacactggagaagagtagaagactgagggagtgagagatagcagtgaggagtataaggtttgtgatttggggatttctatgctagggtttcatttagtgaatatatatattgcatacaaaggggtcaaatggactattaggccatgtgaggagataaaactatttaaggcctgaaaaatatatatgggctaaaaaattttcaggtcgggcatggtttacccacaggaaaaacccgcgcgcgcctactaagttcgcgggtatcggatcgggcgtgcccacaggcaaaaaaaaaaaaagttatccgcggatacccaaacctatgagcaatactgccattcctaagattttgggtgtgtttgagagaagagatttttttaaaaaagtatataaaatgggatgagccattatcatatgattaattaagtattaattttttaaaacttaaaaaataggttaatatatttttttttaaaaaataactttttaaaattatcttttttaaaaaaacgtatgatttagtggttcggaaaacgtaacgagggatttcttctctctttcatcctaaggaacagccttagtgatattaaggatttacgattgcctttcatctctttcaacgtgtgttttcgggcgcattcgtggacgatagtgtggtgcatgagtcgtgatggtgtgtgcgtgtgtttttcttccattaatgaaaggaaaatattagctgagtttttcagtatttcaatataatatcatgtcaaaatgggcaaacttagctaagattgttttcgattttctgattatttttcaataatgtaggtactctggatactgtgcatggcgtggcgtcttcgatttctccgggaaggaggggtgcaccaccatggtcgacatccggagggcctacccagagctcggcaactgcctctacttcgacctggcatacaagacgcacgctgtgctctacgagctgcccaagaaccggctcaactggctctggtacatcaatggcgatgaaccagagctcatggtaattgtcaatcgatgagaaataaatcagtgtgtttatccctccttttccgatgtgatttggttccgtttggtgttgcaggggagctcggtgacgatgaaggtgaacgaggccacggtgagcgagatgaaggaggaagccgagcgcgtgtggtgccccgagctggcgcggctgatcggcgagacggcggagccgttcgtgaacgtgatctacgacgccgagccgctgcccgggctgtcgtgggcgggagggcgggtggcgctggtcggcgacgcggcgcacccgaccaccccgcacgggctgaggagcaccaacatgtccatcctcgacgcccgcgtgctcggctgctgcctcgcgaggtggggcggcgatggcaacgccgagccgacgtcgacgccgcggcgggcgctggccgagtacgaggcagcgcggcggccggtcgtggcggcgcaggtgctgcacgcgcgcaggctcggacggctcaagcagggcctgggcatgggcagcgccggggacggggaggggttcgacgcgaggacggcgacggaggaggagatttcgcagctgcggcagagcagcatgccgtatttcagtggcgcgccaaccattgagtgatctaataaatgtatttttgtgaatttttatataaagaaagaaatggctatctctatcataggttttctttaccgaaatttcaaatttttagctcctgccctgtttggaataaatgaaatctgtactattttcaataagaagtttgttgtaaatttcaccaaaaaccgttaatttaattttatttttcttctcataggaaccgttcatttccgaaaatgctcag

SEQ ID NO: 35232 - DNA, 9752 bp, Oryza sativa
aatagatctaatgttatagtgaactgaaacattctttcgctatttgctgaaacattgtttttatataaggtgaaacaacgcccgatttaaacgaatgaaatatttgcgatctacttagtgaaacaattccgatatacttggtagagcatcgtgcaactgtcaacgtttgatgtctcgactacggtatttggacagtatggggatcgtcggtgctagggtatacgcgagactgaggtaaaagagatggagacgatgatttttatacaggttcgggcccctgagctatcaggtaatagccctacatcctgttggccggagccaatgttgctttttattcaccataatcacaccagtacaatatgtggggtggcctatctaactgttgtcgacatggcggtctgaaggtctgactcgtagtcgacaacagggtagccttcctcctcgagctcgcgcccgacggaatcagagacagtgctagatccctacggccggcctctgaaggtaccggatagggtcgatccaggcgtatctctgatgtcgatatccggcggcttgtcttggcgtatgtaggcttctatgttgattgtgttgggagttgattgtctcgtggtgggtgttgatcgtctcatggtgggggtcgatcgtgttgatcgtgttgatcctccatggtgggtgtgtgtccccctgtcctcctagggggcttatatttatatccataggtgtccccttgtccaagtagaactagggaaaccaatatgaatacaatccgagtagtccttgtcgtttccatatagaactctggttgtctttccttatccggaactccctcctatatccgtaggctgtttccgtataggacatggtatgtggtgggtcctgccgagatttagtcaactactattaggtatgtggtatccataaccctgacagtagcccccgacttcaatgcaaatgaacgaattcatattctcaattgcgcgcagactttggagtaactattatcgagctcatgtgaacgttttcggtgagttcagatataacgttagacttcctttgtcagcttcgtgcgggcaccgaaagggtttgtctaagtcaatctttgatgttgaccgagaaagtacagagcgtacgactaagtttcccgtcttgctgtaatcgagaatttggattaaagtcaagaaattttatctcggcgggtacatcatttcttcattccgcattccttgtcgagatccagcaatcgttctcgagcgatcgagaaggcgtagagtctgcgacagagccttgtcaacattggtcgtactcgccttagtcgatcttggtgtagaaccatagagacatggagccttcgtcaatgtcgaatataattttcctgaaatcaatactcagaaaagaatattagatagaaatagcccccaagcgaatgctcaaagggtgacatattataatatgacagactaatgaattgaatgtacagaccagtgttttgtatatgagtgtcttctctcttaccgactccgatcagtcagtttgtagagtcatacactctccctagcccccagccttgtcatcggagaatcattctcggaggataaggctcttggacccttgacctgccttggttgaataagcactgatcctagcccccagccgtaaagttggaaaagtcaatttccgattacacggcttagttaatacgcacggcgagaactcttacacgaccagatcttacatggtcttttgtcattacagatcttacatgggcctccacttacatggcactccagcaaccgttggatctctcctccctttcccttccttatctggctacattcccaaattcttgtcccatcgacctagccgaaacctcccctctccccctccacagcttcctctgcctccttgccctcgtcggcgccgcctgcggtgaggctccacgcctccatctcggccgtgtccgttagttctctttttccctacctccgcgagttcagctgttcgccgtagctccccctgctacgtcccgagctccgccgcctccgattaaactgtttgcgccatctggcggcggccagcagagtcctccctcagctccgcgggtttagattactgcgcattgatatgtggacttctctgcttgcttcctgaggttagttatgtataatttttccctaatgattgaaaaatctttgggacgaaaatttccaaaatttggccgaaaattccaatatgatatttggaagttttgaccaaaattttggaagttttcgttcaggggtatttctgtcattatgataaaaatctaacggaggctaactagacaatgatggtatattatagaagttaagaaaattgtgatgacatatgagaatttgacaaacccagtgacatattgtagaacatggataaaatcagtgacacataatggattctttctatttgttcccttaactacctatctactatggtgcgacatgtttagaaaaagttaaatcttatactataattccatttcttacacattaaattatatatacttataatataattttcaaattatatagtgcactattcacattttatatgagaaatatggaaaagtgatttattatctatttaattatgagagaaaaatattagtccaaattaacataaacatatagaaaataaaaaaacaacaaaagaattacggaattactccgcacactaactctctctccctccattttctttttccctctaacagttagtgatcgctagatccagcaataaacaacccagatctagcatctccgttttttgtaaggttggttcatgcctccctaagtctttgcaagcccaacaatcccaacctcaacgacgacgatgacaatagtgtgcatggcgataggggaggagaaaagacatggctataactatagggtgcagctacgcatgcaaaggcggagaggagaaacggtggtggctcatagagaaagagcgctggtggtggtgcgtggagctgtagttagtggtcgcgggtggtctgagaagtttgttgtcgacacaatctctaactgagtttgttaatgtttttctgatatatgggccaccagtcatcataaaaaatagcatagtaaggccctgtttagatacctggcaaaattttacgccctatcatatcgaatgtttggacatatgtatggagcattaaatatagaaaaaactaattatacagattacatgtaaattgcgagacgaatcttctaagcctaattgtgtcatgatttgacaatatggtgctacagtaaacatttgctaatgacagattaattaggcttaataaattcgtctcgcggtttacaggtggattctataatttgttttattattagactgtgtttaatactttaaatgtgtgtccgtatatccgatgtaatacgccaaaactttacatctggatctaaacacagcctaaaaatattgagatatacgtggaatatcagtatatgccactcaattcgcggccctatgatccaattcgtgtgtaactttggaacctgccacgggagagcgaattccttcgtttcactccatccatccgtctgcccatccgttttacgctcgtccgcgaccgccgccgccgccgccacctctaccaccgtacccgagctcgtccgccgccgtctccattagcgtcgtccaccagctcggccgccgtccccgagctcgcgtcgtcctggtgagcctctttctgattcatctctctctctcccaccccaccgggacaatttctgtctgcaatttgctcacgttcgttcgttaaccctagcttctcttctagatctggaagaagctatttcagagccttaaccttaatacaagtaacagtttattgtttgtttcccccaaaatttgggggttcccaagttggatccgccccctgcttcgtcgcaagagaaattctccttttcatttgagtttgtagagcttttcaatggagtatacatcaagtgaggatgatgagctggttgaaggttacatggatgttgaggatgatacaggcaccagcaatactgatcaaggaacaggtctgatgccttctgagatgcgtagcatccttccccgtccgtcgtctgttggcaacggtcggctgatggctgctgatgggttgggcacaaacgatgacccatgcctaggcatggagtttgagtccgatggagctgcacgggcattctacaatgcgtatgcgctgcgccttgggttcggcatccgcgtcgcccggtcgcgcagcgagcggaggaagggtgttgagctacttatcatgaagcgttttgtgtgcctgaaagagggacatcacaagaagaaggatgccgagcctagcgacaagaaaaagaggaagcggctctcgataagggatggctgtccagcgatgatggaagtggtgaggaggggtccggaaaaatgggtcatcacaaagttggtcctggagcatactcatgtgattcttagcccagacagggtgcgggaggtccagctccgtcgcctctctggaaagtgcgcagagcatgataatcaattgcaggagctgcgccggaatgtgtttggagatacagatgcgcaaggccttttcaactacttgaagagaatgcagtcggagaactctggttttttctactccatacaagttgacagtaagaactgtgttagcaatgcagtttgggctgatgctagagccagaatgtcatacacatactttggggatgctgtttattttgacactacttatagtaaaaatgagaatatgttaccctttgcagctttcacgggtgtgaatcaccatggtgatactgttccttttggttgtgcacttgttttggataggacagaatcttcatatacctggctatttgagacatggctgacagcagtgggtagacggttgccgttttcctttacaactgatgaaggcaaagcaattgcatcagcagttgcaaaagtatttcctcagtgtttccatcgtctttgtagatggcgaattttgtctagatgcaagaagaagttgtctgacgactacgtgagatttcccaatctccatgatgagctcagaagatgcatcaacgagtgttatactgaggttgcttttgatatgttctggggtactattcttgacaaatatggcctgagggagaacagttggttgcgatcaatatttgaagcaagacacagatgggttcctgcatacctgacaacaagctccttctttgcagaattgacattgacccagagaggagaaacaatcggtaggttttttaggaataacttcagcacaagagttcctctcgatgaatttaccactaaatttgaccaacacatagacaatttgtatgtacatgaaactcagaaagatcttggttcatctcatccggaacagatcctgaaaaccaatatagccttggaaaaacaagcaaggagcatctacaccaatgccgtgtttgaaatattccaaacggagttgtttgaagcattgcagcattatgctgttaaggttcatcaggatggaccttactccaagtactatgttgacagagatgatcctccaacaaggcacactgttttctacaatgttgccgagaagaaggcttggtgcgattgctgcaggtacgctttctcagcaatattgtgcaggcatgtgcttggagttttcatcttagctggaatcatggtgcttccggagacatgcatcgcgaagcgatggacaaagagggcaaagactgggccagaattaattgggcataatcttgagaatggaaattgctacatggattcttcaacttcaaggtataatgatctcattcatgatgctatcaaatgtgcagagaagggagctgtatcagcagataacttcagagttgcaaaggaaatactccgcaaagccttcatggaaatcaagtgtcttggagaaaaactgactgacgatgacctgcagcaggttgacagtagatagcagtggttatcttgtgaagcatttgagagattgttccagatatcttttactaaaggatggaaatgaggcgtaattttgctgtgccaccatgagtaaaagcatttgagagattgttccaggtatcttttattaaaggatggaaatgagatgtaattttgctgtgccaccatgggcaagcctaccctgtactgacaatgaccaattaacatatttaaccactgtaaatctaatcctgatgtatgctgttagcctgtctgtagaatgctaatctgacttgtgggagtcaggactgtaaatgttgactcgtttgcctgtgttcctcttgctgctattcatgtcatgatatcacaactcacaaaaagttatgttggactcgccatgcttgtagggttttttcttcataaaaagagttacagacatcgtttcttgtttattttgaaaattgatccatttggagtaagcctttgttgttaaatatacaaagtttattgcgttctttaatgagaattcgaaattcggatgaattccttcatgcaaaatcttgacataaaccaacacattagacctttcgtcttgtttgttcgtaataagctttctggtagtatctgctaccttccgattctatggctacaaaacaaaatttacaaagcccctatcatgtttaaacacgacaaaaagaaaatctcctggctcaaattttaacacgccgcagaattcacgaaaattcaaaaaccaataaaaaatcgcaaaaatccaacgggaaaaaggagacgcaggaggaaagggagagagagagagaacaaacggcatcaatggcggccacatccctcctctcccgcctcctcatcctcccaccaccggcgccggccgccgccgcctctctccggcagcggaaacccgccgcagcgcactccctatcctccagggggcggaggccccgcctcgcggtacaggcggtagcccccgcggcggcggaggaggagaagggcgggctgccggcggcggaggcggagaggctggcggagttcctgcgggaggacctcccccacctgttcgacgacgtcggcgtcgaccgctcggcgtacgacgaccgcgtccgcttccgcgaccccatcacccgccacgacaccatcgacggctacctcctcaacatccgctcctcaagctcctcttccgtcccgacttctacctccaccacgtcgagcaggttgagctgctaccccgcactgcatttcccaatttcaatcgtaacagatttgcagcgcattttgcgaagaactcgtgactggatgggtggtggggtttttagacagggccgtacgagatcaccacgaggtggaccatggtgatgaagttcgttctactgccgtggaagccggagctggtcttcactggcctctcgatcatgggcgtcaaccctcagaatctcaagttctgtagccacgtggttagcattcttgcttgacactgcagcttttggaacatttgtttcttcgaattaatgtacgttaagattttcttttattgttcatgaaatgaattagtggtattttaatcccctgaatcatatgtatggatcacgtcttacagagtctactatatgttagaaccataggtctcctgcttgcgacattcgagacctctgagatgaagcatatatattaagcatatgcagcttagaagttaaagtcttaaaagagtacggtttcttttatcaagagcattagtaagcagtcagtctggagtaagatttcgagagatgagatcagggagttcctgacaaagctttcagacaagctttagttgcatacttatgtttagctatgtcaaataactttttattgttgcaattctccaccggatacagttcctcctataatgcaatgcttcatagtcctaattcaatttgatactaaattttagcttttcaggaagcttgtgggactatttattgatgggccggcaaaccaatacttagcttccatagtccacacttgataaagtttacaatactcttaataattgcacttgctgtgatgtgccgtagagttcctggttcttacttatttgtttttttccccccgtttagtgtgcatttttgtaaatagaagattaaggatactatgcttcccagcagagtgttggagagattttgtacatacagagaactccaacacactaaataagtttacccaagtaatcattaaatattattataacttcccaatatgctgaagtgcaggatatttgggactcaatacagaataatgaatatttttcttttgaaggactgggggatgtcttcaagcaggtcatttgtcatgactctacatttttcttataatttgtcaaacaaatgtttgagctagatcttttgattctgcacagctacggatttacaagacccctgatatagaaacaccaaagtaccttatcctgaaaaggacggcaaactatgaggtattaactttaggaattcattttatatctgttctgaagtaacagcactgccatattctcatgatccatgcttcatatgaattaaccatactgataagtatccgaattattttacttgatttttgccagtgtataatctttgctaatgtgatctctatagtagtcagaactcagaacatctaatttatagctgttacttctctgcagaatgtttaagatgaaatcatgaacataaattcttttttgcagattaggagttatccaccattcttaatagttgaagcaaaaggagataaactaaccggatcatcaggttttaataatgtaactgggtgagttatttttctgttacagtagatatttaaccctgtaatcctagtactgattacttataagcgcttgtaaatgtaggtatatttttggcaagaatgcttcttcagaaacgattgcaatgactacacctgtcttcactcaggcttctgatgacaaactctcagatgtatccatccagatagttttgccgatgaacaaagacttggacaggtctatcttgtgcaatgcaggatttcagttactgacagtgcggtttaaagcattgattttggacagctgtgcaaaattaaactaaaagtagtcttatggatttatttctattactaatagtagtaatcttgttcaatcagcttaccagctccaaacacggaagctgtcaacttgcgaaaggtagaaggtggcattgctgcagtgaaaaaattcagtgggagaccaaaagaggaaattgtgatccagaaagaaaaggagctgcgctcccaattactcaaagatgtgttgaagcctcaacatggttgtttgcttgcacgctacaatgatcctagaacacagagctttataatggtatgtttccttttgggctgtcccttattgtttaagctgacatgtgatttttttgatgtacttcactataatgatcctaagactaactaatgaggtttattttatgattaagtgttggaaagttgatattttatcatcatgcttcctttcccaaaattccagttcattcttttttcagttttacatttccagttcctttttttcagttttacattcattgttatcttttttaattcggaaactctcttatgttcttccttatcaaaagaggaatgaggtgctgatatggttaaacgacttcacgctggagtagtagtcttcactgtctacaacacatttctgcaacatatagacacttagcattggagctttcggagcatcatagcaaggtaaagtaattgttcataaagca

SEQ ID NO: 35233 - DNA, 413 bp, Oryza sativa
actaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatatatatatatatatatatatatatatatatatatatatatatatatata

SEQ ID NO: 35234 - DNA, 279 bp, Oryza sativa
ggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatt

SEQ ID NO: 35235 - DNA, 4150 bp, Oryza sativa
ttaaaattggatttattgcgtcagccgagggcaggggcgctcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcacccgcaccccgatggtcgccgccggcgaccaccggcgcggcggagcggcgctcgagagaggggagggaagggggaagtgaaatggcggtccacggctcaccccgggtcgatggcgacgacgggaacggcgaccggagcggaggaaggcggcggcgcggctcgggtcgacgaggacggcggcgttccggcggtcggcgggcgaaacggaggggtggacgaggtcggcgaggttgcggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacggcggagggaggcacggggagcgtttatatagggttgggagggggagagagcggccggatgagggggaatcggccacggaagatccggccgccattgatgcgccggcgaagttagggggaaactttccgaacgaatccgagggagagagagagggaaaagtggggggaaagagggagggaatcatggggagtgatttccccctctttattgcgcgcggggacggcggggaagcggctcggattcgcggacgtcggacgcgctagggcacaggcgacgcggcgggagcggcgggaggaatgggatgacgggtgggccccacccgtcagcgagggtggcgtgcgggcacgcccgtcagcggcacgcacgcgcgggaagggggccggatgggccgcgggtgagaggagagagagggagggaggtggtccgctccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaagacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactgcctcggttaacatggattttatactacctgcggaatttgggatcaagcaagccgatgttgatgaaattgaggaagaatcggctagattgattttatcaccagaacaagcagtctttgagaaactggaagggacagagaatcggcatcttaagccattgtatgtaaacggctatgtcaatgggaagcctatgtctaaaatgatggtcgatggtggggctgcagtgaatttgatgccttatgctacatttaggaagctaggcaggaatgctgaggatctcatcaagacaaacatggtgctcaaagactatggtggcaatccatcagaaaccaaaggagttttgaatgtagagctaacggtcagcagcaagactatccctacaacattttttgttatcgatgggaagggttcctacagcttgttgcttggaagggattggattgatgccaattgttgtattccttcaaccatgcatcaatgcttgattcaatggcaaggcgacaagattgaaatcgtgccagccgacaggtcagtcaacgttgccagtgccgatttagctctttgggagatggatggtttcgattgcttatctggaaaagtttgggatggagaatttctaaaagtatccgattgtgatatacagccaattgaagatggagagcccaagttattattttgagggcatcgtggagggttcaaacgtctataacaaggatacagtagatcatctcgatgacaagtaagaacagggtttcttgttggccgatgatttggaagaaattgacataggtccaggtgatcgaccaaggccgacatttatcagtaagaacttatctccagaatttagaaccaagttgacagagctcttaaaggaattcaaagattgctttgcttgggagtattataagatgccaggactcagccgatcgattgttgaacatcggctacctatcaaaccaggggttagaccacaccagcaacctccgagaagatgcaaagccgatatgctcgaacctgtcaaggctgagattaaacgtttatatgatgctggttttattcatccttgccgatatgccgagtgggtttctagtatagttcctgttatcaagaaaaatggcaaggttagggtgtgcattgatttcagagatttaaacaaagctaccccaaaggatgagtatccaatgccagtagccgatcagttggttgacgctgcttcagggcacaaaatattgagtttcatggatggaaatgcaggatacaatcagatcttcatggccgaagaagatatccatcagacagcttttaggtgtcatggtgcaatcggcttgtttgagtgggttgtaatgacttttggcttgaaaagtgctggagctacatatcaacgggctatgaattatatataccatgatttgatcggctggttggttgaggtctacattgacgatgtggttgttaagtctaaagagatagaggaccacatagccaatttgaggaagtttttcgagagaactaggaaatatggccaaaagatgaacccaacaaagtgtgctttcggtgtatcggctggccagtttttgggatttcttgttcatgagaggggaattgacataactcaaaggagtgttattgcaatcaagaaaattcagcctccagagaacaagacggagttacaggagatgatcggcaagataaatttcgctagaagatttatttctaatttgtctggaacattagagccttttatgccattgttaagattgaaagctgatcaaaagtttacttgggggctgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctcccctccttttatacttcaaggggataccacatgcacccttctcttcaaactggactgttctttttctcttgaatgggcggagatcagcacggttgctgtccgaatgacgctccgatgggacagcccacacctaccttcacttccgccgggggtgagcgcgtcgtgggagcatggctgtgcgctgacgatatggtcagtgtcagacccgtcgcaaatcggtcattcttgtccaccgcgtgtaatcttggcaacg

SEQ ID NO: 35236 - DNA, 13559 bp, Oryza sativa
atgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagtcgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttacccattttgttcgtcttttggttttttcttctgcttcagcgatgtcccgtcgcattcctcccgccgccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcaagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggccctcgaggcccgtgccatggcgctggaagaacatgccggcgccgtggagaggagcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcaacggctggcggacagcctctccctccgcgaggcggcgcaggaggagcaggcgcgccgcaaccttgaaagcgtccgcgccgagagagccgcgctggagcagcgggctgctggcctcgaggcgcgggagaaggagctagacgcgagggcgcctatcagcggggcggccgcgggcgaaagcgacttagccgctcgcctcgcggctgccgaacacaccgtcgctgacatgcagcgcgcgctggactcctccaccggggaggccgaggcccttcgcttggcgggcgagatcgggcccgacatgctctgggatgcggtctcccgcatgaagcgcgccggtcggcaagcgggcctctggggaggccagacgtcggtgccccccaccaatctggaaggcctcgctccgcacctcaacaggatggcttgggttctcgagcgactccccgaggagcttgagaagaccatcaaggcatcctcgagggacctcgcccggggggcggttgaactcgtgctggcgagttaccaggcccgggatcccaacttctccccctggatggcgctggaggagttccctcccgggaccgaggacgacgcgcgcgcgcgggtcggggacgctgccgaccacatcgtcaacagcttcgagggctcggcccctcggctcgcgttcgcccccagctccgacgaggagggcgacgccagcagcgaggacggcggtggcgacgaggccggcgacccgggcgcatatgaatgagcccccaggcccccgccactcttatcttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgagggggggtgcggggttagcccgagccaaaacctgacacccgacccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacactctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgaactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcctgggtcgagtcagcacagggttagcctcggggccaaagggctttaagtgcagccttccctcagtggccttggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccctgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcatttatgtataacaataggttcctacgggggtaatgaacgcagttttttcctcatcctccctagccatgcgaatctgatggtaaccagagtatgcatctagaaaacacaaaaggtcgcactccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccaccacatcgaagctcacccgctccgtgcggaagttggcgggtccaccgaaggtgaccggtaggtcgatgtgacctaacggccacgtgtgccccggcgtcacaccgatgatcggttgtgacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggtcagaagctctcgcttcatagccttgaagctccggcgagagacgtgagcacatgctcctccatcgacggtggcaatggtggctccaggttcttggaaacctagatcatcatcaccatcatcaatgtcaacagcgggggccttcttcttggcctcacttcgccgtttgtcggaaggaaccgccggggacttgccgtcacggcgttcctgcctcctgtcctcctcccacttcctcgttcgctcagccaagtttttgactgcacgacagtccgcgagatcgtggagggaggtgttgtggacggagcaccacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatggttaggatgaagcctggcatatatcgatcggggctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcgtgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaggggcagagcaacagaaggctttggatattattaaggaatatcttagctctcctccagttttgatttctccacaaaaggggatacatttagattatatctatcggccggtgagaagtcaatcggttcagtcttgattcaggagcttgacgggaaagaaaaagttgtattttacctaagtcgtcggctcttggatgcagaaacaagatattctcctgtggaaaagttgtgcttgtacttatatttttttgtacaaggttaaggcattacctattgcccaatgaatgcactgtgatatgcaaggccgatgtggtcaagtacatgttatcggctccgattttgaaaggaaggattggaaagtggatattttccttaacggaatttgatcttcggtatgaatcaccgaaggcggtcaaagggcaagctatagccgattttattgttgatcatcgtgatgattcaatcggctcggttgagattgtgccatggactttgttctttgatggatcagtatgcactcatggttgtggtatcggcttagttattatttctcctcggggggcatgttttgtgtttgcctatactattaaaccttatgcaactaacaatcaagctgagtatgaggcagttttcaaagggttgcaattacttaaggaagttgaagccgatgctattgagattatgggggattctttgctagtgatcagtcagttggcatgggagtatgagtgcaaaaataatacattgatagtttacaatgagaagtgccaagagttgatgaaggaatttcggctggtgactttgaagcatgtatctcgagaacagaatattgaagctaatgatttggcccaaggggcgtcgggatataagccgatgatcaaagatgtcaaggtagaggttgccacattaacagctgatgattggagatatgatgtacatcattatttacagaatccatctcaatcggcttctcggaaattgcgctataaagctttgaagtataccttgttggatgatgagctgtattatcagacgattgatggggtgttgcttaagtgcttgagtaccgatcaggctaaggttgcaatcggtgaggtaaatgaaggaatttgtggcactcatcaatctgctcataagatgaagtggttgcttcgacgtgcaggatatttttggccgacaatgctggaggattgtttctgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgt

SEQ ID NO: 35237 - DNA, 15405 bp, Oryza sativa
caagaaggggagggggggaaaaaagactttttagggtttttctttttataaaacctttttaactttgtttatttcttcttaattattatttgtgctctgaaaattccactaaaatttatttacgcattttaggcttctaggaaatatacaaaaatcctacaagccttattcgacttttaactttgcacattttaattgttggaggctttcacatggattttacttattctatgcacaattttgaggttgtattttagagtcgttttgggacgtgacaaacctaccccccttaaaaggaatctcgactccgagattcagaagaactggtgaagagatcgggatgggctgccttcagctcgtcttcacgctcccaggtagcttcttcttcgacgtggttgctccactggaccttgcaaaaatggattacccggttcctggtcctgcgctccatggtgtccaggattttcactggcctctccacgtaggtcaagtcttcgcgaacttcaatttgctctgagtcggcttgctcggatggcactcgaaggcatttcttgagttgcgacacatggagcacatcgtgcacgttgcccaaggaggcgggcagctccaattggtaagcgacttctctgcgtcgggcaacgatacggaaaggacccacataccgaggtgcgagcttcccttttgtccgaaacctgtgtacaccccgcaatggcgtgacccgaaggtatacaaaatcgtccactgcgaattccaggtcacggcgacggttatctgcataacttttctgccgggactgtgccacctttagattatcccgaatgggtctgactttagcttcagcttctctcaggatatcagacccgaacacttggctttccccaacttgatccacaagagcgtgttcggatttgcgcccatacaacgcttataaggtgccatttgtatgctggcttgatagctgttattgtaggagaactcggcataggggagactcttatcccaggtcttcccgaaatccaggacacacgcgcgaagcatatcttctaggatctgatttagacgctcggtctgcccatctgtctgcgggtggtatgcggagctgaagtttaaccgggtacccagctcttcttgaagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtctttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgtagtatcagctgtttaagttctctgttatctggaacgcatactcgatttccgttccatagggttccgtgttcatcctctgtgaaaccagcggctttaccctgtttcatattcttgaggagtccatgcatgtccggatcgttcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacaacgattcccaatgagatagtgccgccagatttttagagcatgaaccaccgcagctaactccaaatcatgggtagggtagttgccttcatgaggccgtagctggcgtgaggcataggccaccacatgaccatcctgcatgagcacgcaccccaatccttggcgcgaagcatcacaatacaccatgaaatccttgcgagtatccggcaagattaacactggcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctcggattgtgagtatatcagaatgtcatcaatgaaaaccacaacaaacttatccaagtattccatgaacactttgttcattaagttcatgaagaaggcaggtgcattggttaaaccaaatgacatcaccgtgaattcatacagtccgtatcgcgtggtgaatgcggtcttcggaatatcttcttcacgaatacgtaattggtgatatccggaacgaagatcaatcatggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcggccagttcatttgctgccatacggtagggtcgcttgtacagaggagtggttcctggagcaagatctatccggaactcaatctctcgtttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtctcgcacaatccactactccttggaattgagccaaccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggatgctccagagtcgaacagaatggtagcagggatggaatgaatgaggaacgtaccaacgatgacgtctggagttgtcagcacgtcctcggccgtcacgtggttcacccgaccccgaatgacatccttcccaccgtggttggagcggggaggcgcttggccttgctgacgcctcggctttgggcatttatccgcaaagtgcccgggctcgaagcagttgaagcacagacgctgcggaccttgagcgtccctacggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctattgattgcggaaattcgccaagcggcgcttgtgcgactccagttccttgtgcttggcttccaagcggatgctcttgtccactagacgttggaaatccggatagtccccggagactagacggacggacagctcagggtccattcctgccaagaacttctcttgcttctcctcatcttcccgcacatcctccggggcgtaacgggccaagttgttgaactcatgcaaatactccatcacggagcggttgccttgcttcaactctcggaattctcttttcttaagggccacgactccggcgggcacatgggttctccggaaagcggcggtgaaacgggcccaagtaataggttgcccttctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcgtccacggggttgttggagctagagaaggtaggtgggcggatgcggaggaactcggcgagtttagagtgttgtgggggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggtggtggtggttgctgccttcaggttggttgccatcaccggtgttagcacttctcctggtcatcaccatctgaaaaccccacacagaaccagcaaacagagagagctgacaattaaagctaaccacccacgactaccataattcttgaatttattactgctattaaattggttcattaaagttcaagttgcttaagcaaataaaataaagacaggctccgacacagttacaccacacaccggcataaccgtgccccacacaacccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgagggatctcgacgaagcaagtccacgccagggactgacgaacaagctcgggcctggaggtgctcttgcgggcggtgatcttctggctgcggcagacacggcggcgcttggggcggcagacctctccctgggcgatcttgagctgatgcagctgcgcctccaccgcgtctaggtccttcttgagctgcaggttctcttgacgcagctccaggatcttcatgttgttctcgaccatcccacggcgcaccatctgatggaagtcgatacgagccgcgtcgtacgcctccaccatgcgcgccaggtgcacgatggtagcgtcatcctctgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccatgtggataccccaggaccacgcacatgccccgcagctccaagacgaagccagtcatgtccaaaccacgacgggtgacgctgccggccatctacaaacaaaaaaacagaaagaaaaaccacattttaaaggtcagattttggcgataaatgaagcagcaagacagagagagactagacagttttcacaaataacaaaggatttttatttttgaaaatattgctaaggtttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgctaacacgattctagtactatgcaatattatttatcaaggccgtgaacccacacgaacctgccttaacccaaggcctacgatgattcagaccgaactggcaacccgaccctgggtcccagctcgtcccaagccaacccaggccaaccattccacattttagttgttaggcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacctccgggataggcaggcaggactgagcccctagcagcaggacaccggccctgtgccatgacatctcgactaccgggccgcagctcgtgtagccttcatttgccctggagatgtccatcgacccccgacttcgtccatctccatccatgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgtaaaatcgcctaaggttacctaattaaaagcgaagcatctacctaaaatcatactagtgataccatgagtagagtgtccactagttggggttttgtttattctagggtgaacaaggtaataataacaataacaataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccattgaagcttatatgctctttaaatggatatttacgaatttcttcatttaaattttgatttaaaatcggatttattgcgtcagccgaggggaggggcgcgcggaccgggtccacgggagtggggcccacgcggcagcctcacggtccacggtggaccgcgtgcacgcggcttacgccggccggcgccgtgggtcccacgcgtcagccgtacccgcgggagcgggcggctgacggccgggccccacatggcagccacggggcgcgcccgaaggcggcctcgccggcacagccgacgggaggcgacgcgcccgcgacccgatggtcgccgccggcgaccaccggcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacggggacggcggcgttccggcggtcggcgggcgaaacggaggggtggaagaggtcggcaaggtcgcggcggagccgaaggaggcgacgccgaggcgggagaaagtccgaggcgacgacggcggcggaccggagctcggcggcgacggcggagagagggaacgacggcgcgagctcgattccgacggggagagagagcggcgagtggcggaaacggtggagggaggcacggggagcgtttatatagtgttgggagggggagagaacggccggatgagggggaatcggccgcggaagatccggccgccattgatgcgccggcgaagtttgcgggagagtttccaaacgaatccgagggagagagagagggaaaagtggggggaaagggagagggaatcacggggagtgatttccccctctttattgcgcgcgggggcggcgggatgcggcggaatccgcggcggcggcgacgctagggcacgggcgaggcggcgggtgcggcgcgaggtaggggatgacgggtgggcaccacccgtcagcgagggtggcgggcgggcccgcccgtcagcggcgcgcgcgcgggggaaggccggatgggccgcgggggagaggagagagagggagggagctgggccgagccggcccaagaaggggagggggggaaaaagactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacgcgacagtttcaaatattacaagggatgtcaagattgtcaaaaatttggagcaattcaaagggcaccggcgtcggctatgaatcctatcattaaactatggccatttagaggttgaggaattgatatgatcggtatgattaatccaccatcgagcaaagggcataagattatattggtggcaaccgattattttacaaagtggctagaagcgattcctttgaagaaagctgattctggggatgctatacaatttgttcaagagcatataatctatcgattaggtattcctcaaactattacaaccgatcaaagttcaatcttcgtgtccgatgagtttgttcagtttgccgatagtatgggtatcaaattgttgaattcttcaacatattttgcataggctaatgggcaaaccgaggcatctaacaagagtttgatcaaattgattaagcgaaatatttccgattatcctcggcaatggcatactcgattggccgaagcgttatggtcttatcggatggcttttcatagatcgatccaagtccctccttataagcttgtttatggacatgaggttgttttaccatgggaagttagaattggctcaagaagaacggagttgcaaaatgatttgatagccgatgagtattataatctcatggacgatgaaagggaagacttggtttaatcaagattaagagcccttgcaaaagttacctaggataaggaacgagttgctcgacattacaacaagaaagttgtgcccaagtctttttcggaaggagaacttgtatggaaattgattttgtcgattgggactcgagataacaaatttggcaagtggtcgctgaattgggaaggaccatttaaaatctatcaggttttgtctaagggagcttatgtgttgcaagaactcgatggagaagtttatggacgatcgctaaatggcaaatacttgaagaaatattacccaagtgtttgggtcaatgcatgatcggctggtgttgccgatgcatgatagccgatgtgttcacattgccttgagatggccaatattgttctatcgcccttagatgtttttcatattgtaatcggttatggtttaccgatgtacaatggccgatattatgatatcgcccttagttcaacttataattttagcaatgtcttcgtcattgtaaaattagggggcatatatgtgcaaaaattgtaaaatttttgagcaaaaacatggagttatattaatcggcacattaagactagttaaacaaagatccagagtttcttagccgattacaaaaattcatagagtctattacacaacatgtcactgagacaagtagcgctggatagccgatatagctctttggctaatttgttctacttcttctatggcttgggcatcttgagcatcggtcccagagatgatttttagggacttggtcatatcagcaacatttttgatggctgattacagccttgccttctgttcttcgacagcttgtgggagatcggctaactttttgtgttccagatccagcttggcgttgcattcttgaaattgtgccaagagttcaatcttgcgagcttcgagccgatcaatattagacttgattggcccctcacatagctgatcaagcttggacttttcttcatgcacgagttgccgattggcctagatggtagattcattctctttgcgttctcggcgtttggctagtctttgcatggctttcttgtcattcccataaatttagcccaaatttccagactattttgtgtattaaatccctgtctaagaccagccagggtacacaaaacgaaaagtaatatacagttccaaacgtaaataaaagcgtaaatagttacagaagaggcacttagtcctcacaccaaaacgaaagcagcagcagcggaaaaaggcgatcctagtggagcttcagttccactccacaggcaaaactcaactgaggtctgagccttggtcttctaacttcgtcttcagcttagaagcactacacttctgaaaaagggggcataatagcaaggctgagtacaaccaccatactcagcaagccacaccaacgatgcagacgttcaaggggaacacaaggacgatttgtggctatttgcataaaggcggttgtaaaacattttattgagcaaaacagtaaaactgttgagtaattaaggtaatattaaatctccactgatcaacgctacaccacgttgaacaggcccaaccaacccacctgaactacagtgcattgggtcgatttattaaggtgggactaatcacggtggatctggtcgaccgcccacaaccgccggcacggctattcgaatagttttactctggccagaggtgtacaactgtacccacaagacacagccccatgacacgtttccatgcgccgacatgccaccacgacatactggaaagaggccgtgacaggaccattcgcataaccccctctaaccgatcgcaccacacctcaaggttcgcccccgtccccagcaggcaacgggaagcccccctctcgtgccttagtgaatccggaagccgatcagccagacaccccggccgacccaactccatcacgcccaccctcgcctgggtacattggctagacgaaagctacactacaagcccagccgttgcccacgctggcttgtggtaagcatgataaattcttccagggtttcccgcgaactggtccttaatttccatgggtgcaactagcaaaaccatgcacccgcagcccaccattcagtcgcattttagttggataattacgaccataaagcatggccagatgtctcaagcacgcagctcattctgatactataaaggtctaatactgtaattatcccatcaactgagctagtggtaattaagcatggctaagcatatagttctagctaggtcacataagtaacatgagctagtcgatttattacccaaggttgacaaaagacagatatcaagtaaacatagcacaagcaagcagataggtagtacccggatcccatgtaattagcaagacatgcatgtttatttgtaaacggtaaaacatttataaattgggatcaacatgctcaaggggaatgtgtgacttaccttgcttcttcaaaacaatcttccgaactcttttcctcgcgaccgtggacttccaaaacgacggattctacacgttggcacgcaaaacaaggaaaaactctaataaaaaccaagaaaacagtacataaaaagtaaacaaacatgtagatcttaattttagatgaattttgcaagttgaatggcccaatttggagttcgaatgaattagatataaattttagaagttttgagccatttaaatggatttctagaattattatcgaattatgacgcaattactatttatttttcaaagggaaaaggtagtcgctcacgtcatcgaaggggaggccggcgccgacatgtgggccccagacgtcagtggctacaagggttggcacacggtggaccaagtccaccgcggcccaggagacgccgtggacccggaccacagggggtccacgggcggcggagcggcgccagccggccgagaggcggcggcgcgcggccggatggtcgctgacggcgatggccggcaaagtggagatagagggagagggagggatgctcaccgagcggacgggacgatgaggcgaggacgggaaggcagtcggcgacgaggattagcgacggcgctcctcggggaggcggcacggatggcggcccgacggtttccggcgaaggcagagaagcagccgaggtgcatgtcacatcctgattttcgctttaggtttcataaattatttaataaattatttttagaatttatattaaatgttcattaattttcaagtgaagctaaatgtaggaaataaaatttcctaaatataaagcatggctggatttagttttcattaaattctccatggttaattatactctctgaaattttctcggatttttcggagctcaattcttaattttaataatacaaagagcagttcagcaattatttaaataataaattaatcattaaatggtctgattataacgttgttaagtactttgagtgtccaattagtttcaggatttttcttgaaattatttgagcattggaagtatttttaacaattcaaagatcattttggtgattaatttaattggaaaagtaattaaattccccttttccttttcgggccgaattaggaaaagtcctctcactctcggcccagtctcctctcagcctgcagccctctccctctcttttccgaagtccatttcttgtccctccttcaatcaggccttggaaaatgaagcccagctgaaagtctgtattgccctccctcctgctacagtgcgtcttcaagctccagccagccgtccagaggccgtgttcttcccgagagccgccgtgtcctccatcaaattcgatgcatccgttgcttcccttccaaaattgattgcaaaaacggattcctctctatctcctctatcttatctccaagaactcccttaaaattcgttatctatctcacgaatttcagtcgtttttatccgggtgaactcgggataaatcttaacttccttcaccgaattcatccgttctcgagccgatctcctccacctttgcctacaaatagcagcccctcggcctcctcttcggtttccctctgtttcccgaagttttccctaaccctagccgcctccccacgctcgccttctctctccaactccggccgccatctccagccgccttttcccgtcgcgccggccgttcccgatcagtgccgccacttccctctgctccgcaaggttgatctctaccacggccgccagttcttttgcgccaaatcccgccggaaggttgccgtcaccgtgaacccgtgggttgttgccatggtttgatctccactcgcaccgttcgtcgtcgccttcggtcgccgccgcctccattggattcgcagcaccgaggagaagcccgttcacccctcggttgtcgtctcctgtcgctgaaactccgccgccatcatcgatcagtaccccgtcgtcactcccgttctcgtcgccggccatctcctttgctgttcatcgctgcgtaagtgttagtaaggatcgtcgtgtcctcctcttcatccccgtgctctcggtttccgccgttgtgccgccgtttgccgtcctcaccaccgaatagagccgccggcgtcgatcccgcatggttgccatgtcatcgccttgttagctgccgtccctaccatctaagtgtcacgccgtctctcagatcccacgtgacagccatctaaaaccttagatcagatcaatccgagccatccaattttggtcgactaggtcaaagttgatctcagccgtccaaaatcaatataaatcctgttatcccttttcaatggcatattagttctttttactatatgtcgtctactaaattcattccaataatttccggaggatggtttaggcttatgtctcagttataaattatatgtaaattgtttaattaatttggaatagtcttttctttaataggtttaattggaattaatcttgtaaaattcataactaattcatatgaagtcggaattaagtggttcaagtctctaaattcatctaaaatcatgatctacatgtttgtctactttttatgcactgtttatttgtttttttattagtctttttcttcgttttacgtgttagcttatcgtttccgtcattgcgaaggttcgtgagtgcgtcggaagtgttcaagaagattaattgaagaccgattattgcaaggcaagtcacacagatcccaaacaaccctttgagcatgttgaacctacttaaagctattgttttatttcaacttatgcattattttcgaatgtcatcgggtggtgagcctttctcaattaattatggccgaagatgactttattttcatatgggtaataaattgattagcttggaccttatatattggattggttcagctaattgctatatacataattgcttagccatgcttagaaacattagctcactaatgggatgaatcaaactacattattatttatggttatatttaatggtagctcacgatggttaatcgtgttatgataattaattgataattaaaacttgacaatggtgggttgtgagcacatggttttgaaggtcgtgctcat

SEQ ID NO: 35238 - DNA, 53320 bp, Oryza sativa
tttttttaggggtgattatgattaagaattggtgaactgtggtgagttgtgttgtcaaaggggtactgtcacatttaattttcgatgtactgtggtggtattgaggcgcatggtaacatgtcgtggacctgtgtcttgtgggtacagtggtacacttctggccagagtaaaactattcgaatagccgtgcccacggtcatgggcgagttgagcaatgtttttcgtgattagtctcacacctctcacaataattatgggtgctataactggtaataatttgcttagctccaagtttggagttagatctgtacagccgggtatggttgtacaggatggttgggcctgtgcagcattggggtgctatgcagtgttgattaaaattgataattaattactctactgttttactactcttaaatgtttgctaaatgctgcttttgcaaacgagcctatattatgccatactttggtatccttgtgcacttgcatagttgatgtgtggcttacagagtatgtcatatgctcaccttgtaattatcaatcaaacctcagttgaagaaaaatgatccagaaggagaagacgtttggcttataccccagttgagttgcctgtgggagtggagcctgagcttcgctagatttttttttccgctgtagttttcttcgatgtgaggactaattgcctcttcagtaagtattatttgctttagttttttttgatgaatctgtatattaaattgtcagtttgtgtacctcggctgattcctggacgaggattttatgcacaaataagttctgaaattactagtgaatttctgggcgtgacagtgtagcgcggcctgggagagatggtaggagggttaggaaggggagaattggtgcagggtgaccgagaacggcggctgacgacgatcacatgaggaggagctcacctagagcgaagagggcgggtttcggaagagtggtggccgggcttgccctcgtccctgcgaagccgaaggaggtggcagcgcaagtcggcgtcgaccggagaggcggcgcgacgccgttggagtcggcaatggcgacgaagagaggtggtgagcgtggcggcggcgtttcgtaggcggataggggaaaaagagtaagggccggggtggagctcggctgggagatgctggcggttgcggcggcacggctcggcggtgcctaaagcggcgaggagcggctgctggaggtggtacaggcggcgatggctcgaccttgcgggggaagcggtgtaacagtgattgtttagggaaaatgagcgacgaccgatgtgcgtcgtgaggtggcgaagccggaggtggcctcggcgcggtgtggcggcggcgagggcggcggctggagctcgccggagagccgcggagatgggggcggcgtggagagtgcgggagaaagcgcgacgagcttgggtgaggaggggaaacgagagaggatggcacggggatggtttttatagggctcggggcaacggggcggcctgggagaggcggcaaccggcggcggagtgggatgccgacgtggggaagcaagtggggttagacgcgagcacgggggacgggagatggcggattttgcggcggagtgggatggtttcagcggccatggaagttgctgtggggtggctggacgtaggagatgacagacggagcccatgggtcccacctgtcagccggagggagagggaaggctgggagggaggcgaagtggacttggagggggaggggagcgagcaggccgagcggcccaaagacggttatgggcggcgggccggaggggaagggggaaggaatttgggccgagcctgaaagggaggaaggggaagattattttcttttctttttatttaaattgattaaatgaactttgtattataataattacttcttgagctccgaaaattcacgggaaaatttcagagaatatttagggcacaaagaatattacaaaatattctcggccaatgatttttaaaggaaattttaattctcccattatttcacttgattaaattgatttaaattttatttaatttctaggaatgcattattaaatgatttttaatcccgaaagaaaatcggggcgttacaaatctttgtcaagctgcgtctgttccaatgcagagtcggtcagttcagttttgagaaattaactatgcaataattacaccttagtggtgtgattatgaatcatggatggttttccttagttcaaggcaactaatataaattctagaaatcatcatgatgtttctcggaagttggtagaaattgttccatacatgggtcagcagcatacaagaatcaagtcccgaaaggtgtaatcagcagggcgtatggcagagaacctcttctcgacggatcatctttaccgaagatacaaatgtgaagttgttatgatcaaagggcagaaattctcggcaacatcaaaggcagtttccaatagacgttcagattgcagtatatttggaaaagcaattgcatggcctaatagtccgtcaacccaggaagagttagcaaaggataatcgaagaggtacaccgtatcaagagaaaccgcatccgaatcaagagaaaccgcatcccctccacctcctccactctcctcccccactttcccccaaaaaaacggcaccagtttgacctccccacgagctccacgtcgcctcccacttcgatgcctgttgccgcccatcccggcccgagccactccctcccgagcctataaaatcactcccccggccatcctctcccttttccccaactttcccgcactccccgcgctctctcccgctcttcccacgtgatcccaagtgccgccgctcgccgacgaccctccagctggccgctgccgccgtccccgcgccgcgccgtttgcgccgccggcctcgccacgcattgccgcaccccgtccaccgctccgcttctgcaataaaccacccgggcaccggtttcaccgtgcacccgagccacaacagcctctcgtcgcctccagccacgggccaccgccgctcccgccgccgctgtgctgtgccgcctccactgccggcttcgccgccttgcgggcaagctcgttctccactccgtttccccattccatcgttggaattccacctccactgccaacccgagccgcaaccatctttaccgcctctggccatccctcgccgccgctctgagcgacctccggcctcgtgtcctcctccggtggcatcgcggcggtggcggggtggtacagaaaaggcggcggagtggggtggctcgggcagccatggcgacagttggagccggaggaaggggatgggcctgacgggtggggccgtgggtcccacctgtcagtgaggggaggagggaggaggctggcacagggacgcaaagcagtcttgaggaagacgggtcgacggcccgtgagaggaagggaaggctggccgagagagggagatagggtgagcgggccgcgggaggggaaagggacttgggccgaaaatggcccaaggaggaagggaggttttattttgtttttctttttatttaaattgattaaatgatctttgtgactttgaaattatctcttgagctccgaaaattgacgggaaatttcagagagtattttagggcacaaagaatattgcaaaatattctcggccaatggtttttaagggaaaatttccggttgattggcttccggattcaccgcggcacgagaggggggctacccgttgcttgctgtggacgggggcgaaccctaaggtgtggtgcaatcggttagagggggttatgcgaagggtcctgtcacggcctctttccggtatttcgtggtggcatgtcagcgcacagaaacgtgtcgtggggctgtgtcttttgggtacagttgtacacctctagtcagagtaaaactattcgaatagccgtgcctgcggttatgggcggtcgaccagattcaccgtgattagttccaccttaataaatcaacccaatgcactgtagttcaggtgggttggttgggcctgttcaacgtggtgtagcgttgatcagtggagatttaatattaccttaattactcaacagttttactgttttgctcaataaaatgttttacaaccgcctttatacaaatagccacaaaccgtccttgtgttccccttgcacgtctgcatcattggtgtggcttgctgagtacggtggttgtactcagccttgctattattccccctttttcagaagtgtagtgcttctgagctgaagacgaagttagaagaccaaggctcagacctcagttgagttttgcctgtggagtggagctgaagccccgctaggatagcctttttccgctgctgctgctttcgtttcggtgtgaggactaagtgcctcttctgtaagtatttacgcttttatttacgtttggaactgtgtattacttgtctttttgtgtaccctggctggtcctggacagggatttaatacacaaaatagtctggaaatttgggctaaatttctgggcgtgtcatttctccagtttgaattgatgcttttcaagataagcagctggagtgaggacatcggctagttcttcaggaatcagagcttgaacttcgtgtagccgagtcgtaattgatccacaatctaccaccaaggtgtctagagaagatgcctctagctgatgagaaatatcttcaagagtcttcttcacatcatcggataagggagctaagggtttgtttgtggtgtcctcttctataagtagtccttgatatcaaaagagaacagatcggctaaggcttgcaaaaataattcaaagagaattagatgccaaatagatatagccgatctaaatccttgtgtcaaaaggaaacttactgggatagtaggagcggctggttgttctgcttcctcaatattgtggcttcctacagcaaatggagttcattcacttgacatatgctgtacaggaggtgaaggaggaggaggaggctaaagaaaatagatgttagtccacatagagtatgattggaactgaaatattttcagaagaatcttaccggcagagttggtttggattgggttgctgccgatttcttcttcacagcgaacttcttcttctgcaaaagacaagatttatgagtaatcaactatgaataaaacaattggaagaaggaattaaagagagctgtttaccctagagaagtgagctggagtagaaggagtcggaggagtctgtttaggtgaagccgatggagttctttctgtatcacttacctcggctgcagcttcgtcaacatcctcttcaatctctagttcatccaaggcttgctcaatggatggatctagggcaggcagatcatcagctaccttgggtttttgtttcttagtcttcttcttaggagccagaactaatggatcgattgttggtgccctgggtttcctcttcctgccggtatcggctggctctatcatctgcccttgaagcagacttgcggtcttgggggcatgatagctgataactggaggggttggtcaaccaccatttggcaagaggcctggggcatactctatatctctgccactattgctttggtgtggaggagaagattctgttgtctgcaaaacagaagagaagattagtcaagttatgaatcggctgacaattgttcaaaagaaattaatgaagtcaaggtttacctgagggataacattaggaaagagatctgtcacatatattgaggccggttggtggaacaaatacagcttccattcaccccaccatctgtcaaagttcttgctcctgaaccttgccagctctatattttcaatgctgcccaaaggaggtccttggatattcagcagccgatccatcatcaaggttgatgagatttctcctcggcattgaattttatcagcaaagagcaagccgattggtagttgacccatcccaagtggtctggcagagctcatcgagtgataaaattcataggaaacctgaatgttcctcccttgatgtatgccgacaggaagaatgcatgggctaatcgcagctgagaagacttctttagatttttgagatttttcattgttgatatcttcgaatctaaagtctgatgggagatcaagatgcactgaatcttcataaggaaaccaaactcgagcatctttttgaaaaccctcatagaagctgcagaaccaatctttgagcagctcggctgataacttcgctccagcatcggctggtgtgaatgcatattctccatatgacatgcatctacgatgagtgctttcttctccatcatcttctacaatcggctgcagtcttgggaattcggcttctatcacggatggccgattgacagctttcatgactaccagattcagccaagtctgcagcagccaccatggtccacctgctccaactactgagccgacgactatcttagtcgatgcattgttcagcatttggtataggtagccgaggatgattttgcctagaggaaattgtctttttgattctagagcctcggctacaaattgccagttggttgtaggaccacaactggatccacagaaaaggaacttttctagccacatgagcaaaaaggccacgtgttcttgagcagtaacagatccttggcccatatatgctgccacgtaaccagaccaaccgcctatgctcttggtcttgaagtcatattgattcttggtgttcagactcgtagggttagccgatgaggtcacatctagaccagtgatcatggtgatatctatcagggttggtgtcatcggcccttggttcaacaaaaaggcgttgatggtattggacgagaaataggtggcggcagctattaggggttcatccttagccgaattcgctatggtaagggcaagtgcttgaccgattccaatctcatcccagtgtgtttgcttgctagccgatacacgcttgtaccatgtggtccagcttttctcgggtgaagttttctcgagggctggccaagatttaaaagtattcttccagtgacctagattcgggttagctaatctgaaagggatcctattggtttcaccaatgataaactcagtgggattgggattgccgattggaccaagaaagtagtggtttttatgcgacaaactcggaactgcgatcagattggaaagttgctacggatccaaaagaacagagaagaagaaaacaagataaggaaagggaaaactaatctgatgcgaaaagagaggatctagccaatggaaacttacctctgcgtactcggttgaagatgcggcggatggactggcggaggtctacatcgttgtgggcagaaagttggccggagaggaaatcgcctgggaatcgcttcgtgcaccgaggggatcatcggagagagaggacggagtttgcttcggcggtgaaaacggaggaaacggtgtgagatttctcggggacaacggttagtatttaaagcgttggaataacggtcggaaaacggcaagtgcaatattctctcgcagtcgacgtatggcaaatccgaaacattatccaaaattctggacttggggggcatgtgttagtcggacagggttagccgattgagccgaatccgacaatatgacacggcatatgttgtcgggttagaatgacgtgcttcatgatgattgccacacatggatagagtcctaagaaggcaattgtatctattaagtaggatattttatgtaatttccttagagatatgtttgggcaaaagtctgctgcaaagacttatggtatcttagagtttgttagagataagaaacgtgtccgatatggacatattttgtaatttttgggtataaatagacccgagccccatataatcgaactaacacacgttcactacaatctcggcgcatcgccaccctttttactttcattttgttttgacgagttcttgctttcgggttgagctgcatcggtttcgatcttcaactagaggtaaaactcgttatggcggcttgcgttctcgggattagtgcttccatctttatgatacactaatcttgtttatgtaattcgtcgagttttcatatatcttatataatctctggcaatatcgctatctaacctctaatcggctaacgtctgttactagaaggcagccgattaggttaaatatcgatgctgacttagattatataggatatctaccactctatgaaacatccaacgacttgattgtctagatattgtccttcttttcatacttatagctgcatcagttgagtttaatcttatgagtgatgattagaatctcaatctctaggctgcctttggctgccgattagggtagcgtcagagtttcagccgatcttacctgatttaactaccattttctcatatgcttaattgacatgttaaatctgcccttaagtatattaggcttttgtttggtgtattctacttgccttaatatcttgatatagagtggtatcggagtattagcctatacatgctagatctatctgatcggctatgctatgaacatatatagtctcgttgttaacatatacttcgatctatgtgatttatactgtctcgtcatggcgacagatcaatcccaatcacttgatttaagtatatagcgacataaggattatatattgttaatatctacaactgatcgagtagatttaattagttctttcttacttattcatgattgccgatcgatccacatatgacatcggctccaagataaatgatacttcatcggcaattagccgatcggctatcgtttatggatttaacccgggtttctttgtctttgtttcttgttgattgcaggatcaaatcaactggcacgctcatacacctaaaggcaagcttctggacttacactggagttaagcagatctcccaggcctcgtgtttttacatggaataagttcaccggaggtccctcaaattgacaccgagattttttaaggtccctaaactagaataccagaaatgtgtacccctaaaattactaaatccgagattttttaaggtccctaaactagaataccagaaatgtgtacccctaaaattactaaatccgtccgtagaaggtccctcgccagtattgactcagtttttgcccggttttgttgacgtgtcgcgctgtgggacccactggttagtccaccattggggagttaatagacggggttaaaggctctgtcctcgctgtttccaggcgttgccgcgacattttcctcttctcgagctgaaaccctagcttaggtcggcggcggcggcggaagcggcggcggcggcggcgggggcgacaagaggaggtgaggctaggcgatggcgagttattgcagtgaccggtcgtcggggtcgtcgcatcccagcagtcgtgctcccatcccggcgcgagttgggccctatgattatcagccggcggtgatgtgccgatgtggtgcgaagccggcccggtgaatttccgggagcgtggacaaccctggtcgatggtactaccgatgccgcaatcgggtgagtgatgaagatttcgtttgcttgcttggtttttgtttgagctggcagtatggttgggtgatttgggatgtaatgttttcagggcgccggctgcgatttttttgactggtatgagcctgcaacaagtagttttttgagggagctgttgaacgatcttcatgaagccgtgttatcgctaagaagggagaagaatgagctgcaacattgtgttgaagaactgaggccaaaggtagaagagcagtgcctagaattaggggtagcaatgaatgaagtggcacaattgaggattgtggcagctgagaatgaagctaacatggctgctatgagagcaagtaacagtaggctagagaaacagagagtttggcttgtactgatgtcgttgggatgcatgcttgtgttgtttgctatgattttagttcagctgtgaggtgcaatgtgttaatctatgtgtcaaaatgctggtagctgaaagcattttgctgcattttgccaagaaactgagctgtgctctttgactatctaagttaagtgaatggatttgtggttggctgaattgtgattgatattcagtaatgacactgacattgcatatatttgagctgactttgcagtggttggttgaattgtgactgaatatcatcttttgcagtggctgagtattcgtaactttgcacataaattttagcataacaaattgataagagtcaattcatcacatcagatcagctcagtaaataccatctcatatcagattaggctatgacacatcatttgagcaaagtcactcaatttagatgataacaatccacatagcttagctggcttacagtctgccagaacaagcacatatcacagcatagttggcaagcagtttgccaaattacagaaactaaacagataggcaaagttggctaagagtctgccaaattacataaagttcacagtaggcatagttggcttagagtctgccaaaatacacaaaaagcacataacattgcatagttagcacaatatggcatcacagcttgtcagtttcccatgggggaatcagcatcagtggacctgtaggtgttttcttgggcttggtagtggctggttcttgagcttgcacataaacacttgctttctcagaagtgatcctcattgaagcagaagaagaacattgagagtgtggcactatggcctgaagtttcacactggttgaaccacctctttcagttgccagcctagcactggctgcaaccttcacaagtgaactgtttgtgtttgctgactggaaggaaaagaaacaagtgttgttagcaaatgaatgttaatttcaaaagtttaattgaatgaggactggctgacataccttttttgtaggagatgttctcttcctagtgtggcaagcagatgtgctagtactgagctcagctgccttccttttcctgctttgtgcaatgctgctaggtgtgcttgacaacactaagttgttatttgcagtgactgtatttcctggagcagatgttgcagctgcagatgtgctaccacctgccccactgtgcatgtgacagcccttgctattgtgaccaggttgcttgcatgatctgcacctcataattgtgccaaatttggaagctttggtaggtttagctggctcattaggctcccttctcctttcagtcttaggcctccctggcatctgtatgtatcctggggcattgagaggctctctaggatcatctggccaactagtcatgccctctactggctgcaggcaatgggcataggttttttttgaaagattccacttaatagcatggagcaacccacccatctagtgtgttggtgctatagtagatgcaagcaattgcatgaggacatggcaaacctgacaattgccaatatctgcatgagcactccttcatatctaggttaactatgaacctatgctcattatgcttgacttcaaaactgtcagccccattgcatatagcatggcagaatgcagattcagcaatgtacacattaagtttcttaagtataccagggcaaatgacagtactccatctattagaacattttttttggtcatggatcctaaccattactttccttctaatggtttcaagcattgttatgataggaaagaatctagcctcaagaatccatttgttgaaagattcacaaatgttgttatcaacagagtcacaattaaatcctaacctgaaccaagccctactccaatgctctgggtgtgtgttcaatattgcttgagctctagcaggggtcagttgggccagctttgctcttggcaagttgaaaagcattctgcatgatgctttggcacacttccagaattttttttgaaacactttatcattgaagtgcctcttccaattggcatagatatgcctggcacagttcctgtgttcagcttctggagcccacttagagacagcattaattattccctgcatttgatagtaacatgcacaagacattaggtatgcattgtgtaatgacagaattgacagaacataaaagcaaacagtggatcaggagcattaccttctattggtcagagatgaagacccatccacttccatcaccaaccctcagatcactacacagcaagtcacaaaaccattcacattcttcattgttctctttataggccacttcccaagctattaggtacatctgattattggcatccctccctatagcacacaatagctctccatttgtagatcccttggaaaagcaactatcaagtcctattaccttcctgcaaccagccataaaccctttcttgcatccatcaaggcaaatgtaaattcttttgaacacaggtggttcaatacctatcactctgttgatcgccacagtgctcccacggttggtcctaagcagttcttgttgataattgtaaagcttctggtactggcccttggtcacatcaaatgccttctgcatcacaagtcttttggccctcttaagcttagaaattgatgcatcagcaaacatctcttgttgaactgttgctttcatatgggatagtggccaaccagggttatcaacaatgaacttgccatatttttctgctatcctaacagatgaaacatgtctactgtccctccttggtgggcatgcatgcatactgtcataagtggcaatctgccaactatcacttcttgtagtcttggacagcaaacacacccaaggacagctagcccaatcacactttgccctcaccctcttgtgatcatctttaataaaattaatcactttcctttcagccagggcatattttataatggtcttcttgaactgatgcttagagctgaacttcattcctagctcaaaaacaggaacccctggctgcttctgaaaccttggaaacttgccctttcttctaacaagctcaccatcactgccaacctcatcatatgagtcttcatcatcactatctgcatatggggtgtcattgccatcttttggacctccagctgttctagctgactgacttttaaaccccctcaaacacaacctcatctagctcatgaacctttccagctctcatcttcctcttcaactctttgtagtgtccttctatctccctagcctcttcatcatcctcagaagggcaatcatctcctcctacataatcactatcatcctcactgtcagaaggtaggatagtgtttatgggtgaggtatccctagaaggtgagtactcccttataggtgcattttccctcaaaggtgacctttccctataaatgacaatcctcctatcactagcactttcatccacttctattgctttacctttaccagcacccacaacagctttgcccttccctttgtccacaatagctttgcccttatctttcactttcacatttctatccccatccttatcctcatctccctcttcctctgattcttcatccaaatccaactccatttcagcctcataatcactgtgttcctcttcatcaacatcaattacaatgggttcgtcagcatacacctcaaccacactaccctcacttatacagtcagacatgaacccacacaccttatcatccacaaatttgcagtgatcttttaggtgtccaaaaagttcaggtaatgacactttatccctgtctatgtatgacattgcttctctccccccacaatacaacttctgtctccctctattaacaaattccccattgaaatggaacctaactgctagagtgcctaatggatccatgctgacagctatccaaaattaaaaaaagaagcactttactactctactattaaaactacactacatgcatatccttaatacctagttaacacctaacaccgattaaaaaaggaccaccccaacactaacccacccagattcacatgggtatacaaaagcattactacacctaaagcatatgggacaatatactacttgacctctacaccgaatcccaaacaaaaaacgaatctaccacattttaaatcttcccccaaaatcaacacagtaccagctacaatagcacgcaatgccgagccaacaaggtactaaccggggtggaatccgccacgcgtttggacgaaaacgatgctcgtcgccagcgccatggccagctcgccgccgccgacaaacccgccgtcgccttcaagtcgcctcctggtcgcagctcagctagagttcgagcaaaggagagagaatggaggtctggctagctgcgctcccctccgttaaccccgtctattaactccccaacggcggactgactagtgggtcccacagcgcgacatgtcagcaaaaccgggcaaaaactgagtcaatactgccgagggaccttctacggacggatttagtaattttaggggtacacatttctggtattctagtttagggaccttaaaaaatctcggtgtcaatttgagggacctccggtgaacttattcctttttacatcaacaatatgctatataatctagattaataacaaaatctaaatctatcggctactctctagcagtagaaaccagccgattgcaggttagatggcgcaactaataaagattatagagcatatatgataactcgacgatttacatatacaagattagaatgtcataaagatggaagcactaatcacgagaatgcaagccgccatgacaagtttacctcttgttgaagattgaaatcgatgcagctcaacccgaaagcaagaactgttgttgttattgaactgttattgaaagcaagtaaaaagggtggcgatgcaccaaaaatgttattgaactgttgttgttaattacatgggttagggttatatttatacccgagatacatgataggtccttgccggacacgactcttatctctagcaaactctaagatacacataagtctttacggcagactcttacccaaacatatctctaaggaactatttaaaatatcataattaatagatacaattgcatatctgagagcttatctccatcgtggcaatccttgtgtagcacgttgatcgattccagaaacggttttataaccatctttatgaaatcggctgtcttctgtccgatccatttcagccgtccagaaacggttttataaccatctcaatgaaatcggctatcttctgtccgatccatttcagccaatgcagacttcagccgatgcctccgcaaccgatacgcactctgttctgcgaatacaaagatcagcccgaggagcagaaagattttgaattgtgggttgctccatcaaggaaaggaataaaagaagaaaaaaataaaaaataaagatacgaggatgaccaaaaaattaacaacagttctccggcaacggcgccagaaatgcttgttggtatttcttatgaccacagataaatccgcaagcatacggaataccgttgtagcacttcaccttagggtgaccccaaaaggatatcgaacagggagcgtgtgtaatctacctaaggctaagattatccaaggacaacaactgatggttggtaggctaggctagagaggacttactatgtgttttaaatatctaagctaagtaaaggtaattttctatctattgcttcgagcagcgacccctgctggtctactagcgtggttccggctatagctctatgatgtatccgaacgtggaggattactaggatgggattcagggctgtcaccacctgctgcctacctctaacaaatccgtgggatacacaacaaacaaaggtaatctctaacctagacaccacgcctatgttattaattactactctaatatttgtgcagaaacttccttctctatccggagtcctagtactagagcacttagtacgaatactaaacaatgaacccgcaaagctgtaaatatatcttactcagactaagtaattaaataacataagaaaggaacacaaatgcttacttaatagaagaagttctccgaacctggagcagagtgtaccgatagctccggtactcctccataatttctcctaggaagctgcactcgtcgaggtagaagtcggatgagtgccaaacttccgggcactcctccagagcttctcctcactctctaccttattctaatgtacaaaagatacaatagagcctcttgtaattcagctcaaagttgtgtgttcttgaagtgagaaggagacctccttatataggttccaaatgacggttaggggcatgggaaatgaccaaaacaccctgcaaccgccataggggagaaatccgagccgtccacgtgaagccagatggcgggaggtgccaggattggttcaagaactagaaaaacgtcctcccggcccctccttcggccggtaggttgcttaatgggcccccaacatccttcactatgttttggcccaatcctagatggtttttattgacttattttgcctccaattcgtgtaaacgcgtcctgaatgttcagaggtgcattatgtcgcatgacggatgtgttttctcctcaaaatatctgcacacacatatttcatcaatactggtagaaatgattagttataaaccctaccactaagttggataccatattttatttcattatatgtaagtattgatggtcaaatattatgatttaaggaccgtcaacattgactaaccaggagatttctaaagactatgctgattttgagagacttgtggacaggaccattcgttaggaagatcaacgtaacaagatagatcgcaagaggaaagctatgcagttcaggtttcagcaaggtggacagcagaagcatcgctgtggttatggacagcacagtggttctactattatgattgttcgatagcacaggccatatcagctaggaaatttcagccgaggcaacagtggaaatcagaacaaccataatccagttccgcgcccgcccagtctcaagctttgcagccccaccagccaaagaagaagtcagaacaaaagccccttatgtgtttcaactacggagataccggacattttgcaaataagtgccctaaaacaatgcgcaatggacccaaggtcgttcaagctcgtgtttatcatgtgtctacaaaggaagctcaagcagcgtcagaagtggttttgggtacgttccctgtgaactcaattccttctacagttttattcgattctggtgctacgcattcatttatatccaagagatttgtttgggtacacgggttaagaaaagtgtaacttagtactcccatgaaagttaatacaccaagtaatagcttaacattagttagtttttgttcctctttgatgatagaaatccaagggtcaccttttctagccaatcttatccttctggagtgcaaagacctagatgtcatactaggaatggattggttgacaagacataaaggagttattgattgtgcaagccgcacaattacgttggttaattgaaatggagaagtggtagtaattcaatctccatttattcagaagaaagaagtaagcttgaattaagtggaaagtgaacaacaggatgaagtcatgaaagatgtcccaaagttagaagacattcctgtggtttgtgagtattctgaagtttttttggaggagtcgacagctatgctgccaaagaaagacattgagttccgtatcaatttggtcctaggtacagctcccatctacaagagaccgtacaggatggcagccgaagaaatggcagaagttaagaagcaagtggatgagcagttgcagaaaggatacattcgacccagcacatcgccttggggtgctctagtgatttttgttgagaagaaagacaagacaaagaggatgtctactgattatagagcgcttaatgatgttacgatcaagaataagtaccctttgctaaggatagatgatatgtttcatcagctgaagggagcaactgtgctttcgaagatatatctgtgatcaggttaccatcagttcagaattcgcgaggaggatattcctaagacaacttttacgactcgctatgaattgttcgagtgcatagtaatgtcgtttggacttaccaatgcacccacattcttcatgaatttgatgaataatgtgttcatggaatacctggatagtttgttgtggttttcattgatgatatcttggtttattcaaagtctaaggaagaacatgggaatcatcttcacgtagtgttggagaagatgaaggagcattagttgtatcccaagttcagcaagtgtgatttttggttgaaagaagtcaagttcggcatgttattaccactaaaagagtagcagtcgattcgtgaaatgtggaagcagtcactaagtggattccaccgaagacagtgatgcaagtgaggagttttcttggacttacagggtattactgtcggttcattgagaatttctcgagaattgccaagccaatgacacagttgttgaagaaagaggaaaagtttgttcgtacttcgcagtgtcaggagagttttgaggaactcaagaggagattagtgtccgctctaattttgattctgcccaatcagagaaaggattttgaagtgtattgtgatgcatctcgtcaaggtttgggatgggtgcttattcaagaaggtagagttgttgcttacgcctcgcgtcagttgcgtacacatgaagacaattatccgactcatgatttggagttagcagtagtggttcatgctttgaagatctggcgacactacttgattggtaatcgttctgagatatatatactgatcataagagcatgaagtatatcttcacccagcccgatttgaatctccgtcagtgccgattgttagagttgatcaaagattatgatgtgtgtatagattatcatcctggtaaagctaatgtcgttgccgatgcgttaagccggaaaaattattgcaatgcaacatgcttagaagaagtaagtactcaactgatacaagacctagaacgtctgaatttgggaattgtagaacatggttttgttgccgctttggaagcacagccgacactcgttgcgcatgcaaaatatccagagatagcagagcttaagaaaaatatgcgagtggataaagcccgagattttactgaggatgaacatggaacgatatggatgggtgaaagattgtgtgtgcctgacaacaaagagttgaaggagttgactcttagtgaagctcaccagatccaatattcaattcatccgggaagcacaaagatgtaccaatatttcaaggagaagttttggtcggtcagtatgaaaagagagatagcagaattcgtagcactccgtgacgtatgtcagcgagtaaaagcagaacactagagaccagcaggtttgcagtctattcagattccagaatggaagtgggaagaaattggtatggatttataaccggattgccaaggacatcatcaggtcatgattctatttgggtaatagtggatcgtctcatgaaagtggcacattttcttccggttcatacaacttatataggaaagaggttagcagagttgtatctttcgaggattgtctgtttgcatggtgtgccgaagaagatcgtgtctgatagaggaagtcagtttacgtcaaagttttggcataagctgcaagaggaacttggaacccgtttgaactttagcacagcatatcatctgcagaccgatggtcagacagagcaagtaaatcagattttggaggatatgttgagagtttgcgcccttgattttggtggatcttgggataagaatctactgtatgctgagttttcatacaacaacagttatcaagctagtttgtacatggcaccgtttgaagcactttaaggtcgaaagtgtcgtatgcctctgttttgggatcaaactagagaacgtcagttgtttggtacagaagtgttgagttaggccgaagtgaaagtaagagcaatcagggagagattgacgattgcccaatcccgtcagaaaagcaatgccgataatcatcggagagagctcagtttcgaggttgttgatcaagtgtaccttacagttatgtcgctcagaggagtgcaccgttttcagaccaagggaaaatggtgcaacgttacatcgggtcataccgaattcttgaacgtagaggtgaagtggcatatcagtttgaaattccacctaacatggccagcattcacgatgtattccaggtatctcagttgaagaaatgcctaagtgtgcttgaggaaccagcaagtccagataatgttgagattcaggaggatttgacttatgtggagaagcctacatgtattttggagaccagtgagaggagaaccagaaataaagtgatcaggttttgcagactatagtggagccatcattcgtaagatgaagcaacttgggaaagagaagatgagttgaaagccacccatccccatctcttcaccagttcttccgaatctcgaggacaagattctgtttaagggggataggtttgtcacacctggagttttcccttcccttaggttccaagtcactaataaatgatctatagaaattgctttggttaaccaggagaaaaccctaattaacaatatatttaataatcagaattgtcaggcagtgttgctaagtttaaaagtgtcaagatcaccttaataataattcttccttgtgcctttggtcgtgaattgtgcctaattcactcccctctctgttcgtagtttcgttttgcatggcgaaccgtgtctgtttttgtttgcgggatcgtttccattctcttcctaaaacggccttaaaaaatgagcgagaccacatcatatatttaattcgaagctgccgcaccgaattgatttttcctatttgggaaagtcctaatccattcttcctttcttttatttcctccccatctccccctctcctagctcggccgccgcctccctccctccattgtcgcgcgcgcgccactgcaccccacccactcctgtctaactccctccccctcctatccaactccctccccctctcccaatcctacttccactaagattcctcctttccaatctaatccttgtgtattagattagggagagagtagagtagaagaagtgggaggagttccggagttgtcggtaatcctcttcttattctttctgctctgattattactctgattttaattgaaatatcttttgagtaatttagttttgctcggttagaattttttcttggttagttcctattcagagtgcgggatcattgttcaccataattaactaaactatagtgattgctttagtgagttataaacgcggtgtctaggtagttgatttaaggtgtttgctccacatcccacattaggtgtgaggtgggtgtagaggtggtgataaccctcaatatcactgaagtcctccctgtccgggtgcgcagtagagcgatatctgggagcagcgagctggccagtgcccgaagtacctccttaggactgaagttaagctttccgtagacactgttcttcaccagtgaaacctctctatcctttgcctatccatagcttcgtgtccttggatgaacctgaaccggagtaagcacacacgttccctatggaaattgatacctgagaatactcctcggtgaagtgctacatcggtatattccgtgcgcttgcggatttatctgtgatcgtaagaaataccagcaagcatttctggcgccgttgctggggaacgattgttgtctatctccgaaccttgttcatcctcgtatcctttttatttttcttacttctacctttacccctgctatccccgagaagtattccagtaaaccttctcaaccgatggagccgcaatctattttccaattatctgctcctcagggcgaattttacgagccacctccttcatcggagcctattttaacacctggcaatgaaattcgtctcgaattcatccgtatggttagggagaaatctttctatggtttaggccaggaaaaccgctacatcatctgcaggaattcgaggcatgaagcaagagactgttcggtggaaattatttccattctcacttcatgggagagcgaaacaatggtacatatttaccgtcgggtgtgcaaacagtgactgggagaaattgcgagacaggttatgcctcccatttttccctgtaacccgtattactactcttcgtgtagaaattctgagttttcagcagataaatagagaatcgatttgtgcagcctagtccagattcactaatttagtatagtctggcccaaccctttctatacctgattacgtgctattgcaacatttccatatgggtttagatagggagtctgcattctaccttgacataactgttggagggtcattcatgcacaaaactcccgcgaaggcaaggaaattctcgatcgcatatcggaaaatacctcctttgccgggtagtgtgttgagccccgtccagaggcatttgtgtcaggaaggaaggaaccttcttttgccgaacctgaatctaagcccgcaatatcataaagtctgactaaagagtcctccttggagccatctccggattccaaagaaatcaagctccaggttgcactcctaaattcagggatgatcctcatagcgattatgacaaaaccttgataggcatccccctgatagattcatgtgtcccctgaatctattctagaacaggatgatctttgtttcattgaaaaagaagattctggcgagacttttgaattacactccatagaaccaccatcacaacctccaatcgagcgaaagccttgtccctttggccctcaagatgttgttctcgacagttgtcaagaaacaaccccgttctttcaatggagaactttcaggccaaggacaagtttgagacatcaactctagaggatgcgaactccacaaatgagcatgaaagcctctctttcaaagttccccaagatacatgctctcataaggaatccccagagtactgtccaattagtaccacttcattgtacaaggaccacaaccaccttacgaccctcatttctaacatgttttgaagtgtggttgtggatgcttttaactatcataaatactgcaaatctcgtatttgtattcacactaatcttgcagcatgatgtctcaatggttgagcttgtgaccacaaacaaaacactaccgggagacaccccggattatcttagtaagttttctttccaataaaagcaagaaccatttcaggtgaagattaagaacgagagacgtacgatgcctaagaacatgggagctacatcaactgttcatgtgttggaacacactttatgaagatcccagtctcacatacttggtttttgacgtctcatgacacaaaagtccaagtgtgaggcagggaggtcgacaagctcttcctggcgggtttcgtcaacctaggccatcttggtttaaagctggtgttagtcttaccttgctgaaaaaagtgtggaagaaaaaaaaaagaaagaaaagagagacaaaagaaaagaagaaaaaaaagaatgggagaagaggaagagagcaagagggctgacgatctagatcaaagaccgcattatgtgcgagtcttttctggctatacacctcgccagtagctattattcttcttggctgcacccagcccctctcttgagctcatgtgccgccttggttagccttcatccactcctagttgtgcacaagttctcgctcccgcagcacctactcgcacacaagcaagaggagacgccctcttcttttctaggtgtttgctactccactccagttggaacttgcatatttgcccaaaaagagatgcaccctacgtctctacagcattctaccaatggaacacgccttcaaggcataaggttcatgcacccgagttgtgtgcataaccgaaccactcgcctgagttggtgtggtcaaagtgccaactgatgagggagttaggtcctaatcttccgataggtattgataaacaatcgatttgggcggagtcgcgacacaactcgatctggcttctgaacgaatacgctactaagccccgcaatcgcagcaccacgtctcctctggttatcaaccgtgcctaaacctggttgacctcgccgagaaggctaatccctgcatgcgaatagaagaacaaaagcaagaacaagatagattgcaacacaattgcatatgaattattaagcactcgaatttggggttccacaaaccgatctagcagcgaaactgttcttaacaaaataatctaagcaaaacccaactctaaacgacgacggctactgattaattatgattagggacgtcctagggttgccctagggcgcacacccccttgggagcccacgacacaattacaaggcccaaaaccgaaatcagatacagattggatgaggtacatggcttgttttgcagattcccggcagcccggtaggaattttgacgtgggaccaaaaccatctgaaattagactccataagctttccaacaagtactcatgggccccaaaattccttcttgatcagtggctaggtccatttgaagttggtgctatcaggaggcctgaatccgaacccaaaacgtgtggaactttatttcttgtcttctatggaccaaaagtgacgtggtgagatgaaagaagactaggagaaggtcttggtttggtccccaatcaacttcttcaatcatccatgcattccttatgctcggtctcttttctttcgcccaagcaactacctctgcaaacgaaaacacacaaaactcattgtgtagcaacgtttgttcaaatatataacaagtaaatctaatgtagaacatatgcacctttggttgactaatacataaggtagtcatggttatatgcgagctagttgtgtcctcatcagccttcccttgccacaatccgcatcaagactgatgggagatcgacaattacatgcgaccatagcaccgctccagagaattcaacatacacatcgtgctggcggtaagtacacttaggtatacaaaaggtagcgaaagattcaccacatcttttactcatacttatctttatttgaatgaggcttgagcatacatgggttatgtttcttgtgtctatttgcatatgctctggtttgggtgtttgcgcaagacatctataggtttagatagtctgctttaatcaaattagacatggagtcaaatttgcttaatgaactttcagatgcatatcttttgtggactaaccccctgcaggaaagttttcaaattcatgggtgagtcctcaagttcaattcacactagaggtaagtcagggttcgggaaacaaatcaataaattgcaaacatgcaaagagagtaacacatcacctttcaaggtgcaaagtaagtatactgtcaattgctcctttgttatgatcgtgcaattttatctgtaagtcctgtatgagtttttgcttaatgaaaatttggtgaacaataaaacattaaaaaaaatgttttaaagaataaaagaaatgtctctcgaagaaaaaaaatgaagacaaaataaaattatggcaaatttgtgggatccatgcttcctaagttttgaatccaattcctttttagcgtagatgttaacaattaatcttgaggctatgaaaaaatctttccaattctttgtagtccctctagtatttgttgtccactaaccttttgcagggaataaagtgacaaccaaggagcggtgtacaataactccaacaccaatcccacgctccttggtatcatagaaagctgtgaagcttgttgcacagggaaccaagtagaacaaatgcaaaacttcgttgcattcaattcagttctaagtttggtaagatccgtctggtaagtatctgaaacaccttgtgcatccgcgcctcatatctccaccctgctaagttacccataacctccattgttgccatgaaaaaatatgaaaataaataaaaaaaaaatttaggcacttcatgtgccttgagttacttgaataaaatttggctcaccggtatttcaccccggtggacaacatgatgaacattgtcccacggacacgcacaaaactcagcagccagaaccatgtcctagctgggttggccgaaccaagtgttctctcgccccttgcctagcccggtgctgtcatccttcaccgtgtagtcaggtttgtaggtgtccttccttatcctcctgtcgaaacaagaattcggcaacaataaaatggggtagcgcacgagacctaaaagtggatggatgtggagacaaagatttaaacaggttcaggccctctcgatgagaggtaataccctactcctatttgggaatttgaatccgccaggtgtagtattgatctgatgatcatatgtgaatatgcccccctagaggacctcctgtccaccttatatagcatggggggcaagattacaagatagaaaccttaaccaatgcagtatcggtttgctaaatctactttacaaaattagcaaaccaggactttaggccattccataatatacaaggaaacgtaataccgtaatacccatgtcatgatccgttacatattccatagatacaagttatcccctataattagtcggataaccatatcgtgtgggtatggggtacccataatctccacacctcccatgattgtgagttaaactttggtagaaaattgaacacaatttagtttggctccaaatgaaaattgaagcattaacactcaacagatagaattttccaatgatttatcatgtatactttttattctttgctaacacttgttagttgtgaacaaccatctatcatagggaaccttgctaatataagtaattgatatatgtgatatggttatgacaatagaaattcatgtccaactgtcatgatacttgggatttattttgtgaaaatcaaaaattcttttcgagcaatactcctcagtgactatattattacctaccaaggccatatatgattctcattacaaaatcctgatatatgtttaggctacatggcattacattgagctttgtcaaattcttgtgacccgtgtgagatgcttttcatactttcatgatcaagatcacgtacactccacatacacacacttatgctaaacttctacactgcaagctagcatctctcttccattatttattttatctattatccacaaaataaaaactccatgtcatttatgccttttcctccaaaattctttcaaaagaaaaaaagatagagagaggcatggctatgcaaaagaaaaagaaataaagccttgctcatacaagtatggagcagtgaaaacaaaaagaaagagaaaaaaaacttgctcatacaaagtatgtggcatgatgaaaaaaaaaagaagaaaaaagatagccatgcactctctcaaatttccaaagagagaaaattggaggaggatgtatacgaaaggagttgttgtcttttattttcctttttccatccacagaatttgccatacacgtacacatatcacacacatgcacattcttgatcagagagtatgacttgctatctccttgggtccggtcttttggctttgcaatatgtgatgcaggtatgccccaattgatccctaccaagctccacctatctagccttttagaatagagacattttgacaaacatgccttggtgaagatccacaaatcaaaccacatgagtgatttgagagaaagtccattgaggagtatagctactttgtgaaaatatatgaaaaccccaagagattgacaggaggaacatgaaggacttgagtcatgaccgttccatttatcaattacccaagatggtaagttagatactcaaagttcacaggtgcagatatggctaagaataatttgtgtacttgtattatattttgggaaattttattccatattaatccttaacctttactcgggacgagtaaagagctaagtgtgtgggtttgttgacggctgttaaatacaaaatttaagccatcaatatctgcataaaaccataaatataaacatccaacatagttgtagggtttatttctaacaatttccacgagtgttcgtgtatattcgtatgcaagtgacaaactacctaagttgagaagaaatatacctgaaggaggaggagaatcaaaagcgtatatgaacatatggagttttggacccagaaacccaattaaacacctccaaatgggccttccatccataccaatagaatgaggggcccaaaatgaatgtccacgccgaaaatcggcgttaatggagtcggctagggttcggccgaaccctgacagaggctgctggcctaggcccaagttcagttcggtagtgctccacttccatttgacggttatggcgttaataccggtagaaaccgtcatcagaatgggacacttggcaacacatgagagaagatgctctttgaatgcttggagcatctccacactcccaaggcacttctctacctataaatacccctctcatcctcacttgtaaacacacacttgaagcatgagctgaattataagaggatctattgtactttattttatacaagattagggagagagttgagtagaagatttcggaggagctccggagttgtcggtaatcctcctcttattctttctgctctgtttattactctgattataattgaaatatcttttgaataatttagttttgctctttaagaattatttattggttagttcctattcagagtgtgggatcatcgttcactataatcaactaaactatagtgattgctttagtgagttataaacactagagtagttattaactgcgtagatgcggtgtctaggtagttgatttccgatgtttgctccccatcccacagtaggtgtgaggtgggtgtagaggtggtgatagccctcaatatcactaagtcctccctgtccgggtgtgcagtacagcgatatctgggagcagtgagctggccagtgcccgaagtacctcattaggattgaagttaagctttccgtagacattgttcttcaccggtgaaacctctctatcctttgcctatccatagcttcgtgtctttggatgaacctgaaccggagttagcacacacgttccctgtggaaatcgatacctaagaatactcccgggtgaagtgctatattggtatattccgtgcgcttgcgggtttatttatgatcgtcagaaataccaacacctaagtgcaaccacaaattcctaccggcctatcgtttgccgtaccgaggctttaccctaaatcgtgtctagcctaccgatttagccgcagccattgttgagtcactcgctcattagtttgaacaaggtgtcgccccgtgtttcgttcgttcatccatgttgagtcgttccttagtttagagccattcagagccgccggtttcgttcgccggtttcggttgatcatttggatggtcccgtgtcacgtagatttgactcgttgagtcggtatctcgtaaggttcgctcaccaatgttaatctatcctttgatcatatttccttttgggcaataatctatgtcaaatgattaaggtttttcggttattagtaataaaagagttcaccttgtaaaattcatatctaattcatccgagctccattttaacccattcaaattgcagtaaattcgttaaacgtcaagaatccattaaaattggtttcttttgctgtttcagtagcttttaacttgtattcattgtgtgccttgtttgtcgtttagactccagcagttccgtcgctccagtttattttaaagtggtcgctgaggttccgtcagctcaagagcaaggcaagtcatatggatatcattgatcatattgagcgtacttgcaaaatccctgcttttctcttaaaattgcattgttttataatgtcatgtgggatggaatttaccatactcagcccttttgaataccctgattcatcggtagcctgggatattaatttgactagatgattggtttaggaatgcttagccatgctaagatcaactagctcacaatgggattcactatattttagtccttaatttttatgatgatgttataccaccttggtatataattaattaattaaaatatgctataatggtgggtcgtgggcacatgcatgatttgattggtggttgtgcccatgacaattaacgaccggttctcaggaatcactggaagatatactcgtactaaccacatgccagatgcgctccaggctaaatcttaagtatatcttttctagctaacacaccgttggcaagggtgggcgtgattataacatatccaaattttagaccttaaaagtttccagtcaaaatagttggaagctaacttttccatttttgagagtccaaatataacttttgtaaacatttacatgcatttaggaaagggaaacacatataagacataagtcttgcgaattatctaaaataattcgtgcaagataaaatcgtgggaaaattcatgtaggctctacttaacatatacaactcactgtaattttggtataatttcataactaaattttatacctcgaataaatcagtcaaaccactcaaataatagactaattataattcctaatcagctaaaaccatactttgtctaaaagagcatttagctgcatggaagcgtatagggaaaataatttattcaaatactaggttaattataataaataaatatattttttttccagaatttatcttctatttttaggtctcctaaaaatccaaactagtttccaaagagcccctcttctcctaatttctgtgagtaatctatccataatttttaagtgcaaccaaataaaatggaatctaggtataatcatctacctccagtaaaatcaacactagttaatgtggtccacacattaagttatcacacattaagttacgaagctacaaagttagaggaggaaaataattccggaaattcgtccaaaaaccaaactcacccatgtttctacccacacctctctcttccacctagtttaccacgacctgggcccgcttggcagccacttgggcttgccctctccccgtccaactcctttaaccgaccagcaggcgtgagagagggaggagaggcgttctgggcgtggctgacacgtgtacacgacgtgtcgccatcctcaaaacgccgagctcgctttcaactcttcctagctgcatcgcctcctctccattaccacttctgtgtagaccaaatcgagagagagggatcgcctcgcctccgctgccctcatccttgccatcggccatgaagacgacggccgtcgccgtcgacattgtgccgcggtcgtcgcctttccacttgcgttccattatcacctctccaagctgatttcattcctctaagtttcatcccatttggtgccgcggatcgtcgggaacgtggacctcgccatcgttgctccggagcgaacaccgagtgccagccgtcgggttctcgtcgtcattccaaccgctgtagaccaagccaagccgagccgtcgcgccaacatcttctccttgaagtcctcctcaaaacccctcaaaaaatcccaggcaatggcgcaacaagtgcggagatcggcccaccgtcttcttcacctccggtcgccgtcgccattgtcgattccgcctcctccagtgagccattattcgattactcgtgcacacaccatctctctggcctcaataacctcatggacatacatgcatgattgttcttggagccgattgagccgtcgccgttcaacctggaggttcttgccgccgccgagtcgttctgctcgtggtcatcgctatctggacctcgccaagtttctttggacgctcggtaagcatcctaggatcccatagaggcacatgcatgtagataaacatttagatcaatgccctagctccacatgcaccgtcacccgagaaccaccgccgctcgcaccgccgtcgccattaatttcgatgaccaatgcttgcaagaataccacctatagcctcaccttgaacccctttacattttctccttaggttgcacaccgagatctgccgccgtttgccgccagcgagctcgagaatgagctcggccatggctagctctgtgtcagctcaatctaaggacctcgattgagaagaatcaaaactctaggtactactttgtaaaacctacctcacacacagaacagtcacaggactgcgggttgatttcctgaaacactaagggcctttctgcatattggcttgagactgacctgtggacccaatctatttaaattctggaaaaatctaaatgaaatgcctaaagctttatattttcatcagaaaaacatgtaaacttgtaaaatcgttaacaaattgaaaacaactcgttttagagtaatacaaattactgttaactcatcgaatcatgaaattagtgttatttcataaaaacttgcactcacagtacaaatgtagcctctaaatttggtctaagataaatcatacataaagcatatacaaacttataaaatgcaaacaaaattcatttcaactcattttagagaaaacttagtttctacatatccaccaacatgttccctaaaaacaaagtaaaataaaacatatacatactttacatcaaatgcctctaaaactattatctttaaaataactagttttgcataagctgaaatttagaagtttatataaaattcatcttagatcctttttgagtaaactcaagttctatagaattacagagttgtgcacttcaatgttataaaataaaaagacatacttacagtataataagaacccctaagcatttatgtaaggaataagcaacatggagcataccttaaattgtaaaatttgtagaaaattcatctttagtctaaatgaagtgaaccaaatttctgtagaaccagcaagtaatatacttcaacctagtagagtgaattatggcaccctctgtacagaccataactctaaaccttaatttggttgtacagaccataactctaaaccttaatttggaagaataggtactaaacgcataatagtggttaaacaatacatatgaataagtatatatatgcatggtagctccaaataaatcaaaataaaacttgttaggaccagtggagccatagttccatccccatctaccaaaacttagatgaacttagctcatgcaacaatcttttggttgataagttaagtaactaacataaaacatccgtatttataaaatgtgtagtaaaataatataaactctaaaattatgaactaagattagattagttaactaaaatactcattttatacaacactagcaagttagagcaagttctggatctaaatctccaaagccatgtgcacataaagactatatgcctagaacacactaaaacttgtaaaatacataaagaattcatattaactctaaattatgaaaccaaatgtgttagtcttagaaaacacatatcttcacctcagcaaacataaacttaataagaatcaccttacaacagcatttcacaatagtacctaaataaatactaccctataccgagcaaacttctaaaattcataactctcaaataaaaagagataaaatagaaattctttcacctaaattcatattataccagtacctatccattgtgcacaaatcaagcattttagagcattttggaattttcgcatatttcggtgtttaattgcataatgtgtactttgtatagatgattgcttaaacggtgaagaagtgaattaggtgctgacatttttcagttgcaaggcaagtcccagctccctctctttgatcactttgaacctatgttttagaggttattgaaaatgtttgcaaatctttcatgtcgattgtacactaataaattaaaattttgttaaactcgttagacaaactcctattatttgcattatcaccttaaccccacatatatctatatccctcattcataaccttaggagcaatatgactataccactttatatatgagttttggtgacactaggttactataatgcttagccatgcttagaatggtcttccttgtcattatgggctcattacaaacatgaaaattgatttttaaataatctggacagaactttaatacttattatttcgataaataaaatggtggaaaacatggattttaggtttgggcctcaagcggtgcatatatggtgattagatgtgtaccgatagggggagagtgtgcgcccaaaccgacctaaggacttcactcaatgtcagttcatttcgtatacagtacaaccacatgtgctagtatgggatagcccaagcttagtaaattatttatggtttagccttacattctggtaggccggtgtgtatgagtttgaataatttagaggagcttcatatttaccccgaagtggtagtttaggtgactaagcgtgtccaatacaacggtattgtgccacgtggagggttcccgttgtgtccgccaccatggcattaagtttaaggcgtgggcccgccacttaacggttctaggtcatatttccagtatgactaggatggaggaacacgtatcgtgctggtgtaaggctaaatcatgaattttggaaaagctttgatgcgggtaataaatcgggtatttatttatcgcgtgccatgctcttgcatgattattatttcgcatcatgtgggtaaagtgtagaaactctgcagagttaaaactaatcgattagccgtgctcgcggtcatgagcggcgtgtggatatgtattgagtatagacttgtgtttattcttctaaattctgaaatttaacttcaaaatgtgatgagatttgtgaatgatctccttgctaccatggatggcaatgaggtgtatatttatacatgattaatgactactttgatgcccaatatgtcaagtacttgcttgctgaaatttatttgaaagcaaaactgatttggaaatgttttatacaaataaaacttgctttatgctaaaaagaaccatatcatgccttctttgattatatgccttgcaagtagagtgttaggcaagtcctagaaataatgtactgactcttgctgttgaattaaccttttgtttgcaggtttagacttagtctttgagtgatgcaggtaatcgactgcttcttctagggtaaaccgctagtcggtgcacttgtggattgggtagacaagcttccgttgttctattatttatttggccggtcggccaatgtaactaaagtagatgtagtttataatcactttcatcttaattgtgtttgctatgtatatctatgattgagatgaaagtgtgagtctagtgcacatcctgggagctagattcacatgagtatgagttaagaatatttgagatgttgtagatctttagccatttttgtcaagtctcctgaatgtgtaacacatctggtcgctgccttcgagtggtttgacgagcacatctcaggcaaaagttgactggcaggctaaaggcccagcaatgtctccaatattcctctcttgaggcgtcggatatttcattgtacttgtttgatgattttagttattcatttcatctctcaattataatggaaggtccggagagcctacgacagtgatggagtacagatggacctggattttggtctatgctccttccggatttaccttggcacgagcagggactgcacattgcctgtatagggatgggggtgaaaccggaggtgggtgtgttggttaggggaggctatatggagggtttgtcatgatttccccctttgtagtatctcggtggtacttcggggcatggtaacatgtgtggaatcgtgtcttgtgagtaaagttgtacactctaatcagagtaaaactatttgaatagccgtgcctgcggttattgggcggtcaaccagctcaccgtgactagtctcaccttaataatttgacctaatgaactggtgtagttcaggtggtttgggttggacctatcataacatggttttagcgttggatagtgatgatgttaatactacttaattatctactattttactgctttcaacttatgatttataaatgctgcttcttacttcaaatatcctatcagccattcctttgaatatccttgcatgataccttccccttggtatgagttgttgagtacggtggtggtactcagccttgctttatttttcccaatcccagaggcagagaatttgtcggatggtgagttctatgaagattaggcttgtgccagacgtcgaggttttgcctgtggattatggtggaagcttccctttgctgagaagaataagtttagatggtctttagtttttttgctgcttttctgagtttttttatatttttgtaagacgtggaactgtatcaaattatcatctgtgtactctgcttgatgcctggatagaggttaaatgcacagatagccggtgattcgggttgtctaatctctaggcgtgacacatacactccattccaccatataccacatttgtcatccacggaataaatactctagaagaagaacaagactaaatttgctgcaaattttcttttgattaaacttggtctgccctcaggggtcgtgtacaaaggcatatatagccattacatgtgttagaaactaactacgaatcaaatacaacacaatatagaaacctctctgcagcaccgtcaatttgatttggctcttgaggtgaaaccagaaggaatttgtgtcctaggccctatccaccaagtgtgtcatgaagttagcttttcaacaagtgctcacacgtccaaaacggactccggacgagacagaaacgggcgttttagtcctggtatatccaggctggcccaaaccgagtccgaactgaatcttttcttccttgtctagaaactccttgctttggaaggcttcaatccatggagaaattatagatggactccttcccaacccaagatgggccataggatagtataactccatccaaacatgccgttcaaagccgacgttcatcaccattgttgttacttgcgcgttgcccgttctacccgcacatgatgtcttcaacttgagattgccgttggtagaaagctcggaatgacatgccgtttgatccgatggaaagtggacttgataacctttcctagtatataagccattcatgttgaaagccttctcatcaatgcagaattctccatgaacttcatgaacagaatagcaattgatcttcctcatgtacgccgctacaacggtcacctccgactggacccacatgttgtttatgccagccaagggttccaatctctcaagtgcgaaatattatgtagcatcaaattctcatatatttcacacatagacttagagagaaatgagctcaccttttgttctgatctgtaagtaaagaacaatgtactattgataggtagatctggatcaattcttcttcatatgctctcgatactttagttcatctaagtattgtctttactttatgtttgtattggtacagtcatatagttagcctaccagagaggtgcaatggtgtgggtttaatgtccgattactcggttgctctatgtcatctcgagggatgtagagtagtatttaataatgtagacagggtgtctagattactaagtatcattatctgggtttatatgctacgagtcagtaaaggtgggctgctaattgtgacagctcagtacgggtattcctccacgatagtatctaatcctaagaaactttcctagggagggtactcctccgtatttagcctaggttggacggccatggtaggttgtcgtaagaaactcggcaacccggggtagtctctcgaagcaccaggagggcactgttagggggtattggctatatggttgtatactagtagatgtagactaaagttgagtgtatattagaattataggaattgattgttttttctatttcttcttccacttagttcagaaatgattaaagaagaaatatgagtgctttgcttcgtgtcactctacccatataaatattttaacccatgcttagactttgattatgtaagtggcatgtatatatattattagcatagttctctcttacaatcttcccttgcgattaaataaatacgataccttagaatactcccgggtgaaatgctacaatggtaaatccgtgcgcttgcggattctttctgtaaaccatatatataccaggaccatttctagcgccattgctgggaattcatatttctagtaatatcgttaagaaataccaacaacaggctggccggactagagggacaggatgcaacattccttggaacattgggatggccaagtacaacgcacaacacaggaagcgcaaacaaactaaggaacaaagagagggtcgtcttagagaatagattgtaagggaggttaaacaaactaaggaacagacagaagatcatcttagagaacatattgtaagggaggtcatgggtgaatgttggtatttcttacgaccaaagataaatccacaagcgcacggaataccgctgtagcacttcaccttcgggtgaccccaaaaggatatcaaactcagggaatgtgtgtaatctacctagggctaagacgatccaaggacaacaactataggtaggcaggctagagaggactttctctgtgttttaattatctaagctaagcaaaggtaatttcctatctgttgctacgggcaccgacccctgctggtctgtcagtgtggttccggctatagctctatgatgtacccgaacatggaggattactaggacggaattcagggctgtcaccacctgccgtctacctctgacaaatccgtgggatacacaacaaacaaaggtaatctctaacctagacaccaggcctaagttattaattacttctctaatacttgcgcaggaaattccttctctatccggagtcctagtactagagcacttagtataaatactaaataatgaacctgcaaagatggaaatatatcttactcagactaagtaattaaataacataagaaaggaacacgaatgcttacttaatagaagaagttctctgaacctagagcaaagtgtaccaacagctccagtactcctccagaattcctactacgaagctacactcgtcgaggcagaagtcggatgagcgccaaacttccgggcactcctctagagcttcccctcactttctacctatttctaatgtacaaaagatacaatagagcctcttgtaattcagctcaaagttgtgtgtgcttgaagtgagatgaagacctccttatataggctccaaatgacagttaggggtatgggaaatgaccaaaacaccctgcaactgcctaaggggagaaatccgagacgtccaggtgaaagtagttggcgggaagcaccaggattggttcggccgaacccaaaaactctcctcctggcctctcctttggtcgggaggttggttaatgggcccccaacaacctgggcgatgttttggtccaattctaaatagtttttattgacttattgggcctctaatccgtgtaaacgcatcctgaatgtgcggaggtgcattttgtcacatgacggatgtgttttctcctcaaattacctgcatacacatatttcaccaacactagtggaaatgattagtaataacacctaccactaagttggataccgtgttttatttcattatttgcaggtattgatggtcagatattatgatttaaggaccgtcaacaacacccccacacttaacctttgctcatcccgagtgaaggctatggactctacaacagagttatgacttcctaactaatcatcatgcaaacaaattattcaaagccatacctgtacttgtcgatctttatagtgtctaccatgcgatcttgagcaattgagaaatggaacaatcttgacattaagtcaccctaatttttcatgaagaacaacttgtggtttttgaggtaacacaaaattataactatgctttgctcctccattgattctttcgatcgctcaaagtgtatgattcctcacaaggcatatgattgtgccttttcttttcctaccatctaataaggcttttgtggagctcagggtatggaaaagagtagagcattacttgcatcacatatattgcaaagtcaaataatggatccacggaaatacaaaacatactttctggtcaagaatgtgcatgtgtatgtgtatgtgtatggtaaatttgtgggtggaaaaaaaatgaatcaataactccttttgtatacatcctcttccatttatttctctttgaaaatttcaagagtgcatggctatctcttttttttctttttcttttttttctcatcatcatgctcaatacttgtatgagcattttttttctttctttttgcatagccatgcctctctctcaacttttttttgaaagaacttgtatgagtatttatttgatggatgaaatgaatgacaaatgaggaatgctaacttgcagtgtagaagtcaagaataggtgggtgtatgtggaatgtgtgtgatcttgaccatgaaagtatgaaaagcatttcactagggtcacaaaacttgacaacgctcaatgtaatgacaagcagcgtatgtagcaagctaattattaatgatcaacctatggctcaagtgggaataaaaatatcaatgagcagtttagcatcattatacaagttttttttcattttataaaattcccaagtgtgcaacatgaagagcagaatttctatcatcagactatatctcattcatcaattacttagatagcatggggtccctattggataagtcaccacaagcaacaagtaatgagcaaagaataataggcatgcatgctattttcagggagaccatgaactctaattgtaccatccctagtttgagtttaattatcttcgatattttagaattgatagtcaaattaaactcaagatagaatggatgtccaaaggaaaaattgtgcaaacatgcgctctgtataaaatagaaaatgatccttggtagagatagtttagccgaactggagatttggctgacccctcactaggtctaactgcatcaatttcccgtgtgtggtttgtcatagctcgtctggggtgatcttgcttttgttacggcgttgatgtgcaagatcacccccacacttgtcttcgtatatgagaggctttattggacacaaaaaagaaaaagaaagacaagagtgaagcaaaaagggctcacatggttggaagaccaaggagccaactttatttttttttatttttttatttttatcatgaaagctagacctaagataactagagggaggcctaaggactcatggcattgaaaactaacggatcaaggggggacctaaagactccgggtagaagctaaaagagacaagattcacaacatccaagtcatgatcaacttctaacggatcaaggaaaacttttaaacaatggccatttaccttaaagatgttaccttcgttgtcacgcagcgtgacggctccatgtgatgaagcatcgacgatgttatatggacccatccatttacttcgaagttttctatgtccgaaaagcttcacccgtgagttgagcagcagcacgttgtcccctaccttgaattccttgtgcttgatccactaatcatgccatcttttggttctttccttgtagatcttggcattgtggtaggccttgtccctccattcctctagctcagagaactgcatcttcctgtgctatccggctcccttcaagtcgatgttccaagtccggatagcccagtgcgccctgtgttccaactctaccggaaggtgacaagtcttcccatagacaagttagtatggtgacatgccgatgggcatcttataagcagtcctatatgccaaaagtgcatcaggtagcttgttcttccatgcctaccccatctcatttacagtcttttgcagaatattcttgatttgtttgttgctcatttctgcttgtccacttgtttggggatgatacggagtggcaattttttgctgagccccaagttcttgcaaacagttttggaaggtcttatcgataaaatgagaccctccgtcacttatcaccatccgcggagttccaaaacgatggaagataatctcatgaaacatccggcgggcgtgcttggcgtctgcggccctgcctctacccacttcgacacctagtcaacggccaccaggatgtacacgcagtcataggactttgggaaagttcccatgaagtcgatgccccatacatcaaatagcttgacttgaaggttgtgtgtcagtggcatcgcatctcgagcagtgatccctccatgcttctggcatctagtgcatcttcgaacgaattactttgtgtcatcatacattgatggccaaaagaatccactctgccagatctttgcatgtgtcctgaatgctccatagtgacctccatatggggcagcatgacacttctcaatgatcatgatgccttcgtctgtcgaaacgcatattcgcagtagaccatctgagcagactctgaaaaggtaaggtgcatcccacaagtgcctgcggctctcgtagatcaacctcttcttattttctaccggtggtacatgacccgtggccatgaagttgacgatggttgcataccacgggtcagagtctatgactttcaaccgcatgtcgtcccgtagatagtcatttatcagtagcttctgcatgttagtgatttgcatacgcgacaaatgatctgcaacataattctctactccctttttatccataatttcaatgtcaaattcttggagtagaagaatccacctaattacccgaggttttgcatcttttttagtaagcaggtattttagtgcagcatgatcagtgtaaacaactaccttagcccccactaaataagacctaaatttctcaatggcaaacactacggctaggagctctttctcagttgtggcataattaagctgagctcccgtcaacgttttactagcatatgtgatagcatggtgttttctatccttagtttgcccaagaacagctcccacagcaaaatcactagcatcacacatgatttcaaacagcagcgaccaatcagagggttggatgattggtgctgagatgagtgattccttaaggattttaaaggatttcatacactcatcatcaaagtcaaccggaacatcattagctagcaaggcagttaggggtctagcgattttggagaaatcctttatgaagcgcctgtagaaccccgcatgacccaagaagctacggacacccatgtcattgacaggaggtggaagttgtcgaattacttcaatttttgctctgtccacctcaactcccctttcggagatttgatgtcccaggactattccttcacgaaccatgaagtggtacttttcccaattaagtaccaagtccttttcttgacatctttgtaagaccttatctaaattctccaaacaatgattgaatgttttaccatagactgaaaaatcgtccatgaagacttccatgatatcctcgatcatgtcagagaaaatagacatcatgcatctttgaaatgacgcgggtgcattgcactacccgaacgacattcttcgatatgcatacgttccgtatgggcacgtgaatgtggttttactttgatcatcgggatagatggggatttggtgataactagaatacccatcaaggaaacaaaagaaggaatggttagccaaccgctcaagcatttcatcaatgaaaggcagcgaaaagtgatccttcttcgtagccttgttgagtttcctatagtcaatgcacattctccatcccgtgacggttcgttgcgggatcaactcgttgttcgagttttcaacgaccgtcatgcctcccttcttaggcactacttggacagggctgacccactcgctatatggtacgggatagataatcccggtatgtaggagtttcaagacttccttttttatgacctctctcatcgcattatttagcctcctctgaggttccctagatggtgtgctagacggttctaagagaatgcgatgagtgcaaagggtcggactgatgccttttaagtcttggagggaatagccaaaagcagcactatgcttttctaaaatggcgataagtcgggccatctccctctcagagagtttgtcacttataatgactagagactccgcatcgctgttcagaaaggcataacttaggcttgacggtaagggctttagctcaattggggctcgtgacggcagatccgtttttggcagatccatcgtttctccagtttcatcctccccttcattgaattcttcgatggattcatcgaaaatagactctagggtctcgaatggagaaatagccatcactccctcaattggctcaggaacaggaagagactccatcaaagaattggttgattgcaacatagggacggaggtggcaattcttcctattttcaggttaaggacaccggtttcgggcacatctaagagtttttctatgggatgccctatgagtatgtcgaaatcatatatttcaaacacatgaaaatctaatatgacctcaacactgttgtgccgtgtgggcactccagagataatccctaaaccttcggtagtagagtttgtggaaattcggaaggttctgacggttggttccaacgatctgtcccctaagcaatcgaatgcaaaggttgcggacataatattggcaccaacagagggattatacagagcacggaccgaattacctccaatgtgacacataatggttgaggaggggcatcggatctgaatcgattcagataagagctctccttctcttaaccatttgttactcatgatgatggtcaacctcttcaccgtctctttaagcatagatttatcaagaggttcattagaattgaccttggtcggtggtctcttctctcaggaataattcaaggtgttctaataatcttcgaaaagatcctcctcgaattggaatgaaatttccggaggatgaatttcttcttcctccggctcctgcgaccgggatgaggattcgacagttgagtcgggttccaactccacgtgcagaggttcctcatgaataatctcgaccttcgggacggcttcgcttcggccgaaagaatcgttctctaagatcaaatctaagagttctcttccttcggcggttgtcttgtgtgcgaacgatcctccggcagaaatattgagattttcggcaaactccttgtctaacccgtaccgaaaatgttgcaacaacacgtggtcgggtaacgacaagtctgggccagattgagttaacagtgagaaactggcctaggctgcaccgagatattccttctcattctgtcgaaaagaaaggatgtctactcaaagattgattacacgggttaatggaaagaaagtaaggcagaaattgcacttaagctcctcccattcacagtggaatttcttgacagatagagtgtaccattgcttagcttcatctctacgagaaaaaggaaacaatttccacttaagagtatcatgtgtcatgccgacgatagataggcacgaacacactagctcaaagtcctgaagatggaggtatggattttcaccgatactaccagagaaggttttctctcgaaccatggctataaagccaagactgatttcgtagccatctaggaagctactcggccagtactccagtactcaccgatactccagtactccttcagaattcctcctaggaagctacactcgtcgaggcagaagtcggatgagcgccaaacttccgggcactccttcagagcttcccctcgctttctacctatttctaatgtacaaaagatacaatagagcctcttgtaattcagctcaaagttgtgtgtgcttgaagtgagatgaagagctccttatataggctccaaatgacggttaggggtatgggaaatgaccaaaacacgctgcaaccgccttaggagagaaattcgagccgtccaggtgaaagcagatgacaggaagcaccaggattggtccgcccgaactggtaggttcggccgaacccaaaaactctcctcccggcctctccttcggtcgggaggttggttaatgggccccaaacaacctgggctatgttttggcccaattctaaatggtttttattgacttattgggcctctaatccgtctaaacgcgtcctgaatgcgcggaggtgcattttgtcacatgacggatgtgttttctcctcaaattacctgcatacatatatttcaccaacactagtggaaatgattagtaataacacctaccactaagttggataccatgtgtttatttcattatatgcaggtattgacggtctgatattatgatttaaggaccgtcaatagtgaacttagccatgaattcaatgaaaaattacacggaattgaggctaggataagggaagagatgctagccaaaaaggaacgaggacaacggacatccagaagaagtgcaagtgagcccctgcagcggcgaagtagttgtttgtcaactgggattccagaatgacatccacctgtctcagtcgaatagtagttctcgttgtagctgatgtgattcgtacaacttaaactaatatttttttctggattgtatgcagggcgtagcccaatgcatcctacaagttagggttacacaaacattctgttgtcatgctgccgagggctaaccatacaaacctactccataaacaagagttcgcggtgcagatttggtggctagacatgtcaaagtacaagttgacatggtgaatgctgattggatgaactggcaacttccaatcccgtggtatcttcatccaatggctaaaagacctcatcatcatcaaggtcactttgaggacaactttagctccagctccacctcgcccagattcttccacaaaagtcccttcacctcctctggccatcgaagctccatttgagagccatggtacggacttcggtgaaatggccaaacttcaccctcctccgcaaaacaccaaggccatttcatctccaccgatggtgcaaagaagggcgcatcatgcaagagatagatcaaaaggaaaaagaaaggcacaagagccgtagttacctcccaaacaactagatctggataaggaggtcaacgttactccaaaaaacaagctccaggtacatttcagcaacaggtgccattggttgcagaccatgagttagccaaaatgggttctgcttgccaagtgctgcatagatactacatggagaaaacaaactccaagagcaagatgagggacacgtccatagtaggttaccacgaccaagaaccatccttggggcaacaaaattattttgcagtggccttctcggatcttttttacctctataagctacgagcagtggacaccggcttgttaaagtgctacacattgtaagtacaaataacaccaaacttacatactattaatacttgtagaatgcttctaattgaccacacatgtgaaccttgaaggatacgttcgaaagaggcacggaggaacaaaaaccaggtgaacagataatgagataatgaggcagaacttcaatctcacttggatgatgtgattaattacttctatgaaagcttaagggcccactaggatgaagacttcatcttattagcacacaatcaacagtgaatagtacactacgttaggaattttaaattttactacacatgtgtggtcttcaacttccagtatattaacgttgcagattccattggataagtgaaaaatggagtagggtatacttccttaactccaaaataagaaaaaaaaatacaactttacatctatgaaggaggactttaatgcggcttgggagaaatatgtcaacaaagggggtcggcaccgagaagatatacccgacctctatcaccatgataactacaaatgcaagaaacaaaccggcgaaacctgtgtatttcatgtatgtcatcagatgaagattctcgctagaaaggtgacctccttggatcctgaggttcatgggtttataaaatcggccattagtatattacataaaattaggtttgcgtatgatatgtactaacttgatgcctctttcagaatgttatttccaacattccagagcacaatttcgccgtatcagagaagaattggctgtcttcatcatacatgaagttatatcttcgaagggcacctaccatactagatgatttatcgtgatcagttaatcagatttgagtgaaaaatatgattaagtcatgactttttatgttggaaaacaattactatttgattatgtttaatttatctatgtacacttgtaaacatttatgttagaagtaatatatttatcacttctttcaaattgcatacttatttcacatgttgcaataaatatgcatggttgtcccttgaagatgcttcacattttggcaaggaaagaaaggtaataaattgttgaatttgaatgtgataataatgtgggttcaatatgtgaatgtgaaatgtatatatttgtatgtgaatgtgaatgtgaaacttgtgaatgtgtgagacttgtgaatttgattgtgaatgcgaaacttgtgtgaatgtgaccgtgaatgtgagcaaggatatgctggattatattgctgggttattgggatatgtagtgggcttggctatcatttgcctgaggcaagccaataaaacaaatttaatttttttgtgaaaaacctcatccctatcgggccgcaaaagcaaaaccgtcaccagaatgtactacattgtcgggttgcactactagcccgtcatggattatcatccgtgataggccctaagacatgccgacaaaggtgggggcaacacctctgtcgggttccatttggagcccatcatggatgattcatccttgacgggctctaaacacctaccatcaatgtgagggcaacgtctttattggagctcaatttgaggctgtcacggatgagtcatccgtgtcgggctggagaacctatccatgaagggttttatttggggcccgacagagacatgcatcattggtgtcggagcatggcccgatacagatgatagtttcacatcactgaccatgaacttttctgacacagatgagggttttgccccgtaacggatgaccggttccgtagtagttactcctcctcacttatggccttgtgttccatggctgcgacctcaaacaccgtgaggattaccaatgcgcaaaaaaaaaacaaatgaatcatgtccctaattttcttaaaaaaaatcagttggtccaaatatttctgttgagcaccagtgaaatatcctaagaactggaatagacataaaaaataaaacacgtgaaacacatcgctctcacgcatgaaacatcgaattttaacggttgaaacatttatattcctcaaaagataatcataggagatcattttttaatgatttatcttcaataaatacaatggtgaaatcagatcttaaataaagatacatagtttagggaaaacatcatttgaggctcgtgtgtttggtctggagccttctccttgttaaatgcgtgcatgcttgcatgcagacttgcagtggacgaaaacgttggttttgcatgggaggcgcgggcgaccaaatgagcttgcatgcaaacttgcagatgggtggtgttggttttgcatggtagacgcggggtccgatttttttgcttgcatccaacgtccagatggaagcattatcgtaaaaaaataataatccagcaaaaaattcgagtcagaagcggaagcgaaattctttccggccaaatttcatcggcgcattggggtggagtttgatctcttgcaagacagatttgctacgaaagtgtgttggttggtggcattgtgctgcgcatggaggttgttcctagaagaaggaaggaagggtgccggtcataggcttggccgccagagacggcggtggcaacggcagggagggcatggcgctgttgcggaggctattctataggaagccaccggatcgactcctcgagatcgccgaccgcgtctatggtaaacccatgcttcttcttcctcctgcaatgttgttgcttttcaaatgctgaggaggatctggggaaacgctgcagcaacatggaagggttaggttgcgtggaattggtggaattgtgtaatgtgtcattgattctagctttggaaatggggctgctttgtacattcactcaattaatagatacggtaatattacttatcaacctagataatacaatttcatggattatataggtttttaatatgttgttgaaaagtctacgaaatgcatatcggttttttctctgaattaattatgtaaataaaacaactacttccttatgtgatagcttcacagatattacatccattcttaaatacaagaacgtctggagttcggcacaagtattaagaaagtatgtagaaataaatagcaaaaaaattatgattggttcacaagggaaagtaggtgctgaaattaattgagaaatgtctctgattggttgagaagaggaagcaggtgtacaagttgctatattttgagatattttttaatgctagaagctattatattttggtaaggagggagtagcttgctaatgtttctttcacaggggaaaagtagcttgctaacattctgcagtgttactaaaatgttagctaagatgccttctagaatccaatttgacttgaagagaaattgattgaaatatttatgcttgcagtattcgactgttgcttctctacagaaaccatggaacaatttgaatacaagaattatctggacaacattgttttgcaacttcgtgagcagtttgtagattcttcattgatggtatttaacttcagagatgaaggaaaaagtctggtttcaggcttgttctccctttacggtatcacagttaaagactatccctgccagtacctaggatgcccattgcttcctttggagatggtcctccacttcctaaggttgagcgagaggtggcttatgctggaagggcagcaaaactttctactcatgcattgtgagaaaggcggttggccggttttggcatttatgcttgcaggtctccttctatatatgaagcagtataatggggaagaaagaactctagtcatggtttataagcaagcgccaaaggaacttcttcagatgttaacaacactaaatccacaaccttcccatcttcggtatctacagtacatatgcaaaatggatgatgagcttgaatggcctatacaaccaattccttttactttggattgtgtaattcttagggaagtacccaattttgatggtgtaggtggttgtaggccaatagttcgtgtatatgggcaggattttctaactgttgataaaagatgcaatgttatgttgccaccatcaaagcctaggaaacacgctaggcgttacaaacaggtaccactaatcgcagtttatctcaattgttgttctatttgttttagttattctttaactgttgtagcaggcagacaatatatcagtgaagttaaatgttggatcctgcgtgcaaggagatgttgtccttgaatgcttgcatattgatgatagcctagaagatgaaaggttgatgtttcgggtgatgttcaatacctattttatccaatctcacattctaccgttgaactttgaaaacattgatgtgtcatgggatgctgaacaacggttcacaaaaaaattcaaggcagaggtaggctataatttttcttgcatacatgtgaaatactattttcaacataataaaatgtaaatgaaagtgcatgcctgaaccaggtactcttttcagagtttgatggtgagtctgatgcatccatagaagttgcatctgactatgatgacgaggtggaagttggctctatcgacgtgttctttgaagcagtagaaattttcagcaatcttgactcacaagaggggcagagggatgctgaaatcctttctataacttccacagagtgttctccacgtgctgaactaatgaaaactgcacccttttcccattttgacatggagattggtcttggtggatctcaaaaaaataaaattgatggcatggttttgtcactagaaaagtcagatgaaaaatgtacatctgctgaaggagatattatacagaacaacataactagagtagtgaggtcaagttcagcaaatacaactgatggagatagagatactatgaattcaagttgttatggaggtaaagtggatggctgcatagtagaaaagaacaattccaacaaggaaatattgacggattccaatgaagactcggggatagaaaatgtgttggtaaaggaggtcattatatcagaaactaatagtctaaaggatatacaaatgatcaaagaggtcataatatctgaggtcacaacttcaaaaccagtaatagaggtagatacaataggaaccgagttaagtgatgtggtccacaattctgaaaccattacacatgcagaggctaacaatgaggaagaagttctggttactctaaaacagaatgaaggggataatctagtcgaagaatgcatttattatggcaatagcataatgatcaaaccagaaaagaataggaagaaagaaaaatctattatcggttccacaattggtgtagtacctgattccacagaggagaatgctagggtgggacttctattatcagtgaaacctcatttggatagcacgggcacttatcatgatttaaattctcccctgcaaaagattgatctacttaatgtttcaaatactaattgtgttgaagagcaaacgaagggaatggaggcttcgatatcaaattcatatggtcagccctctaatctgtcttcactaaacttgcaacctcaaggatctagttttcaagctaatggggatccaacttgtgccaacacaagtacagatgcaaatgaatcaactcaactggaactcaagagaaaatcttttctttctttgtcaacatctagtattttttctccattatcccctaggcgtaatctgcttcgttcaacatctacagatttgtcatttctatctccactacaaacaaaatcgaatcaacactcaattccttgttcaagtggaagagatgattttgcttcatcttacggaccaccaccaaacataccatgtacatcacttcgaacatcaaaagtatcatcgctagtacacccctctctacgaccacttagaactgtttcatctctatctcaatcttcattt

SEQ ID NO: 35239 - DNA, 9185 bp, Oryza sativa
  unsure (1)..(9185): unsure at all n locations
ccaccaccaccaccaccaccaccaccacgtgcatcacagtgtaaaataaagttgtcaattctagacaaggatagtgattcaataccactaatacattcaaagtcttcagattatccacacaatgaactagcaatgtcagtagaacaacaatatccctctcttcgaagacatgaagaatgtgaggtgtcatcaacccaaacagtcattgagttatcttcattgagatattctgaatatacatatcaacatatatccatgaatattgaatataagactccaattctctctccctcggtatctacatcgttgcatgcagattcctcatgtattgctataacaaatggtccttcaagttcaaattatgtcgaggaagtaccaatggaaacaattttgaatcaaccaacattatccattcctttggaagcatgcaaggatgagctattgcattgtaaagaaaatggaggcattccaattccaccacctccacctcctctttgtggtaagtgtgtacaaatttcaacagaaaaattccttgtggggtgtgaaatgtttttgattccatcattgatacctcaatcaccaccctcacccccaccctcaataccattgtcttttccatcagctttaccttcaacctcaacatcatttacagctttacatcaactatcccatataaaaaccgcacctcctcctccaccaccaccacctagaggacttctagaaacttcatgtttatctccaatcacatcctccctaagagaacattcaaaaatattacctccccctcctccacctctcccaaaagaatgtttgccaactccatctccacctcaatcccctgattgtccatcttttcctacaaaatatgcaactacatctcctcttccatcaccaccaccaccacttctacataaagtacatgaatgtgttattccttctcataccaggcatgttgtagtacctgcaccaccaccaccacctccctttggagaacatcattctacttttagtaaagatttaacgacatcaccttgttccttttatgaagatcatgcaaaaaaatatactagaattcctctaccaccaccacccccagaaggtagccacggaattttagctacaacttctactgaattgattgatgctggtcctcaattgccaccattatctcatcttgaatggaaacggtgtccacatcatcctccagaaaggccacattatcttccaggagaagttggaggagctccatcgccaccatcaccacctcctcctcagagagaaaatacatcagtaggaattcaaggtggcattccacctctgccaccacctctgccaccaactctgggagattatggagtggctccacctcctcctagcattggtgcaggggctccaccacctcctcctccacctggaggaatcacaggagttcctcctccacctcctattggagggctaggtgggcatcaagctccaccagcacctcctttacctgaaggaatcggaggagttcctcctccacctcctgttggagggctaggagggcctccagctccaccacctccagctggatttcgaggtggaactccacctcccaatgcacatggaggggttgcaccaccacctccaccccctagaggacatggtggggtaggtggcccccctacccctccgggtgcacctgctcctccaatgcctcctggtgtgcctggtggtcctcctccaccccctggtggaaggggtttgcctgctccacctggtggcagaggtgtagtaggacatggacttactcgttccttggggctgaactcagctgccacagcaagaaggtcaactctaaaaccactacattgggttaaagtaacaagagcaatgcaagggagtttatgggcagaaatacaaaagcaagcagatgctaataggtaccctcttgttttttagctttttgattactagaaaatataacttctctacctctttcaccatagttacaacaaaaaatactgtagtgtaaacccgctgctatttcaatttatttctcgtatcatttttttaataaaattttactaactggtagtatcatgtatgtagccattctgaatttgatgtgaaagaattggagtctctttttgctattgctccaaagacaaaaggtggttcaaaatcagatggagctagcaaatctcttggatcaaaacctgacaaagttcatctggtaacttactctaacacattactatgctaaacagaaaatattcccagtacttttgtttaatctactgctatgataatgaattacttgattccatgcaagtgtaatgcgcacaaaattaataattactttcattttagaagacaagttttctatatagttgcggaaaaacctcattatcatattcacttttgaaaatgtgttgatggctttttgtaccgagattgtatctttagttcatatatttatatttcacggtattcattagcttctctctgacaataaaatctgcccttcattaattactggtatcacttgtgttttctaagagttaccttggtgtctttgaaatctacagattgatttaagacgagccaataacacagagatcatgttaactaagatcaaaatgccactacctgatatgatggtaagcaccctgctatttcttttttgcctttattgatgcacaatagttggacaaaagggcaaggtcattaaatgtctttgttccttgctaatactccttcagtaccatattagttttagctctaacctgaatcaaacttctctaacgacgaccgagtttataggaaaatgcaccagcatctaaaataacaaataaatgcactattaagagctatttcatggtggaattaatggaactaatttgatgttgtagatgttgatgtacttttatataaactatatcgaagttcaagaagtttgactttggacaaaactacataacttactatattggaacgaagggactaatatgactactatagtgattgaatatctatcgtgcgctatattatttccttggcgtagaactgatacaacatccaatatagctcgcttttaaccagttttgcatatgtgggctattattttgttgtttgggaattgcacacatagacctttgcattgtgacaacatccaacatagcttgtttttaaccagatttgcttacaatctgaagattaggtagctgaccaaaataaatcatcaacagagtttatgaaagttttgtttttggtgattgggttcttccactggaaagtagggtgtcagcctgcatttaagtgataaattaagtgggattccctactaacaaatattgagaattttttgggtttccttttgccaagtaggatgtagaagacattttatcgacacaatcaaaatttcatgtgaagctagcttcacatactttagatctagcttcacatactttaccacttgcgagagtgctcggtccagctcaccaaccgtgggtctcataagttacattgggcctacttcaccacaggtccaactaaagccacaacttcagatcctaggtctaaacaaaccaaaaggtggtttgatgggtgagtataacctccacatgttaagccatgatcccccatcatcaattatcaatgtaggactaaacccaacaattgcatcggatatgtaggcttcagctaaactacattactaaatatcatgtgttcctgtgttatctctgcaatgtcaaagttgatcaatggttgcagcaatcaggaaggttagtcatcgtttcactatatcgattaacttctgcaacactaccaatcagtgaaggccaaacactcgaactagtttgagatagtttctttaaaaacagggtagcaactccaaatccacaagtatagtcgcaatgatttatgttgaatattttcaagtcaatctgcatgcacttcaaggatttggatttggtttcgaaatttttatgaaaatagatctacaatggagacacgaatttttacgtggaaaacccttacaggaaaataccacgggtgccgaccgacaatgatcataattgagaagttgattcaaacataaaggaataacaatgggatcgtcgccacttcctatacggcttacaagagtatatataagggataaacggaaagacacacaatagggaaagacgtgatgacctactaggaaactagtctgaatattttgtcggcctaagatttggatcacatatttaacatgttttccatctggttcagctaatgcttataggaatgtttcaatcacattccatcttgatattaattaatacaccatatttagtccattttcctggagctgaattgtataccctgaaaccatttgcattttagaccaaggatcacctccgtttgatgaaactcagttcatgacatttagtagctacttcattcttaagaattattcagatttttagtggacatttactcaaaagttactcccattttttaaatggctaccggtaaggcttaaggtgcttcatccattctatatctactttctctacttgtaacagagtgctgctctagctttggatgattcagttctagacgctgatcaactggaaaatctcataaaattttgcccaacaaaagaggagatggaacttctaaaggttgttttaaaattaaagcttatatttccttgcactccttctgtaatctttaatttttctcttctctgaatatcttgcaaaagtaaagtatttgcactttttcctatcagaactacactggagacaaggaaactcttggaaagtgtgagcaggtaaaccttcatgcatgtttggactcttcttttgttatatattgatttgntttcacttatatttgatcagaactattgaggttataactgacaaattatattttgtacattcctattcatctcctccgtctgcagttttttctagagcttatgaaggtgccgagggttgaatctaagtttaggatatttgctttcaagattcaattgccccaaatttcaatcacaggtcatacactgttgaaattttgagttattatctccgtatttgaaatgtccatagattttcactatcccccttttcatttccctcttagattagggatgttagaaagaatttgctgactgtgtcatccgcttgtgaggaggtaaatatgttttaatacacctcctttggattaataagtattaatgtttatcacgtgagagctcatttcaatatgtcaatcagctcagaggctctgagaagttaaaggtgatcatggagaaaattctgtttctaggaaataaattaaatcagggaacaccaagaggtaatttactgcgtctattgacgagctataaaatctttcaaataaactttcatgcaaatatgtttagcttaaaatcattttgcagttgaaatttcctggataatttctaagctccctcttcattaggactaggagggagaaatgccctgtgacaacttcactgtatatataattacatttatcctttccactattatcaacaaaaataagttgtttctctaggtgcaacaatgtaaaacaattcaggctatagattgaagttgtttgaatgtcaatttaagtactgtatgttcaagatctgtgggtcactaattttagcttccctatacctcgtattcattgaggaagaaaaaatatttaatttttccttatcttgttgcaggccaggctcttggttttcgcttggacagcctattaaaacttacagacactcgtgcaaacaacagtagaatgacactaatgcactttctttgtaaggtatggagatatatagctgtcgtacactagttgttcatataaaatcaagcatgagtatgaaagataatgttgatcccaaaataataaatttgtctatactaattatgtggggcccaaatatcagtggtggtggccaccaccatcaccacaaggaatattcaaaggagtaaagatatattatgctcgtaggactagaaaagaatgtaattgtgatattttgcttttcaccacatttcaccaaaagagtgtcttgtaattacatacaaggcactcttcatgattaatatacctcaatagtgctatgtacattaactcaatagtgctatgtatattaactctaaaacatgtagttctttgataacttcatcactaaatcagtagttttgtgatacaatgctataaatctgtagttctatgaaaaatttggcactaaatctgtaatttcgtcatatacatttttgaatctgtagttttgcgatagtttagttaaaggcagccttagttaaaatatcgctagttttgtgatatttactcaatttgaaaggccaactaactagctaatttctttgtcatgtttaacttgtcatcatactacttattttgctcctctcataaaattctaagtttgcttctataataagctttaattcttattaactcgatggttggtttaagtgtttatcagggccttgcggacaaatcaccacatttactggatttttatgaggaatttgtcaacctagaagctgcttctaaggtgtgtatgtcgatctgacgagagcatccaaaggacttgtgttgataaaaaaaattatacattgtttagaaaatggaagtttgtattgaacccaatcaattacatcacggtgcctctgcataactaagatacacacgaccacactcaacaaacaaaaaatggagaatatcatggatttgtaaggaccatcaatcgaaagaataaatcgtcacccatgaacaactccttaaatatatcctctaaatgcacaaagtattaagagccaccaatcctaatactagatctccacccatatacctgggtaaagaactccttgaccaccttctccaaatgtagacatgccgcaaccaccatatcccgcggatcaggcttctgtaggatagcccatgtacgaagccaatggataagacaatatataacctgtaatagtgaagttatgattttttttaatcaaaatatacattattcctgcatagccaaagcaaccaacaagtagcaaatgctcttaacaggacatgtgcttttaaattattatgaattccagcaaggcagctcccaaacatatgggctacactatgcagtggaggaagtccaaatgctacttggaccaaacagaatgggcaaaatcaaaaaaaaaaagatgtctaattgtctcatcattgtgacaaaaacaaccgttcttattgctttgccagtttccttttgtcaaattatccatcgttaacaccactccacaatgaaaataccaaagaaaaatcataacttttaagggtatctttagtttccaaagatgtttattaatattaagaacattgatgtgaattagagctaggtaatgagactgcaccgagaactccccatttgaggttaagttctaacgaaactcgtcttgctcctgagttaattgaaaatcagtgatacatgataataaatacaagtttaaggaccacccgtgcattttactcataataaattattccaagccacctattttgatattataaggtcctttctccatgaaagggaatgattggtttctaagaattgtgcaacagtaggcggcttatgcttaaatatattttgaaggcaaggatactgttcttttaaggttgaattgcccaaccatttgtctctcataacctgatttgggagctatataaaggatccaaaccagagaaaatcccatttctccttcatgggggtggaccaaaagtataagtccctggccttccactaagcttgagaaagaggtttatcacctacatacttattacatatcaactgttgtcaaaccccttccgtggagagcaacttgaataagcacttactaagtagagccacattcttaatgtccaaaacatgaattcccaaccccccccccccttgttccttggggaggcactttttttctctgaccaccacatttccagtaaacctggagcgaaaatacttaagctttgtaagtatcccctttggtatggcaaagaaagacatcatatatctcgggaggctacttagcactgaattaatcaatgttagccatcctccggtggacaggagttttcctttccaactactttgatgtttttcaaagcattttatcacatctttacaatcggcatttcttaatctcctatagtgaatagggatacctagataccggaatagaaatttaccagtggaacaaccaaagagctccatgtattcattgttaaactcgttcgcttcaccaaagcaatataattagtttttatggaaatttatcttaagactgttaattgctcaaggcaaattttgctacatgacactgcttatgtgtggttttagctctaggacactgcccaaactcacttttgagggaaaacactccataaacatggtaatttgctagtggataccacgccgattaaaataataatttccggttgaagaggagagagaaaacgcgtgaaatgtcaaaaatgcccttaggcccacatgtcagctctatctcctatctctcttctcctcttccagcccacatgtcgctccccgccggccgccggccatgcccgcgcagatggcggtggaggcagtcgttgaactcgtcaccatcgacgtgacatcgagcggctcatcgagatgttcatctggaataactcgttggagaagggcgcccgccgatcggccgcggtggttgtctccatgctcaccgaggggaagttgaatgctctctgcgtcaccggcacccccggcgccatcgagtcagtcgcgtcgctgcattacgcttacctcgacgagctcaacctacttggcctccatgcccatccaccactctctgctaccgagcttgccgctagcaaaatcagtcgttccaccgccgggtatatttcgccggcgtcgtgtgcagtcgcctcccccaatctgcccttgcctctgaccatcacacgcgtgtttgtggggggaggggggattgcggcatcgtgattcggcgattgggatgagagaagggcggcagcggcggctgcggcggtggccatgagtggctcagcgtcgacggggatggggtgcgggagctacggctggcttgcgtcggccggcggtgggaggaagggcgggggtagggggtgggggt

SEQ ID NO: 35240 - DNA, 6110 bp, Oryza sativa
ttcaaccagaaattagtgttttaatcggcgcggtgtctactggcaaattaccatgtttaaggagtgttttcctctaaaagtgagtttggtagtgtactagggctaaaaccacacataagcagtgtcctgtagcaaaattttcctttgctcaatgacataaagcaataacgtcaggttacgagctttttctaatttatgatccataaaaaaaactatatcattggtatattgcaagatagagagaccatcattcattagatgatgtcgtactacttctgcaatttgccgatcaactttggctctattaatcagtatagccaatacgtcagctataatattaaataatatgggtgataagggatcaacttgatgtacccattctggagttgctttgaacagttgcaactgaaagcattggctgaggagcagcaagcagttgtgaaagggctgcagaaggttgaacaagaactagctgcttcagaaagtgatgggcccgtttctgaggttttccgcaaggtataatttaattccctacctttttggatgctatgtgtttagtttagatggctactgctccatccgttttttaatatatgatgcagttgactcttagatacatttgaccattcgttttattcaaaaatttatataattatcatttattttgatgtgatttaatttatcattaaatattttttaagcatgatttaattttttttatattcgcacaaaatttttgaataagatgaatggtcaaacgttcgttaaaaagtcaacggcgtcacacacacacacaaagaaacagaaagaaatttacttgacgttcctttctgtttctttaagtatggaatcttaataaacagatatatttactgatggttttgcaatctagactttgaaggagttcactgatgcttctggagctgatgtaaggtccttgtcagcactatatgctgaagtagtaagccatcgtgatccaacaagctagctttcaaaactgttccatttggattcgaaccccttttaacatactgagcggtgacagggtaaaagtgcggatgcactagcctattattttggagaggatcctgcaaaatgtccttttgaacaaggtaatattcgatctggaaattctggatgattcccaattctccatcaagttgtggtagaacaagttaatttttacagttttgtgaacactgcttgagagcatcattttttccaaacatgtgacattcactagctcaaagacagaatcaataattaaacgtctgacagaaattattagatctaataaatacttgaattttacgaattgtcggatttaggaagttggtgctctttcgttctagaattttcaagaccaggtaaatctcctgttgtgttcacgatcatctaaattaataaaagcttatatgctggaacagagggaaggtctaaagtactgaacaaagctaaggcttagggtgtgttacagtgttagttcacgttaaaattgaaagtttggttgaaattgaaacgatgtgatggaaaaattgaaagtttatgtgtgtagaaaaattttgatacgatggaaaagttgaaagtttgaagaaaaagttaaaaactaaacgagggcttagtaaatggacctgggctcatgggctggtgccatctgcagcacgttaggtcccatacagaaaatggaccactgaatttaccgtacctaatccctgatcggcaaaaagatctaggctgtgtttagttcatggcaaaattaaaagttaggttgaaattaaaacgatgtgacgaaaaagttggaagtttatgtgtgtaggaaagttttgatgtgatggaaaagttggaagtttcaagaaatattttgaaactaaacacggcgctagtataaattaacaagagttcctgttaactgattgattatgtgtgctaaattcattttcttttacctttttaaattaaaaagctatcaatgttcgtatgttctgattaattttctgatcatgtacatatgtaactgtaaatcttatactatatatttatatgtacactgtaggaggttctcctacagtatttttcctctaaaacaaatgttaatggagactttaagtagtaacagcatccttctttcctcttgctcacattaattttgaattcgacaaaaatacagtcacgtctactcttctgaactttgtggggttatttcggaaagcacatgaggagaacataaagcagattgaggctgacaagaagaaagcacagaaggaggctgagaaggaggcaaaccaggaccgtactcctgtaaagtctaaagatggactagtagatagatcaccaagatcacccttcaagtgacatgcatcactaccaattttttattgtccagccgggtcagtttcttctcgacaaatgccacctccattaccattagccattcagaccatcgtggctcaagcaatgcatggctccatgtgcttgagaaacaaggtaacgcatcattatgtacattgcacacttttgttcttactgtattgatgaaattatagtcgtcattaattatcattctaacctataatatatatttttttattttgtataggtactcaacccatgcatgctttctagcttgcaatactgtacagagctaactccgcaactatatatttaggtccgtttgtacatatttcactagacatttcttctattgtacatgtatactagaagaaataggtcagtagttgtaaactaggaaaaggaaagaacgtaagagaggatcagtaggtcagaaaccataggaaattaaggattagtgttacctcgaggcagttacagcaactggtgaatgtatagcaatgttcctgactcgtgctatcaaatgacgcatccaagtgtacaccttttatctagaagcatgtgttgtcaattaattaaaaccaagctagcttacttatatggttatggtgttactgtagctgttaatgtatagaaagaaaaggaacgaatacaaacttcgaattaaatttgaaaatatatcgctcattcaattttatttcaggaatattcgggatgtaaattttttaaaaaaaatatatcgtcgatctcgcacaatcattgagcgaaaatgaggtgacgtcgagggcggtatcgtgcggtgaaaaagcgagaccgcgtgctctcgcggaaagaacgagcgagaccgaacggtatcgctgaaaagagagcgacaccgtaccaatgcttcctttggttagtgactaatgacgtaattaactatttaataataacaattagtgattaattaataattaattaatcactaattaatcattttgaaatccggtatcgctgattggttcagcgagaccgttcgttctcgctctttcatttcgcaagaccgcacggtctcgcgcttttctcgtgcgatactacccgtgacgtcacgccacgtcactttcgcgtaatggttgtgcgaaattgacgttatattttttaagaaattttgaatcctgaatatttctaaaaataaaatgaatgaacagtgtatttccaaattttattctacaaacttccatgcttgcatattgaggagtgtttgctttcggtcagattcagtctagtacatactccctccgtcccaaaaaaaacttaacctaggagagtacatcccctcctaggagaatgaatctgccatcttctcttaggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaattgttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcaccttcatgccatctccgatttgggtgatcttggacttgatggaaggcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggatgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccccgaagtcctccctccctccctttctctttctggcgccgacaggtggggcccacctgtcggtcgtcccctacctcggtcgttggagccggagctccaaccgcccgcgccaccgccttctccgctccacgtcgcgcctccactccgcgcccgcacctcgcgcccacgtcgccgcccctttcccgcatctcccgcgcgcgcgcgcccgcaagtggtgggggattt

SEQ ID NO: 35241 - DNA, 1902 bp, Oryza sativa
gccgtcggtggccgtgcctcgccgtcgcctcgccttgggcggccggtcggccttgaggccgagccgagcccggccgacgccaccctcgcctcccctttgagccaccgcctggtggggcccacctgccaggcgccacctgcttcccttttgagccgctgacctgtggggcccacgtgccggcgcccccttcctctcctctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacaccctgcatttctattaaatgttgcattcttttacaatgtcatgtgggatgggtcctattacttagccatttattgtttaccatatgccattgataacctgtgtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttccgggcatggcgacatgtgtggaatcgtgtcttgggggtacagttgtacacctctggctagagtaaaactattcgaatagccgtgcccgcggttatgggcgatcaaccagattcaccgtgattagtctcacccctaggggagcttaatgaactggtgtagttgaggtggttggttgggcctgttgcaacgtggtgtagcgttggacagtgattggttaatattgattaattactacagctgttttactgctttcaactactgttttgaaatgcctgctttatgcaaaagaacccctagcttcctttggttatatcctgcatcatacctcctcttccggtatgacttgatgagtacagtgggtagtactcagtcttgctctcttttcccccacaccagagttgaagttcttctcagttggagccgtctcagagagggggtttttggttttctcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcaacttaaaaattctggttcgagaatttctgggtgtgacagattatacat

SEQ ID NO: 35242 - DNA, 20373 bp, Oryza sativa
cgaggagggggaggagttagatctgtctagaggaaggggaaggaatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcccaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtgaagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccccttgcagctgtaataatattctgtgtgtccagattcgccatccctcaaaaatctttcatagtattatagaagggaggaagtagtaatttttccagctgtagtaatgttctttgctttagatagggtgttgtgttactattggactctcttttgcttgtgcttttggtttctgatgtaaaatactccatcatgttcttgtttggagagatgaatctttaaatctgcaaagttgcagaccggttgtttgagccttagcatgattgattggggtgggtgggggagacgtgtgtatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttcacgtcgaaggacgtggttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaggagttaccattgtgtccatccctgggtgccacgtggtgggctgctattggccggaaggcgaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatcggttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttgaaaattacttttctacaaatatttagtgaaaaaagattcgttgtgaaaaaacaaaggggatgtaattagtttatcacaaattagaaaacaaatttaaaatttttaaataaatttcagatcaaatttgacaaatttcgtatatcttcccaaaaatttaaacctaaataacatttagtttttgctcttaattttctagcgaaactaatgtatggatttaatcataatttttaaaaaataaaaaataataacttttattttttaagttgggcattaaatgattatattgcttttattttgtataagttaatttttttcatatgaaaatttattgggtaggtaccacatatgtataggatggataatatagtcattttaaaatatttagcggtcaactaatggtcaactaatggagatgggtatagaggagatcaaaatgaaaactcaggggtatataagggatgatgtcaaattcaggggtattgaagggattgagtaaattttcaggggtatttagggaattttctataagtttttctaatttgctaactctttatttatctcatacccttttgttctttctttttttttttgcctctcttgtttttttgcctttttgcgcagttctcaccctaacccaggccgaaaatgaggcccgaactctgatcggggacctcaccattcatgagtatagctgtcacgccctaaaaatcctaaatatataaattgttgtttaattggaattattagaatttattttaaaagcctacaagttaaactctaataatctaggaaaattttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttcttctacctccggccggccggccttgctagctcgagccggcccttttcccctccaaatccgcacccaatccggccctttttctttcgattgtttgaggagtttttatcctctcatcctcctctatctttacccccaaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttttttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagtttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatggttatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacccctcacaataattatggatgttataactggtaataatttgcttagctcctggtttggagttagaactgtacagccgggtatggttgttcaggatggttgggcctgtgcagcatgggtgtgttgctcagtgttgattaaaatttctgattaattactccactgttttacttctcttaaatgttttgctaaatgctgcttttgcaaatgagcctatattatgccatcatttggtatccttgtgcacttgcatatttgctgtgtggtttgttgagtatgtcatatgctcattcttgcaataatcatcaaacctcagttgaagataaaggatccagaaggagaagacgtttggcttataccccagttgagctgcctgtgggagtggagctgaagtcatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctggggtgatggccacgtgggacaccagcgcgccgatgacctggtcgaacatccctgtagcgtccaccatcgggtgcagctagccgctggcactacctgactatgtccaccacgctctgccacgaccactgcggcatctcatcgagagccttctccgtcatcttaaccaggctcggcggtgtcgacacctccgccatcgccgctattgctgccaccatgtccatgaactcaaccgtgcaccgcccataaaatcccccaagatgcggcgctggaggagaggatagagagagaagagagataggagagttgaaatgtgggtccaagagcatttttgatatttaatgtgatttctctctcctcttcaaccgaaaattattattttaactaatgatgtgttcatcagcaaatatccacgatccattttttaagagtgtcttccgctaaaagtcacttcggacagtgtcctacagctaaaaccataaagtcatgatctcctgtaacaaaatttgtcaaaaaattagcacaaatgaaaaaaaactaacacagaggttaactaactgtaatagcaaaaaggaaagaaaaacacgttacaatttttttttaactagggctggaaagcccccatttccattactaaaaatgaaacgacaagtacaacagggttcagaagtaaaaaaacaaaggaaaaggctaaacacaacccccttactggagcagcaccctgacaagagagactaacagtttctgcagggcaagctttacagagatcaccagatcacagacaacaagatgtaaagggcagacctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcagaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgccttttcactggaacataatgaccatgagcatattccaccgagggaattgaaccacactagcacacctttcgttttgcatctaattgttaagtttgcaactgttcccacatttgctatccagctcgcctaatggggtcttggaagtattggagagagatgagaagtgcttcctgaaaacgtttgcttctgtcaaaataggaacaaatccctgaaaaataatgaactttccaagctttcaagtgtcaagtacctccgttcttattgttctgctcccttgactgggacatgtattcaaataggtattaaatacatcatctacacctttaccctgcagaaggaaatgtgtcttcaataacaatactaacagtaaaacaaccatcatttactaaagtatgagcagttagccacactaacacagtaatcaagttatgtatatcataaactaggaagtttatagaacaaatctcagctgacccattaccgagagttaaaaaacacaagacattgcaagtgagaatggactagatgatgtaggttgggcagttggtctatggtggattggtggtctagtaggtgcaatttggcgtggctttcctagttggtatgaagccagcagcctatattctcattctcataaaggcacacaggaaaatactagcaactaaaccactactatgcagagctgatctccctggcttcttttcatatttttgttgtactccaatctgaagttacaaaattttccattagttcctttcaccccttgtttcatcagttctcaagttcgtgttttagttagagaacatggactctgccacatctcttaacttcgcttcagaatctgaacagccagtattgttggtctgtgaccattcagttttattcgtttattcagcttttcattagtacttaacaaagaataccaaatattcaaagacaataccggtccaactgagttgactgctgtattttgataatttcagcctggtttgtctagtgtcagaaataacaacataggtaccagttttttgttagtactaacaaaatacgtattagaaactatcatatgcaatgataccttcaaatttctatcttcttcaatgcattcttctagaccagccaatccaccaaatgcaattaaaaggtgcctgtacaatgaagcgctcataaatgacaagatagccatacacccacaatggtggtcctgtgtatttttcagtttatgatgaagaatagagtggattctactttgcctctcatacactatcatctgagtctagaaatcaaccctgaataataaaaacggacatcttccacccctcaaccaccaaaaccagtttaaaatatccccttaagagcaatacaatgtggttataaccaaggttctaaatagaagtgatagttacaacaatggtggtagtgggttactaccattaccaagactaggtagtgctacgaaatagcgcattggaacaaagcagctgcaatagcagctggatagcaacctcataagcaaaatagcagctgctattgcattgcacactgaagtctgaattatggagcttaaatttgtgttgtgttaactcttgttgattacttgctttgtttttttaaatagagtaaagacctaattaaccatatctctattttctttttcataccaaggctccaaaagcagctaccctaatgagggttaaaaaaaaaaagcagctacccaaataactcgacactggtaaattcaggccagaggcaaattatgtaaactatataaaatgatgaaccagctgttcaacaatcaaatcactggaaccatcaaaataagttaaccagtaacatcaccaagtcaatagctggtctgggttcaagaactatctgactggatcacatatattgttgtatggcctattttatagtaagagtctgcaaaacactccctataacaaaaaagaaatggacatgtttaatgcaaaaaaaaaaaaaatcacattcagtttgtatatgttcattttttattcatagaaaaaaatcctgagacactggcaaaaaataaataaatagtcatcataaattatgtcatagcatctagaaacaaaattttgcattcagcagaccaaacaactatggaaaaaactgaattgaattctgaaggtagtccaagggaagtgaaaacaatatacctaaaggaaggtaagatcagctcagatgaactaatgatctttccatgctctgaagtaccaatgatataatcatatccttcctaaaaatatgaaaataattagtaataagtactctttaccctgtactacatgtgattgagctaaagaaaattgtaccttgtatggtgaatcactgaaaactccacccaaatttgaagcataccggaccttatagccccaatacaattccatttcatccctgggagaggaaggggaaacaattttccttttgcaagctagatgaaaagtaaatgacaatatgtcattaatcaatatcaaaataacagacaaaattcaagttgtagaaggcaagagctaaaataactgaatggggatataagtatgcctagtgaacaggaatgataaaatgaagcgacgcattacgaagtgaatccaaagagcacacatgtgaactgaaaatagtcactctgtttttatgttacataattaaaaaatccatccattttgctctgcagaacaagcagaatggtttacttgaaatctgtagtaacgcatgggcactatattattcatatgagaaataaaatcctgatagttgttgcagattttaaccagtcattgcaaatggttaggaaggatacttcagggtatatggattaaagaacatataccgagtaattcagatactaaaaagttctagacgaagaaaaatcaatagagccacatctgaagcctgggtcaagtgaataaatcatttacctgttgtaatgtcacgattggtacccatggcaatagttactctcttccctggttctagcatttgctcaaccagaacattctgtgatgaaagacaattatagtaagtttattggatgagaacgtacattatctaatacatgatccacaaaggtgtatatgatacaatatacattacagaatctgagaatcaagtttatcatgttgagtacaaaaagatttgctcagaggcagacatgcaactatcaatataaagttgctagacttgccaaagcactctggccaggcagctatcagcattgaagctatcccatgctgattttcatgtttcaccattctcttacccttgccccatatgcagttatgggtaatggccatggcatgcctctttggtgcaaagatatctagctgacattttgacagcttacagttatgctatgctatccttgccaaaaaaaaaaaaaaaaaaaaaaaaaaaaaaaaaaaaagcagtatgccctttgttttggcccagcttcaggtatattgaaagcagccttactgggagtatagaaaattcaccaagcaaacctatattacagaaaaaaaaaaagaagtattttgttggaataacaaactatgaactcgtttgttatgtgtttggtatgacaccacccactagcttaactttttttcattcaattaggctaagtttacaggggttaattcctcggagtaaaggaaagataaagatagttgggtttatgaaaaggaaagggtttggttttttggaaaggaaggaaagtgtttgctctttccggaagtaagagaaggactaccttgggtaaggtaggacttctcggagtaagggaaagcaaggtgatacgtgttcctagcagtagttaagcgctattgttgctagggagcccatgtatgggggtatgcgcgtggaggaaaacgcccagaagggcaatttttgaagccctacggcactttagggtaggtttaggtactctgatacctaaaccagaatttaaatgcatttaaacgcatttctattagtgaattaattattcgattcatgcactgggttagtttgtttggacaataaccatattataacccctttgtttataactgaacagatattttatagtctaagccgtcaggttacaactgaacggatatttaattacacaagccacttgagctaaaaaatagtatgtgaaaaaaatttggataccttactcaatccgacatcaacaaatgtccccattgaacgatccccatccaatgttacgcctgtctaaattcattctactgtaagcattctgttgaatcacacatgaaaaatgtggtaacaaaaacttttccgataccagcattaaaataggaatgaaaaaacagtcgaaacaaatccaattatgctattagtactcatgttcctttttttagttgagaagcacaaaagggtgccattctaaattgaagccttaacaaagttgagcatgtgggataggcagtcctcccccaagaagtaattctacattaacacaaccaacagctcagccattcagtaacacagcaggatcaaagagcgtataaagtttatttttccttttagcatgaactacgagaattgataaagtccaaagcaaatgaattgcatattgtgcatgtaatgaatttctgaaagctacgaagaacagataaaacaactgcacaattcatgggcatactatataatatttataaaaggtgcagacatggccacgcatgacagaattattaaacatgatgaatcattcgaaataccaaacactgcatgtgcttatgcatagttcaattgatgtgctcatatacatatagtttcattcaaagatgtccctaactagttaaatatgaaatttacaacttctcctagttttctttttgaccgaaaaacagtagcagatctctagaacttgtcctaaattaacaagagaccgagaggtaagtcgcatagctcctataaatctaggaagacaaacttcatatttttctagttaggtaaaaaagttaaattacattggccatgtgatatttactttgatttctctctcctatttcaatccgatatactaaaataatggtaggagtgtattatagcaaagagaaaattcgctctatgcacagaaaaaatggcagtaccaaaaatagcacaaaacattcccccattcgaccagaggcacacgccactagtttttcttcaatttgtagcgcttccgtcacattttccgtccaagtgattggttagccaaacatgaacttgggctcctcggctaattgaacttgtccacggtggtggctgtggtggggtggccagcagcggaggagggggtgcggccgatggagaaggtgtttgcatcgctgatgaggtcttcacataggtgtggcttatggagatggagaacacagagaggtgcagcttgtcgtcgacgcgtagcagttccctgtttctctctagaaaaaaaatcagagaggaaggggccagtggtcatcacgcacagcaggaattgagtaagaagatgagacagagatgtgaagaattcagtgctcggcaatgcaaatcaatggtgtcctatggaatttaatttttgcaaatcaatgattgaacaggacacaacaaactagttcatcatggggttcggggatgggaaggagtcgttagccgccactgtcatcaacgaccttgatcccatgtgccgtcgcacggcgcaaactgccagccgccgcatgcttgcctgctctcccagccaaacgagcatgaactgatgaagaacaggaatggtccaacccaaccaatcacgtgtgaatacagagaggactaagggtaaatttgtcattttctgtccctattcacatggaaacactcgtcttgcactgcagttttggtggaagtgctatggatggaagaaaaacgagtggcctgtgctaccagtcgaaagcggaaattttagttccttgtttctgtgctacagatcgaattctctatagcaaatagccagaaaactagagtacccatggccgtgacatgattttagttccccacacaacaaatgccgacttcgccaaccatatacgataaaagcaattcaacgtggataccaatagcactgcaagaagagagagatcaccttcacgaaattcagaccactcatgcttgcgcaaatggtgtggtgcatcgagtgggggcagcaacccctgcatacaagaagcgacacggatcaatcagcacctccaggaaacccaacatgccgatgatgcaatcatgttcttcagcggtctcaccacaaacttcaagttgttgtgcatcgggaaaaggcgtcggcgcaggtattgtggagtctccagatactgtaggatgcgaacaaggaagcgcgcgccactctctacgtcatcgccgctgttctccactgaggaattgctgtcgaagaccacaacctcgtcgatgcggaagacggtcgccgcgcgggcgatttgtcctgccagctgaaacagggtaggagctagagccgcaagaactagcaagggaaggtgagaaaggatggatactgacgagggtggcgagctcgagggactgggcgttgtcgatgatggatccggcgacggcgatgctcaccgtggtcttccgattcggaaccgccacgtcatctccgttcttcttctgttgcagctgcttcttcctcttcttgtcgtggacgatttcttcgtcagccgctgaagcctctgcggctccgcagtcgtcctttcgcttctttttcttctccttcttgcaccgggccttcttggaggccgctgctgcctcggcgtctccggagttcattgcggcggcggcggcggcggcggaggcgtaggggggactaacacgagaacacctccaggttccaggagtcgagaggccgacgaaagtagggtagtgcgtaagggcccctcatgtgccggccttcggccagcgaaggggtttgcgtggagtcggactgttttcggcccagcgataagtctactttatgtccctcagtaccgtttgagtttcattgtatctctcaaccgtaaaaggtggagaagtagaaatagaggctcattcagattggtcgcccgatcgaatttgagaaatattgggcgctgacgtcagcgtccgatttacgtgcagaaactactttaaattgatttttctcttaaattacttatccaaatcataatccgattgcaccattaaattcgttgcaattaaattttcaaaacaagaccacacatggatatattccgacgaaaaaaaattagcttattattgaattatttttaaatattgcacaatgttccactaggtatatcggaattgtttcactaagtagatcgaaaatgtttcactcgtttaaatcgggtgttgtttcaccttatgtaaaaacaatgtttcaacaaatagcgaaagaatgtttcagttcgctgcaacattagatctatacatagtgaaacattgtgagtatactaggtgaaacatttttcggtggaaaaaaaatataccaaattcccttaatagggggtttccaaaatatatggatttttttgttgcaatggaatgtttcgttcactgcaacattagatctatacatagtgaaacattgtaagtacactaggtgaaacatttttgatggaacaaaaaataaactaaattcccttaatagagagtttctaaaatatgtgggttttttttgttgcaaaagaatattttaattcactgcaacattagatctatacatagtgaaacattgtgagtacattaggtgaaacatcttttgtgaaaaaatgggagggagaagtgggtgggcccaccaggtgatcacgtgggggagcgcccgatccggctcaccctgcgcgggtcacccggggtgaatcattatcgagtataaattgtccctcattttttattaaaaccagtacaaatcgataatatggaataagttcacactgcatcccttatgtttgcgcattgagtttaaatcacatccttaaaccacaatactggaaatcttaaacctccatattacaaaaccgggttaaataagatcctaagacggtacggatgattgttttggctgacatggcatcctagctagaaaaagaaaataaaaaataatatgtggggctcatatgtcggaggctttcttcttcctccaattctcccctctcttcccaatctcactccacaacggcaaccgctggggaaggaggggcggctgaagaaaagagacaaggcgatggtggcgttcgagccaaccaaaggtcgctctcgtggcgcaaacagctcgggctcaccttggttgctgagctccacctcgttggggaggccacaccgcccgctgggtacgacgcaacgacatggcggaccaacgccaaagatttcacggcaacagaggggatgaggtggtggatgacgatggtgacctcaaggctatgggagggggggggggagagaaagcctgagcaggcagtggggatgaggaggtgaaggatgatagcgagctcgaggttgcagcagtgacacggggagaaggggggtgaggggtggaggagggagctcgagtgagccggagggaacaaggtggtgggacgatgtgggcgagctcgagacgtgggtgagcttgaggccacaacagtggctaggggagcctgagcaagcggcatggcctccccatgcgaggcggagcttggtgaccagtctggccgccgccattgccttatctcctctctcctgccactatgaccgcctctcccctcgctgccatcagccattgccgcgaagagagatcgggaagagaagggaggtgtggaaagagatgggaatagaggagagaatgattggaggaagaagaaaacccgtgacatgtcaaccccc
